United States Patent 11,098,302 (IDENTIFICATION OF POLYNUCLEOTIDES ASSOCIATED WITH A SAMPLE) - sequence listing, part 63

SEQ ID NO: 216532 - DNA, 628 bp, Homo sapiens
  misc_feature: GYAE6OF02JFYE9.1.34.D01.1.454.CMB.1.raw
  modified_base (101)..(101): a, c, t, g, unknown or other
  misc_feature (101)..(101): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (323)..(323): a, c, t, g, unknown or other
  misc_feature (323)..(323): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (615)..(615): a, c, t, g, unknown or other
  misc_feature (615)..(615): n is a, c, g, or t
tcagacgagtgcgtcacgaccggtgctcgatttagatcgtctgtgttgggtttggggagtcagaccctgtcaggacacagcatggacatgagggtccccgntcagctctgggctcctgctgctctggctccaggtaccagctgtgacatccaattgacccagtctccattcctcctgtctgcatctatgganacngatcacntcactgccggnagtcaggccatcagcgattcttagccttggtncagcagaaacnggtcagcccctnagtactcgtagtctagnggtancagtccatagtttcgacgtagggtccggacctntacggtagttcaggtcgcagtcacgtnttacggngggaaactggtaactctactaccgatacgtacttcgacgactaacgtcgtcgaacgtcgtaccgtaggtaaactttacggttttgaaccttttaaaagtttacgttcccgtaaggttaaccctaaacgttacgtttaactaccgttaaacggttacccccttaaaggggttccgtaccggttacccggaacgggttaacgggaaaccggttaaggtaccgggtaattacccgaaacgggttccgttagggtaccggtntaacccgggaacc

SEQ ID NO: 216533 - DNA, 725 bp, Homo sapiens
  misc_feature: GYAE6OF02ICOFQ.1.34.D01.1.454.CMB.1.raw
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccatccctccctgtctgcatcgtattggagacagtacgtacaccatcctacgttcggccgggcgagtcaggccatcagcgtattctttacgcctggttcgcagacaaggaaaccgaggggccgacnccccctnagtactcgtaagtctagtggtcgactactacctagatttcggacgtaaaggggttccggggtaccccagttaccgaggtttacagggttacggcgtaacgttgctagtcggtagggaactaggtaacttaccgaccttacctacacttactacacggacctacggtcccttggacctacgtaccgttaaggtaacgtttacggtttactaacctttaaatttttaaccgttacgttacggttaaacctaacgttaacgtttaaacgtttaaaccgttaacccggtttaaccccgtaagggtttaccggttacccgggtttaccgggacccgggtaaacgggggtaaccccgtaaaggggtaaccgtaaacgggttacccgaaaccggtaccggttagggtacggtacccgtagtaaccccg

SEQ ID NO: 216534 - DNA, 744 bp, Homo sapiens
  misc_feature: GYAE6OF02HSMSS.1.34.D01.1.454.CMB.1.raw
tcagacgagtgcgtcacgaccggtgctcgatttagatcgtctgtgttgggtttgggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagcctggttgcagcaagaaaccgagggcgacgcccctacagactcgtacgtctagtggtgctatccagtacttggacgtaacggggtcgggtcccagtccgtaggttcgaagggttcggaccgtagtcgccgtagtccgtaggggaacctaagtaactttacccgaacctttcctaccgtaacttaacgtccgtaacggtaccgtaacgcccgttacggaccgtaacggtcccttaagggttaaaacgtttagttttttacggaaccttttaaatttttaacgtttaaccgttacggtttaaacctaaaccggttaagttttaaacctttaacgttaacccgttaaacccccgtttacgggttaccgggttaacccgggttttacccgggaacccggttaaccgggggtaaaccggtaacggggttaacgggtaaacccggttacccgtaaaacccgggtaaggtttaccggtacgggtacccgtaccggttaaccccg

SEQ ID NO: 216535 - DNA, 549 bp, Homo sapiens
  misc_feature: GYAE6OF02IC8N3.1.34.D01.1.454.CMB.1.raw
  modified_base (474)..(474): a, c, t, g, unknown or other
  misc_feature (474)..(474): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(516): a, c, t, g, unknown or other
  misc_feature (515)..(516): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
  modified_base (540)..(542): a, c, t, g, unknown or other
  misc_feature (540)..(542): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
tcagacgagtgcgtcacgaccggtgctcgatttagatcgtctgtgttgggtttgggagtcaggccatcagcgattctttagcctggttgcagcagaaaccagggcgacgccctcagatcgtagtctatggtgcatccagattgcgaagggtcgggtcccatccgaggttcagtggcagtgcatcgtgggacagattacactctacactatcagcagcctgcacgctgaagtattttgactaatttataactgtacaactgtatactactaccccgttagtcggtacgttaccggccgaagggtaccgaagggttacggaataccgaaaccgaacgttcgtgggctacgaccacgtatcgttcgtacttcacgttcctccccgaccttccctactaccggtacctaccgttcgtccgttacggacggtccgggggtcttacgggaacgaccgggtaccgtaccgtaaagttcggncgcgcgcgcactacgacnctntcactacgncngtgcncncnnctcncgcncncngcntncnncnannncnctcan

SEQ ID NO: 216536 - DNA, 722 bp, Homo sapiens
  misc_feature: GYAE6OF02IFYB7.1.34.D01.1.454.CMB.1.raw
  modified_base (234)..(234): a, c, t, g, unknown or other
  misc_feature (234)..(234): n is a, c, g, or t
  modified_base (498)..(498): a, c, t, g, unknown or other
  misc_feature (498)..(498): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctcgtggcctcccgaggtaccagctgtgacatccaattcgaccctagtcctccactccctccctgtctgacattctagttggagactagactcaccatcattggccggngagtcacgccatcgagcgtatttcttacgccgtggttgacacgacgaacgaaaccggcgggaccgtacgccccctagacggtacgttacgtagtccgttagtgggttcacctacgtaccgaagtagttacgggacgttaaacggggtccgggtaccctacggttaccggtaacgggttcgtaacggtcggaacgttaggtcgtaacctcggtttacggtacgggaactaacggtacttaccgtaaccgttccgtactaaccgtntaccgagcctacgtcctcggactacgccgttaagtacgtttagtcgttaacgtttaacttagttactccgtaaactaaccttaacgtttaagttaacttacccggttaacccgtacggttacggtaccggttacgggtacccggtaacggggtaacccgtaagggttaccgtaaacgttacccggtaaacggttacccggttggtacgtaccggttacgaaccc

SEQ ID NO: 216537 - DNA, 737 bp, Homo sapiens
  misc_feature: GYAE6OF02I5TG9.1.34.D01.1.454.CMB.1.raw
  modified_base (178)..(178): a, c, t, g, unknown or other
  misc_feature (178)..(178): n is a, c, g, or t
  modified_base (195)..(195): a, c, t, g, unknown or other
  misc_feature (195)..(195): n is a, c, g, or t
tcagacgagtgcgtcacgaccggtgctcgatttagatcgtctgtgttgggtttgggggagtcagaccctgtcaggacacagcatggacatgaggtcccgctcagctcctgggctcctgctgctctggctcccaggtaccagctgtgacatccaattgacccagtctccatcctccctntctgcattctattgganacagagtaaccactcgacgttagcccgggcgacgtcaggccatcagcgtattccgtttagccgtggttcgactacgactaacgaaaccgaggggccgacgaccccttacgaaggacttaccggtaggttactaggtacggtgacctaacgtacccgagtagttggaccggtaacggggttccggggtcccctaggtaccgtacgggtttacagggtcgacgttagtacgctaacggtcggttacgggacgtaagttacttaaccgtaaccttacgacgttaaccgtactaccgtaacgaccgtacggtccgttaccgacgtagtacccgttaggtaacgttacgttttaggaccttaaagtttttactacgtttagaccttaaagtaccgtttaatttaaaccgttaccggtaaacccgtttaccggtacgggttacccggttacggaaccgggtaacgggttaaccggaaaggtaaccgggtaaccgttaacgaaacccggtacggttacgtaccgggtaccgttacgtacccgtaaaccg

SEQ ID NO: 216538 - DNA, 612 bp, Homo sapiens
  misc_feature: GYAE6OF02F8C1Y.1.34.D01.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttggccgggcgagtcaggccatcagcgtattctttagccttggttgcagcaagaaaccgagggcgacgcccctnagatcgtagtctagtggtncatccagtattggacgtaagggtcgggtacccagtccgtaggttcgagttcggcaggtgacagtcgtgggacagtacttacactctacactatcagacacgcctgcgacgtaccgtagtaagtacgttttacgacttaaagttttacttacttagtaactaaacgttagttaattaacgttaaccgttaccccgttaaggtacggtaccggtttaccggaaccggtaacggggtaacccggtaagggttacggtaaacgtacccgaaaccgggttaaccgttcggtacggtaccgtggtaaccccg

SEQ ID NO: 216539 - DNA, 640 bp, Homo sapiens
  misc_feature: GYAE6OF02G3K3T.1.34.D01.1.454.CMB.1.raw
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagacgtcaccatcacttggccgggcagtcaggccatcgagcgtatttcttacgccgttggttgcagacaacgaaaccgngggacgaccgcccctagacgtactcgtagtctagtggtacgcactccagtattggacgtaaggggtccggtaccctagtccgtaggttcgaggtcggactaggtagacctagttcggtacggggaacaaggttacttaaaccgacttcctacgaacttataccgacgacgaacgtccgttagacctacgtacgttagtaagttacttttcgaaactttacgttttaacttacgtacgtaactaacgttatttaacttaaacgtaccgttacccgttaggtacgttaccggttccggaaccggtaacgggtaaccgaagggttaaggtaaccgtaccgaacgtacgtggtacggctacgaccg

SEQ ID NO: 216540 - DNA, 511 bp, Homo sapiens
  misc_feature: GYAE6OF02G7QM2.1.34.D01.1.454.CMB.1.raw
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagactcgtagtctagtggtgcatccagattggacgaaggtcggggtcccagtccagggttcagtggcaggtgcatcgtgggacngtatacnctctcactatcagcagcctgcagcctagagtntttgcttaatttntatntactatagtattatacgtaccctagtcggtacgttcgggacgtacgggaaccaagggtagaacgtacaacggtacgtgtacgcgtgaccg

SEQ ID NO: 216541 - DNA, 424 bp, Homo sapiens
  misc_feature: GYAE6OF02JZ2UN.1.34.D01.1.454.CMB.1.raw
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
  modified_base (398)..(424): a, c, t, g, unknown or other
  misc_feature (398)..(424): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagtattacactctcactatcagcagcctgcagcctgaagattttgactaatttattactgtacaactagtattatacgtaccccctagtggaccgttcggaccgaggggaccaggtggaagcaaccgaacgtgtgctgcacatccgtgtctcactcctccgccctctcacgcactcgctgcgcgggtctagccgaaggcngaactgnacnnnnnnnnnnnnnnnnnnnnnnnnnnn

SEQ ID NO: 216542 - DNA, 708 bp, Homo sapiens
  misc_feature: GYAE6OF02J0TMM.1.34.D01.1.454.CMB.1.raw
  modified_base (187)..(187): a, c, t, g, unknown or other
  misc_feature (187)..(187): n is a, c, g, or t
tcagacgagtgcgtcacgaccggtgctcgatttagatcgtctgtgttgggtttgggggaggtcagaccctgtcaggacacagcatggacatgagggtccccgctcagctcctgggctcctgctgctctggctcccaggtaccagctgtgacatccaattgacccagtcctccatcctccctgtctgnacttctattggagacagagtccacatcacttcgcccggggctagtcacggccatcgagcgtattctttacgccttggttgcctagacgacgaaaccgagggccaacggtccccctgagtacgtcgtaacgtctagtggtgcatccgagtattgacgtaagggtcggtaccctagtccgaggttcaggtcgacgtagtcgctacgtcgtacgggactaagtacttaaccgacttaccttacgaacttactacgtacgtaccgaacgttcccgaggtactacggccgttaaaccgtagttaaacgttttcggtaaccctttaaaatttttacccgttaacgtttacgggttaaacctaaacggtttaaccggtttaagttaaaccttcccggtttaaaccccggttacgttaccggggtaccggttttaaccgggacccggttacgggtaaacccggtaacggggtttaacgaaacggttacccgttaaccggaaccgtttaggtacggtaccgtacgtaccg

SEQ ID NO: 216543 - DNA, 611 bp, Homo sapiens
  misc_feature: GYAE6OF02FI2VJ.1.34.D01.1.454.CMB.1.raw
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcagtcaggcccatcagcgattctttagccttggtgcagcaagaaaccngggcacgcccctnagatcgtagtctagtggtncatccagtattgacgaaggtcgggtacccagtccgtaggttcaggtcggcaggtgcagttcgtaggggacagtacttaccacttctacactatcagcacgtcctgcacgcctagaacgttattttacgacttaaattttacttacgtacgttacctaaacttagttaaactttaacgtaaccgttacccccgttagggttacggtaaccgggttccgggtaacccgggtaacgggggtaacccgtaaggggttacggtaaaccgtaccgtaaacccggtaacggttacggtacggtcgtacgtaacccg

SEQ ID NO: 216544 - DNA, 642 bp, Homo sapiens
  misc_feature: GYAE6OF02FYR74.1.34.D01.1.454.CMB.1.raw
  modified_base (222)..(222): a, c, t, g, unknown or other
  misc_feature (222)..(222): n is a, c, g, or t
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttggccgggngagtcaggcccatcgagcgtattctttagccttggttgctagcaggaaaccagggcgacgcccctnagatcgtagtctagtggtncatccagattgcgtaacggtgggtcccagtccgtaggttcaggtggcaggtgactatcgtagggaacagtaattacaccttctacctaacttactaccgagaccgtacgccctcggacctaaccggtcccttaggaaacgtttagttttacgacgtttaaatttacgtttatacggttaactaacgttaagtttaatttaaccgttaaccgttaccccgttaacgggttacgggtaaccggttaccgggtaaccggtaacggggtaaaccggtaagggtaaccggtaagttaacccggaaaccggttaacgtaggttacggtctacggtaacccg

SEQ ID NO: 216545 - DNA, 568 bp, Homo sapiens
  misc_feature: GYAE6OF02H247K.1.34.D01.1.454.CMB.1.raw
  modified_base (199)..(199): a, c, t, g, unknown or other
  misc_feature (199)..(199): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (370)..(370): a, c, t, g, unknown or other
  misc_feature (370)..(370): n is a, c, g, or t
  modified_base (522)..(522): a, c, t, g, unknown or other
  misc_feature (522)..(522): n is a, c, g, or t
  modified_base (536)..(536): a, c, t, g, unknown or other
  misc_feature (536)..(536): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatccctccctgtctgcatctattggagacagagtcaccatcacgttgccgggngagtcaggccatcagcgtattcttagcctggtgcagcagaaccgngggcacgccctnagatcgtagtctagtggtnctatccagtattcggcgtaacgggtcgggtacccagtccgtaggttcaggtggcaggtcgactagtcgagggacagtactacactctactactanacgagtacagcctagcacgtctagtaagtactttgacttaatttacttactagtactaaatagttattaacgtaccgttacccgtaggttgtaccgttcggacggtaacgggacgtaaggtacgaacgtaccaacggtcgtgggtcggtacncggaacctaccgtnttcgtcgttcctactacgttccctaccgtccg

SEQ ID NO: 216546 - DNA, 639 bp, Homo sapiens
  misc_feature: GYAE6OF02IH03J.1.34.D01.1.454.CMB.1.raw
  modified_base (203)..(203): a, c, t, g, unknown or other
  misc_feature (203)..(203): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagntcaccatcacttgccgggcgagtcaggccatcagcgtattctttagccttggttgcagcaagaaaccaggggaccacgccccctcagacttcgtagtctaatggtgcactccgagtattcgacgtaaggggtcgggtacccagtaccgaggtttccaggttcggacgtaggtcgactacgttcgtacggggaactagtaactttaccacttacctacgaacttactacgacgcctacgcctcgcacgccttagtaacgtacttttacgactttaaattttactacttacgtaacgtaacgtaacgttaattaacgttaaccgttaacccgttacggttacgggtaccgttaccgggaccggtaacggggtaaccgtaagggttacggtaaacgtacccgtaaaccggtaaccgttggtacggtccgtgtaaccccg

SEQ ID NO: 216547 - DNA, 533 bp, Homo sapiens
  misc_feature: GYAE6OF02IPRBS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaaccagggcgagcccctcagatcgtaggtctatggtgcatccagattgcaaggtgggtcccatccaggttcagtgcagtgcatctgggacagattacgactctacactatcagcaggcctgcagcctagaatatttgctaaatttattactgtacaataagttaatacttaacgtaaccccgttagtacggtacggtttaccgggccgtaacggggaccgaaaggtacggaaagtaccgaaccggtaaactggtacgggactgaacccg

SEQ ID NO: 216548 - DNA, 498 bp, Homo sapiens
  misc_feature: GYAE6OF02GDP79.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcatccctgtctgcatctattggagacagagtcaccatcacttgccgggcgagtcaggccatcagcgattctttagcctggttgcagcagaaaccagggcgagcccctnagatcgtagtctatggtgcatccagattgcgaaggtcggggtcccatccgaggtttcagtggacagtgcatcgtgggacagtactacactctcactatcagcagcctagcagcctagaagtattttgactaatttattactgtacaactagtattatactaccctagtcgtacgtcgaccgagggaccaaggtggaactcgaaccgatcgtgactcg

SEQ ID NO: 216549 - DNA, 787 bp, Homo sapiens
  misc_feature: GYAE6OF02FSOEP.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttacgcctggttcgcacgacaacgaaaccgagggccgacgcccctcgagtactacggtacgtctagtggtcgacactccgagtattgacgtaacgggtcggggtacccattccgtacggttacaggtggactaggtcgtctacgttacggttcgggaacgtaaggtaactttaaccaccttaccgttactaaacgtttactaccgaacggtacctccgtacccgttcgacccgaacggttccggttaaagtaaacggtttagtttttaccgaaccgttttaaaattttaccgtttaacgttaccggttaaccttaaaagttaacggtttaaaccttttaacgttaaaccccggttttacccccggttaaagggtttccccgggggttaacccggtttacccgggggtaacccgggtaaaacccggggggtaaaccccgggttaaaagggggtttacgggtaaaaacccggttaacccggtaaaacccccgggtttaaggttacccggggttccggttacccgggtaccgttaaacccccgg

SEQ ID NO: 216550 - DNA, 670 bp, Homo sapiens
  misc_feature: GYAE6OF02F582M.1.34.D01.1.454.CMB.1.raw
  modified_base (225)..(225): a, c, t, g, unknown or other
  misc_feature (225)..(225): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
tcagacgagtgcgtcacgaccggtgctcgatttagatcgtctgtgttgggtttgggggagtcagaccctgtcaggacacagcatggacatgagggtccccgctcaagctcctggggctcctgctgctctggctcccaggtaccagctgtgacatccaattgacccagtctccatcctccctgtctgcatctattggagacagatccaaccatcacttggccgggngagtccaggccatcagcgtattcttagccttggttgcagacaaggaaaccgagggcgacgcccctanacgatcgtagtctagtggtncatccgagtattgacgtaaggggtcgggtaccctagtccgtaggttcgaggtcggacgtacggtgactagttcggtagggactaaggtacttaccacttacctacgtacttactacgaacgcctacggccctggaccacggttcctaaggtaagtttacgttttacgactttaaattttacttacgttacgttaactaaacgttagtttaacgtttaacttaaccggtttaaccccttacgggttacggtaacccggtttaccggggaaccggtaacgggggtaacccggtaagggttacggtaaacgtacccgtaacccgggtaacgttacgggtaccgggtaccgtccgtaacccg

SEQ ID NO: 216551 - DNA, 719 bp, Homo sapiens
  misc_feature: GYAE6OF02GUZV7.1.34.D01.1.454.CMB.1.raw
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacngatcaccatcacttgccgggnagtcaggccatcagcattctttagcctggttncagcaagaaaccgngggcgacncccctnacgactcgtagtctacgttggtcgcagttacccaggtactttcggacgtaaacggggtcggggttacccaggtccgtaggttccaaggttcggactagtcgctaagtccggtgggaactacggtaactttaccacgttctaacctacttacgtacaaggtccaacgtcccgttggaacccacggtacccttaggtaacgtttacgtttttacggaccctttaaaagttttactttacgttacggttaaacttaaccgttaagtttaaaccgttttaccgttaaaccggtttacccccggttaagggttccggttaaccggggtttacccggaacccggggtaacgggggttaaaccctaaccgggggttaacgggtaaaccggttaacccggtaaccgggttaacgttccggggtacggttcccgtacgtaaccccgg

SEQ ID NO: 216552 - DNA, 448 bp, Homo sapiens
  misc_feature: GYAE6OF02H85U6.1.34.D01.1.454.CMB.1.raw
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
  modified_base (332)..(332): a, c, t, g, unknown or other
  misc_feature (332)..(332): n is a, c, g, or t
  modified_base (354)..(354): a, c, t, g, unknown or other
  misc_feature (354)..(354): n is a, c, g, or t
  modified_base (416)..(416): a, c, t, g, unknown or other
  misc_feature (416)..(416): n is a, c, g, or t
  modified_base (418)..(448): a, c, t, g, unknown or other
  misc_feature (418)..(448): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtcaactagtattatacgtacccctagtggacgttcgccagggaccaaggtggaagtcaaccgacngtgctgcacntctgtctcnctcctcccgctactctacgacnctaaccgtcgtctaggacggtccggggtcgtaccggacgaacgggccgtacgtaagtaggcngnnnnnnnnnnnnnnnnnnnnnnnnnnnnnnn

SEQ ID NO: 216553 - DNA, 692 bp, Homo sapiens
  misc_feature: GYAE6OF02GNZHC.1.34.D01.1.454.CMB.1.raw
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcgccgggcgagtcaaggccatcagcgattctttagcctggttgcagcaagaaaaccgngggcgagcccctnagatcgtagtctagtggtncatccagtattgacgtaagggtcgggtcccagttcccagggtttccaaggtcggctaaggtcgacgtagttacgtaggggtaaccaagtaacgttaaccctacgttaccgtctaaaccttattccgaaaggcccaaggtcccttagggacctacggtaccctaggaaacgtttatttttacgaacctttaaaagtttttaacttaccgtttagtaaccctaaaagttacgttaaacgttttaactaaaccgtttaaccccgtaggttacgggtaaccggttttaccggggacccggtaacgggggtaaacccgtaaaggggttacggaaaacgggttacctaaaacccgggtaaccgttgggtaaccggtacccgtaggtaaccccg

SEQ ID NO: 216554 - DNA, 731 bp, Homo sapiens
  misc_feature: GYAE6OF02GMB7K.1.34.D01.1.454.CMB.1.raw
tcagacgagtgcgtcacgaccggtgctcgatttagatcgtctgtgttggggtttgggggagtcagaccctgtcaggacacagcatggacatggagggtccccgctcagctccgtggggcctcctgctgctctggctcccaggtaccagctgtgacatccaattcgacccagtcctccatccctccctgtctgcatctattggagacagagtcaccatcacgttggccgggcgagtcacggccatcagcgtattctttagccgttggttcgacgagacaagaaaccgaggggccgacgcccctagagtactcggtagtctagtggtgactagtccagtattcggacgtaacggggttccgggtaccctacgtcccgtaggttcgaggtcggctaggtcgactacgtcggtacgggaactagtaacgtttaccacgttcctaccgtaacttatccgaacggtacaccgtcccgtagccgtaacgtccgttaagtaaacggtttctttttacggaaactttaagttttaacgtttaccgttagttaaaccgtaaacgtttaagtttaactttaaacgttaaacccgtttaccccgggttagggttaccggggttaacccggtttacccggggaacccggggtaaacgggggttaaacccggttaaaggggtaaccgggttaaccgttaacccggaacccgggtaagttaccgggtacggaccgttaccgacccg

SEQ ID NO: 216555 - DNA, 645 bp, Homo sapiens
  misc_feature: GYAE6OF02H7FRK.1.34.D01.1.454.CMB.1.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtcctccatccctcctgtctgcattctagttggagacagacgtcaccatcactggccgggcagtcgaggcatcancgtattcttagcctggtncagcaagaacngggcgacgccctanagatcgatctagtgcgcataccagtngacggtaaggtcggtccactcgaggttcaggtcggactgcgcacgtcgtagggactagattaccgtactctactacgtancgtacncacggtcttcggacgtcgtaccgttaggtaacgttaatttcggtacttaaacgtttttaacgttacgtttaacgtaccaaacgttagtttaaaccgtttaaacttaacccgtttaacccgttacccggttacgggttacggttacccgggtaacggtaacccggggttaacgggaaccgggttaaccgggtaacgttaccgtaaacccggttaacgggttacgtttaacgggaccggttaccgttacccgg

SEQ ID NO: 216556 - DNA, 669 bp, Homo sapiens
  misc_feature: GYAE6OF02GIJRO.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctttgacatccaattgacccagtctccatcctccctgtctgcatctattggagacagagtcaccatcacttgccgggcgagtcaggccatcagtcgattcgtttagccttggttgcagacaagaaaacccgaggggccgaacgccccccgtacgaacgtacgttccggttaaggttccttagtagggtcgcctaactcccgaaggtactttggaccgtaaggggtccgggggttacccaagttccgaaggttccagggtcggacgtagtcgcaacgtcggtagggaactaggtactttaccacgtttccactactacacgagcacgccctgaccacgtcctaagtaagttattttgacctttaaatttttactacgttagtacaaacgttgtttaagtttaactaccggttacccgttagttacgggttaccgtttaccggacccggtaaacggggtaaccgtaaggggttacggaaacgttacccgaaaccgtacgttacggtacggcttaccggactaacccg

SEQ ID NO: 216557 - DNA, 604 bp, Homo sapiens
  misc_feature: GYAE6OF02GWFXZ.1.34.D01.1.454.CMB.1.raw
  modified_base (354)..(354): a, c, t, g, unknown or other
  misc_feature (354)..(354): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgattctttagcctggttgcagcagaaccagggcgagcccctcagatcgtagtctatggtgcatccagattgcgtaaggtcgggtacccagtccgtaggttctagtcggcagtcgacntcgtgggacaggactttaccgactctacacgttatcacgcaacggcctggaccgagtaccgtagtaaagtacttttacgtacctaaattttagttaacgttgttacctaactagttaactttagttaaccgttacccgttacggtacggttacggttacccgggccggtaaacggggtaacccgtaagggttacgggtaaagtacccggtaaacccggtaacgtttacgggtacggtaccgtcgaacccg

SEQ ID NO: 216558 - DNA, 643 bp, Homo sapiens
  misc_feature: GYAE6OF02IJSA0.1.34.D01.1.454.CMB.1.raw
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatcaccatcacttggccgggcgagtcaggccatcagcgatttctttagccttggttgcagcagaaaccngggcagcccctnagatcgtagtctatggtgcatcagtattgacgaagggtcgggtcccagtccgaggttcaggtggacagtgacagtcgtaggggactaggtacttacgacctactacaacttatcaagccacggccctaggcacgtacctagtaacgttattttcgactttaaagttttacttacgttagtaacctaaacgtacgtttaatttaaccgtaaaccggttaacccccttaagggttacgggtaacccggttttaccggggaacccgtaaaccgggggggtaaaccctaaaggggggtaccggtaaaacggttacccgtaaaaccgggtaaccgttacgggtaccgggtaccgtacgtaacccg

SEQ ID NO: 216559 - DNA, 563 bp, Homo sapiens
  misc_feature: GYAE6OF02IXTH5.1.34.D01.1.454.CMB.1.raw
  modified_base (288)..(288): a, c, t, g, unknown or other
  misc_feature (288)..(288): n is a, c, g, or t
  modified_base (437)..(437): a, c, t, g, unknown or other
  misc_feature (437)..(437): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatcaccatcacttggccgggcgagtcaggccatcagcgatttctttagccttggttcgcagacagaaaaccgagggcgacgcccctnagactcgtagtctagtggtgcatccagtattggacgaaggggtcggggtacccagttccgaggttcaggtggtacaggtcgctagtcgtagggaacagtacttacactctacactactcagcacgcctagccacgctagaagttctttnacttaatttactacttacgtacaactagtttaattacgtaccgttacccgttaggttcggtaccgtttccggacgaacggggtaccgaaggttacggaacgtacgaacgtacgtggcgtcgtgacc

SEQ ID NO: 216560 - DNA, 795 bp, Homo sapiens
  misc_feature: GYAE6OF02HTFX3.1.34.D01.1.454.CMB.1.raw
  modified_base (196)..(196): a, c, t, g, unknown or other
  misc_feature (196)..(196): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagatcaccatcacttggccgggcagtcaggccatcagcgtatttcgtttagccgttggttcgcagacaacggaaacccgaggggaccgaacgcccccctacgaacggtacgttacggttaaggttcctaaggttcggggttacgacctaacgttacccgtaaggtaacgtttacggaccggttaaagggggttcccgggggttaacccctaacggtttcccggtaacgggtttccgtaaagggttcgggaccgtaaggttcgacgtacgttaccggtaggggaacctaaggtaactttaacctaccttccttactaaccgttactacgaacggtcctacggacccttagggacctacgacccgtttaaggtaaacgttacgtttttacgaactttaaagtttttaacttaccgtagttaccgtaaaccgtttaagtttaaacgtttaaacgttaacccggtttaacccccgttagggttaccgggtttaaaccggtttccgggaaccggtaaaccggggttaacggtaaacgggttacgggtaaaccgttaacccgaaaccggttaaccgttagggttacggaccgtacgtaacccg

SEQ ID NO: 216561 - DNA, 525 bp, Homo sapiens
  misc_feature: GYAE6OF02GLV6I.1.34.D01.1.454.CMB.1.raw
  modified_base (197)..(197): a, c, t, g, unknown or other
  misc_feature (197)..(197): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattcttagcctggttgcagcagaaccagggcgagcccctnagatcgtagtctatggtgcatccagattgcaaggtcgggtcccagtccaggttcagtggcagtgcatcgtacgggacaggattacacgtctcactatcagccagcctgcagcctagaatattttagactaatttattactgtacaactagttaacttaactacgtaccctaggtaggtaccgtttcggaccgtaagggacctaagggttaggaacgtccgaaacggtacctgtacggtcacgtacc

SEQ ID NO: 216562 - DNA, 708 bp, Homo sapiens
  misc_feature: GYAE6OF02I1E3W.1.34.D01.1.454.CMB.1.raw
  modified_base (199)..(199): a, c, t, g, unknown or other
  misc_feature (199)..(199): n is a, c, g, or t
  modified_base (325)..(325): a, c, t, g, unknown or other
  misc_feature (325)..(325): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctagttgganacagagtcaccatccacttcggccgggacgagtcgaggccatcgagtcgtatttcgttacgccttggttgcagacaacgaaaccgagggcacgcccctagagtacgttacgtacgtctagtcggtnacgtactccgaagtacgttacggaccgtaacggggttccgggtaccccagttaccggtaggtttacgaggtcggacgtaaggtcgtacgtaagttccggtaaggggaactaacggtaactttacccgaaccttcctaacctaacgttaacgtacctaacggaccgtaccgtcccgtaggtaacctacggtaaccgttaagtaaacggttatttttacggaacttttaaattttactttacgtacgtaacctaaacgttagtttaaacgtttaaccgttaacggttaccccgtacggttacggtacccggttacggaccggtaaaccgggaacgtaacgggtacgtaacgtaacgtaaccgtacggtgtacggtacgtacaccg

SEQ ID NO: 216563 - DNA, 678 bp, Homo sapiens
  misc_feature: GYAE6OF02JMCZN.1.34.D01.1.454.CMB.1.raw
  modified_base (198)..(198): a, c, t, g, unknown or other
  misc_feature (198)..(198): n is a, c, g, or t
  modified_base (220)..(220): a, c, t, g, unknown or other
  misc_feature (220)..(220): n is a, c, g, or t
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagatcacatcacttgccggnagtcaggccatcagcgattcttagccgtggttgacagcaagaaccgagggcacgccctnagactcgtagtctagtggtnacgtactacagtattcggacgtaagggtcgggtacccacgtcgtacggttacaggttaggacctagtacggtacctaagttcgtacgggaacgtaggtaactttaccactttacgtaccctaacttaagttaccgaaacgggtcctaacgtcccgtagggtacccaacggttacccgtaggttaaaaccgtttaagggttttaccaacttttaaacgttttaacttaccgtaggtttaaaccctaagttaacgttaactttaacgtaccgtttaaccccgtacgggttacggttaccgttaccgggaacggtaaccggggtaaacgtaaggggtaaccgtagtacccgaaacggtcgtacggtacgtacgtcggtaacc

SEQ ID NO: 216564 - DNA, 659 bp, Homo sapiens
  misc_feature: GYAE6OF02F8T62.1.34.D01.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (307)..(307): a, c, t, g, unknown or other
  misc_feature (307)..(307): n is a, c, g, or t
  modified_base (370)..(370): a, c, t, g, unknown or other
  misc_feature (370)..(370): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcacatcacttgccgggnagtcaggccatcagcgtattcctttagccttggttcgcagcaagaaaccgacgggcgacgcccctcagattcgtagtctagtggtnctactccatattcgacgaagggttcgggtcccatccgaggttcaggtggcagtcgcagttcgngggaacaggtacttaaccacttacgtactaacttataccgtaagccgaacgtcccgtaggtcctaccggacttaggtaaacgttacgtttttacgtaccgttaaattttaccgtttaacgttagtaaccttaacgtaagtttaaactttaacgtttaaccggttaaccccgttacgggttacgggtaaccggtttccgggaaccggtaacggggggtaaccctaaggggttacggtaaaccggttacggaaacccgttaagttacgggtcggtaccgtacggtaacccg

SEQ ID NO: 216565 - DNA, 629 bp, Homo sapiens
  misc_feature: GYAE6OF02G5A0G.1.34.D01.1.454.CMB.1.raw
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgattcttagcctggttncagcagaaccngggcacgcccctnagatcgtagtctatggtgcatccagtattggacgaagggtcgggtacccagtccgaggtttcaaggtcggactagtcgcatccggtagggactaggtacttaccgacttcgtactactactcgacgctaacgcctgaccgagccctaggtaaacgttacgttttacgaactttaaattttacgttacgtacgttactaaacgttaagttaactttaacgtaaccggtttaaccccgtagggtttaccgggtaccggttaccgggacccgggttaaacgggggaacctaaacggggttacggtaaacgttaccggtaacggtaaccgttgggtaccggtacttacggaacccg

SEQ ID NO: 216566 - DNA, 809 bp, Homo sapiens
  misc_feature: GYAE6OF02JN6OF.1.34.D01.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagacgagtgcgtcacgaccggtgctcgatttagatcgtctgtgttgggtttggggagtcagaccctgtcaggacacagcatggacatgagggtccccgctcagctcctgggctcctgctgctctcggctcccaggtaccagctgtagacactccaattcgacccagtcctccatcctccctgtctgcatctatgganacagcgtcaccatcacttggccgggtnagtcgacggccatcagacgtacttactttacgccgttggttgctaggctaacggaaaccgacggggacgtaccggcccctacgaagtacttaccggttaggtaccttagtacgggtcgtacctacgtaccgtaagtacgtttacggacgtaaacggggttcgggttaccccaagttacccgaacgggtttacgaacgggttcgggaccgtacggtacggtaccgtaacttccggtacgggggtaaccctaaggtaacctttaacccgaccgttaccgttcctaaaccgttacttaaccgtaacggtacaaaccgggttccctaacggtacccgtaaacgggttcccttaaggtaaaccgtttaaggtttaccgtaacgttttaaaacttttaaccgttaccggttaccttaaccggaaacctttaaggtttaaacctttaacgttaaacccggtttaaccccttaagggttaccgggttaccggttacccggtaaccgggtaacgggtaaacccggtaaaggggtacggttaaaccggtaccgtaaaccggttaccggtaggttaccggtacgacggtacccg

SEQ ID NO: 216567 - DNA, 789 bp, Homo sapiens
  misc_feature: GYAE6OF02H9LVP.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgaccctagtcctaccactcccttccctggtctgctattacctagttgggacgacgtagtacgtacaacctattccgacgttgggcccgggcgaacgtccgacggaccatccgaggtccgttaatttccgttttacggccgtttagggttacgacgtacgaccgaaaggtaaacccggtaggggaccctaccggacccctcgtaaacggttacgttaccggtaagttcgtttaggtcgggtcgacctacgtaccggtaaggttacgttcggtaccgggttaacgggggttcccggtacccttacggtccggttaacggggttcgtaacggggttacggaccgttaggtcgtaaccggtttaacgtccgggtaggggtaaccctagttaacgtttaaccctcccgttaaccttacgtaaaccttacgtcgaaccgtaccgtacgtccgttacgacctaccggtgttaacgtagtttacctttgtaactttaacgtttataccgtgtaactacgtatttaaccgtacttaacccggtccgttagtaaccgggtcggtacgaaccgggtacggtaacggtaacgggttaccaaggttcccgaaacgttacggtcggacggtacctaggtaccc

SEQ ID NO: 216568 - DNA, 674 bp, Homo sapiens
  misc_feature: GYAE6OF02GMX67.1.34.D01.1.454.CMB.1.raw
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttcgccgggcgagtcaggccatcagcgatttctttagcctggttgctagcagaaaccgngggcgacgccccnagatcgtagtctagtggtcgactactaccgagtagttcgacgtaaggggtcgggtcccagtccgtacggttacaggtcggcgtagtcggactacgttcggtacggggaactaaggttactttaaccgaccgtttaccttaaccgtaaacctttaacgttcccgaaacgggtaccctaacggtacccccgttaggacccggtaaacgtcccgtttaagggtaaaacgtttcggttttttacgaaaccttttaaatttttaccgttaaacgttcggttaacctaaacgttagtttaaacttacgttaaccgtacccgttaggtacgggttacgtccggaacgtacgggtacaagggtacgactacgaaccgtgtcggtagtcacgtaccg

SEQ ID NO: 216569 - DNA, 747 bp, Homo sapiens
  misc_feature: GYAE6OF02IC6O2.1.34.D01.1.454.CMB.1.raw
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtcctccatcctccctgtctgcatctattggagacagagtcacatcacttggccgggngacgtcaggccatcagcgtattctttagcctggttcgcgagacaggaaaccgagggccgacgcccctanagatcgtagtctagtggtncatcaagtagttgacgtaagggtcgggtcccacgtccgaggttcaggtcggacagtacgctagtcggtaggactaagtacgttacctactctactacgtactcgacgtcacgtcctacgaccgacgtccgtaggtaaacgttcgttttacgaacttttaatttttaacgttaaccgttagttaacccgaaacgttaagtttaaccgtttaaaccgttaaccccgggtttaaacccccgttaggggtttaccgggtaaccccgggtttacccggggtaacccgggttaaaacgggggtaaccccgttaaaaggggttaacgggtaaaccgttacccggaaacccggttaaacggtttcgggtaaccgggtaccgttaccgggtaacccgtaaacccttacgtttcccggttacgtttaccctttacccgtaaccgtttccccccgtttaccccggtaacccg

SEQ ID NO: 216570 - DNA, 692 bp, Homo sapiens
  misc_feature: GYAE6OF02HQBCZ.1.34.D01.1.454.CMB.1.raw
  modified_base (202)..(202): a, c, t, g, unknown or other
  misc_feature (202)..(202): n is a, c, g, or t
  modified_base (492)..(492): a, c, t, g, unknown or other
  misc_feature (492)..(492): n is a, c, g, or t
  modified_base (516)..(516): a, c, t, g, unknown or other
  misc_feature (516)..(516): n is a, c, g, or t
  modified_base (677)..(677): a, c, t, g, unknown or other
  misc_feature (677)..(677): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacataccaattcgacccagtcctccatccctcctgtctgcattctagttgganacagatcaccatcacgttcggaccggggcagtccgagccatccgaggcctatttcgtttacgccgttggttcgacgagacgaacggaaaccggagggaccgaccgccccctagagtacgtacgttacgtctagtggtacgacagttaccagtagttcggaacgtaacggggtccgggtaccaacgtccgtaggttacctagggtcggaacgtgtcgacgtacgtcggtcgggaacgtagtaactaccgactttcctaacgacttagaccacggcaccggtctacggaccncggtaccgttaaggtaaacgtttntttacgtaacttaaagtttttaacgaccgttaggtaacctaaggttacgttttaaataaccgttaaccgggttacccttaaggttaccggttacgggtaccggtaaccggtaacggggaactacgggtaaggtaaccgtaaccgaccggtaacgttcgggngtaccggtctaaccg

SEQ ID NO: 216571 - DNA, 689 bp, Homo sapiens
  misc_feature: GYAE6OF02I42Y3.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatccctccctgtctgcatctattggagacagagtcaaccatcacttcggccgggcagtcaggccatcagcgtattctttagccttggttcgcgagacgaaggaaaccgagggccgaccgcccctagagacgtcgtagtctagtggtcgcactcagtattcggacgtaacgggtcgggtaccctagtccgtacggttcgacggtgtcgaggttgaccgtacgttacggtacgggaactagtaacgtttaaccaccttaccgtacctaacttactaccgacgtacgacgtcccgtgaccgacgtccgttaagtaacgtttactttacgtaacttttaaatttacgtttaacgttacgtaaccgtaaacgttacgtttaacttaaccggttaacccgttaacccgttacggtaccggttaccggttacccgggtaaccggtaaccgggtaaccggtaacgggttacggtaaaccgttaaccggaaccgtacgttaccgggtacggtacccgtgtaacccg

SEQ ID NO: 216572 - DNA, 761 bp, Homo sapiens
  misc_feature: GYAE6OF02HSSUY.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcacctatccacttcggccgggtcgagtccgaggccatcagcgtactttctttagccgtggttgcaggcaagaaaccgagggccgacgcccctcgagagtcggtagtctagtcggtgcctatccgagtacttggacgaagggtcgggtaccccaagtccgtaggtttcaggttcgggacaggtagccgtaagtccgtacggggactaacggtattaacctaccttacgtactaacttacgtacgacgctaacgtccctaggaccgtagtaccgtacgttaaagtttacgtttttaggaacctttaaagttttttaaaccgttttacttaaccgggttaacccttaaaacgttaacgttttaaacgttttaaaccgttaaacccgggtttaacccccgttaaccggggttaccggttaacccgggtttaccccggggtaaacccgggtaaccggggggtaaaccccggtaaaggggtttaaccgggtaaaaccggttaacccggttaaaacccggtaaccggtttccgggttaaccgggtcccgttaccggtaaaccccg

SEQ ID NO: 216573 - DNA, 443 bp, Homo sapiens
  misc_feature: GYAE6OF02IRYYF.1.34.D01.1.454.CMB.1.raw
  modified_base (333)..(333): a, c, t, g, unknown or other
  misc_feature (333)..(333): n is a, c, g, or t
  modified_base (354)..(354): a, c, t, g, unknown or other
  misc_feature (354)..(354): n is a, c, g, or t
  modified_base (396)..(396): a, c, t, g, unknown or other
  misc_feature (396)..(396): n is a, c, g, or t
  modified_base (400)..(401): a, c, t, g, unknown or other
  misc_feature (400)..(401): n is a, c, g, or t
  modified_base (403)..(404): a, c, t, g, unknown or other
  misc_feature (403)..(404): n is a, c, g, or t
  modified_base (407)..(407): a, c, t, g, unknown or other
  misc_feature (407)..(407): n is a, c, g, or t
  modified_base (411)..(443): a, c, t, g, unknown or other
  misc_feature (411)..(443): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaaacagtattatagtaccccctagtggtacgttcggccaggggaccaaggtgaagtcaaccgactgtggctgcaccatcctgtcttnatcttcccgccatctcgaacnctactcgtctgacggcgggctcgggccaaggccgcaagtagncganntnntgntcgnnnnnnnnnnnnnnnnnnnnnnnnnnnnnnnnn

SEQ ID NO: 216574 - DNA, 700 bp, Homo sapiens
  misc_feature: GYAE6OF02JDZYH.1.34.D01.1.454.CMB.1.raw
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (436)..(436): a, c, t, g, unknown or other
  misc_feature (436)..(436): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccgaattcgacccagtcctccatcctccctgtctgctatctattggagacagagtcaccatccacttgccgggcagtcaggccatcagcgattcttagcctggttncngcagaaccngggcacgcccctnagatcgagtctagtggtcgcactaccgagtagttacgcgtaacgggtcgggtacccacgtccgtacggttacgacggtggcgtagtcgacgtatccggtagggaccgacgtacttaccgacttcgtacctaacgtacttacaacgtacgtaccnccgtacgtacgaccgtaccgttagtaacgtttacgttttacgaacgttaaaccgttttactttaaccgtaggttaaccaaaccgttaagtttaacgtttaaaccttaacccggttaacccccgttaacgggttacggttaaccgggtttacccgggtaacccgggtaaaccgggggtaacccggtaaacgggttccgggtaaacggttaaccccggtaaaccggttaaaccggttcggtaccgggtaccgttaccggtaacccg

SEQ ID NO: 216575 - DNA, 464 bp, Homo sapiens
  misc_feature: GYAE6OF02HJLJB.1.34.D01.1.454.CMB.1.raw
  modified_base (440)..(464): a, c, t, g, unknown or other
  misc_feature (440)..(464): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtggggtcccatccaggttcagtggcagtgcatctgggacagattacactctcactatcagcagcctgcacgcctagaagtattttgactaatttattactgtacaactagtattatacgtacccctagtcggtacgttcggccgaggggaccaaggtggaagtccgaaaccgtaacgtgtggctgaccacctatctgttcttctacttccctttcccgcccttcctcaccgctacgttccgtctcggacggccggggtcgttcgggaccgaacgggccgacgtagtacgannnnnnnnnnnnnnnnnnnnnnnnn

SEQ ID NO: 216576 - DNA, 687 bp, Homo sapiens
  misc_feature: GYAE6OF02HD7WV.1.34.D01.1.454.CMB.1.raw
  modified_base (257)..(257): a, c, t, g, unknown or other
  misc_feature (257)..(257): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagcctggttncagcaagaaaccagggcgacgcccctcagatcgtagtctagtggtgcactccagtattgacgtaagggtcgggtacccagtccgtaggttcgaggtcggactagtcgacacgttcggtacggggaactagtaactttaaccgtaccttacccgtactaacgtactacgacgacgaccgtcgtacgacgtaccgtacgttaagtaacgtttacgtttacgtaacttttaaacgttttaaccttacgttacctaaacgttaacgttaacgttttaaacgttaaccttaaacccggtttaccccggttacggttacccgggttaccggttacccgggaaccggggttaaaccgggtaaccgggttaacggggtaaccggtaaaccgtaacccggtaaccggttacggtacggtacggtaccgtacgtaacccg

SEQ ID NO: 216577 - DNA, 559 bp, Homo sapiens
  misc_feature: GYAE6OF02JCABS.1.34.D01.1.454.CMB.1.raw
  modified_base (260)..(260): a, c, t, g, unknown or other
  misc_feature (260)..(260): n is a, c, g, or t
  modified_base (427)..(427): a, c, t, g, unknown or other
  misc_feature (427)..(427): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttcggccgggcgagtcaggccatcagcgattctttagcttgggttncagcaagaaaccaggggcgacgcccctacgagatcgtagtctatggtgcatccagtattgacgaacgggtcggggtacccagttccgaggttcaggtcgcgtagtgcatgtcgggacagtatacgactctacacttactcagccagcctgcctagacctggaacttntttagacttaattttattacgtagtactaacgtattacttataccgttacccgtaggtcgtaccggttaccggaccggaaggggtaccaagggttaggaacgtacgaaccgtagtggtacggtctagacccg

SEQ ID NO: 216578 - DNA, 578 bp, Homo sapiens
  misc_feature: GYAE6OF02G52AS.1.34.D01.1.454.CMB.1.raw
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatccctccctgtctgcatctagttggagacagagtccaccatcacgttcggccgggcgagtcacggccatcagcgtattcttagccttggttgcagcaagaaccgagggcgacgcccctanagatcgtagtctagtggtgctacnccagacttggacgtaagggtcgggtcccagtcctaggttcaggtcggctagtgacattcgagggactagtactacacgtctcaactcacancgtacgcctgacncgtctagattctttacgattaatttactacgtagtaacctaattgttaaacttactaaccgttacccgtagggttcggtaccggtcccggtacggaaccggggtactaaggggttacggaacgtaccgaaccggtacgtggtaccgtgtacgtaccc

SEQ ID NO: 216579 - DNA, 663 bp, Homo sapiens
  misc_feature: GYAE6OF02FMURE.1.34.D01.1.454.CMB.1.raw
  modified_base (224)..(224): a, c, t, g, unknown or other
  misc_feature (224)..(224): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttggccgggngagtcaggccatcgagcgtattctttagccttggtgcagcaagaaaccgagggcgacgcccctgagactcgtagtctagtggtcgcactccgagtagttcgacggtaacgggtcgggtcccacgtccgtaggttcgaggtcggcaggtcgactagtcggtagggaactaggtacttaaccgtaccttctacctaacttagtaaccgtacgaccgtacgtcccgtagtaccgtaacggtcccgtaaggtaaactttagtttttaccaacgtttaaattttaactttacgtacttaaccgtaaacttagttaactttaaacgttaaccgttaacccccgttaggtacggtaccggtttccgggaacggtaaccgggaccggtaagggtaacggaacttacccggaaaccggtaacggttggtaccggtactcggtaacccg

SEQ ID NO: 216580 - DNA, 532 bp, Homo sapiens
  misc_feature: GYAE6OF02FPYJ0.1.34.D01.1.454.CMB.1.raw
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcagcccctnagatcgtagtctagtggtgcatccagattgcgaagggtcgggtcccagtccaggttcagtggcagtgcatcgtagggacagtattacacttctacactatcacgcacgcctgacacgcctagaagtntttgacttaatttatactntacaatattattactacgtaccctagtcggacgttcggaccgtaaggggaccgtaagggtacggtaacgttaccgaaacccggtaagttcggtacggcctggaccc

SEQ ID NO: 216581 - DNA, 860 bp, Homo sapiens
  misc_feature: GYAE6OF02GBA3F.1.34.D01.1.454.CMB.1.raw
  modified_base (331)..(331): a, c, t, g, unknown or other
  misc_feature (331)..(331): n is a, c, g, or t
tcagacgagtgcgtcacgaccggtgctcgatttagatcgtctgtgttgggtttgggggtagtcgagaccctgtcaggacacagcatggacatgagggtccccgctccagcctccgtggggcctcctgctcgctcgtggctcccaggtaccagcctgtgacatccaattcgacccctagtcctccactccctccctgtcctcgcactactagttggaacacagtacgtccaaccagtccaacgttcggcccgggcgtaagtccgacggacccaagtccaaggccgtattaccgtttacgccgtggttcgactacgcgtaaacggaaaccggngggtacgaccgttaccccctacggaagaacgtttcccgtagttactaacgttggggactacctaacgttcccaaaggtactttcggaacgggtaaaccgggggttccgggtaaccccgttacgtacccggttaaggggtttaccggtaacgggtaccggggcttaacggggtaccggtacccgtagttcccgggggttaacggggaaccctaaggttaaccgttaaaccgtacccgtaccgttaacccgtaacttaacgtaccgtaaacgtcccggaaccgtccgtaacgtaccgaccgttacctaaccggttaattaaccggttttacgacgttttaaactttaagttttacccgtaagttaaccgttaaactacggtttaaactttaaccgtaaccggtttacccgtaaccgggttacggttaacccgggtacgttaacccgggacggggtaaacccggtaaggggttaacggaaccggtttaccggaaccggttaaccggtagggtacggttacgacggttacccg

SEQ ID NO: 216582 - DNA, 710 bp, Homo sapiens
  misc_feature: GYAE6OF02HPMBP.1.34.D01.1.454.CMB.1.raw
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagacgtcacatcacttgccgggnagtcaggccagtcagcgattctttacgcctggttncagcaacgaacgagggcgacgcccctanacgatcgtatctagtggtgactactaccgagtatttcggacgtaacggggtcgggtacccaacgttccgtaacggtttcaagggtcggacgagtcgctagttccggtagggaacgtaagtaacttacacgttctacctaacgtacttacgagaccgtaacgtcctggtaccacggtacctaaggtaagtttacgttttacggaacttttaaacgtttactttaaccgtacgttaaccgtaaacgttaagtttaaacgttaactttaacccgggttaccccgttacgggttaccggtttaaccgggttacccgggtacccgggtaaaaccgggggttaccgtaaacgggggtttaagggaacccggttaaacccgaaacccggttaaccggttcgggggttacctacccggttaccggtaaccccg

SEQ ID NO: 216583 - DNA, 531 bp, Homo sapiens
  misc_feature: GYAE6OF02GLEXI.1.34.D01.1.454.CMB.1.raw
  modified_base (491)..(491): a, c, t, g, unknown or other
  misc_feature (491)..(491): n is a, c, g, or t
  modified_base (496)..(497): a, c, t, g, unknown or other
  misc_feature (496)..(497): n is a, c, g, or t
  modified_base (499)..(501): a, c, t, g, unknown or other
  misc_feature (499)..(501): n is a, c, g, or t
  modified_base (503)..(531): a, c, t, g, unknown or other
  misc_feature (503)..(531): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagtattttgactaagttactatttgtcaacaggaccaaactacgtttcccctacggaacgtttccggacccgaaagggaacccaaaggggtacggaaaaacccgaaaccggtaaacctggtacggacctaggaccaccaattcgtcgttccttactacttcccgtttccccgcctaacttccgtacgaaaccgtcctaccgttccgttcgtacggacggtccggggtcccgtagggtaccgaaacggggcccaccgtaagttacgcngacgnngnnngnnnnnnnnnnnnnnnnnnnnnnnnnnnnn

SEQ ID NO: 216584 - DNA, 684 bp, Homo sapiens
  misc_feature: GYAE6OF02IG4X8.1.34.D01.1.454.CMB.1.raw
  modified_base (414)..(414): a, c, t, g, unknown or other
  misc_feature (414)..(414): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgctatctattggagacagagtcaccatctacttcggccgggacgagtcgacggccagtcaggcgtactttcgttagccttggttcgcagacaagaaaccgagggtccgacgcccccgtcaaggacttccggtaagttctagtgggtcgactactaccgtagtacgttcggacggtaacggggtccggggtcccctagtcccggtaaggttcctaaggtcggacgtagtcncgtaagttccgaggggactaaggtacgttaacctacgtcctactaacctatacgacgactacggtcctacggaccgtacgtccgttaggtaaacgttgtttagactttaaagttttacttacgttactaaccaaacttagtttaaaccttaacttaaccgttaacccgttagggtacggttaccggttaccggaaccgggtaaccggggtaccgtaaagggtacggtaacggtaacccaacggtaacgtcggtacggtcgtacgtacccg

SEQ ID NO: 216585 - DNA, 590 bp, Homo sapiens
  misc_feature: GYAE6OF02HF6C4.1.34.D01.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagccttggttgcagcagaaaccagggcgagcccctnagatcgtagtctatggtncatccagattgactaagggtcgggtcccatcccgaggttcagtggctagtgcatcgtagggacaggattaccacttctacacttactcgagcacggtcctgccacgcccgttagaacgttattttacgacttaattttattacgtagtacctaaatagtttaattaacttaaccgttaccccgtagttcgggtaaccgtttccgggacccgtaacgggggtacctaaaggggtacggtaaacggttacccgtaaacccggtaacgtttcgggacgggtacctcggaacccg

SEQ ID NO: 216586 - DNA, 611 bp, Homo sapiens
  misc_feature: GYAE6OF02IKCOA.1.34.D01.1.454.CMB.1.raw
  modified_base (198)..(198): a, c, t, g, unknown or other
  misc_feature (198)..(198): n is a, c, g, or t
  modified_base (604)..(604): a, c, t, g, unknown or other
  misc_feature (604)..(604): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattgganacagagtcaccatcacttgccgggcagtcaggccagtccagcgattctttagcctggttgccagcaacgaaaccgagggaccgacgccccctagagactcggtacgtcctagtggtcgctataccagtattggacgtaaggggtcggtaccctacgtccgtagggttcctaggtcggcagtgactagtcgtaggggacagacgttacactcgtacactatcacgtcacgccttgcacgactaggaacttatttcgacttaatttacttacgtagtacctaaacgtagttaacttaacgtaaccgttaacccttaggtaccggtacgttcgggaaccggtaccggggtaacggtaaagggtaacggtaaccggtacgaaaccggttaccgtagggtacgccggttanaacccgg

SEQ ID NO: 216587 - DNA, 669 bp, Homo sapiens
  misc_feature: GYAE6OF02I2BPW.1.34.D01.1.454.CMB.1.raw
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacagagtcaccatcacttgccgggcgagtcaggccatcagcgtattcttagcctggttgcagcaagaaaccngggcacgcccctnagatcgtagtctagtggtgctactccagtactttgacgtaagggttcgggtcccagtcccgtagggttccaaggtcggaccgtaggttcgcctaagttcggtacgggtaacaggtactttaaccacttccgtacgtactaataccgagaccacggtccctggaccgtagtacccttaggaaacgtttactttttaggaacctttaaattttaacgtttaaccttacgttaaacctaaacgttacggtttaaacttttaccggttaaaccgtaccccgttacgggttaccgttaccggtttacccgggaccggtaaccgggtaaccgtaaagggttacggaaccgttacccgaaaccggtaacgttcgggtcggtactaccgggtacc

SEQ ID NO: 216588 - DNA, 665 bp, Homo sapiens
  misc_feature: GYAE6OF02IKB9D.1.34.D01.1.454.CMB.1.raw
  modified_base (146)..(146): a, c, t, g, unknown or other
  misc_feature (146)..(146): n is a, c, g, or t
  modified_base (308)..(308): a, c, t, g, unknown or other
  misc_feature (308)..(308): n is a, c, g, or t
  modified_base (539)..(539): a, c, t, g, unknown or other
  misc_feature (539)..(539): n is a, c, g, or t
tcagacgagtgcgtcacgaccggtgctcgatttagatcgtctgtgttggggtttgggggagtcagaccctgtcaggacacagcatggacatgaggactccccgctcagctccgtgggctcctgctgctctggcctcccaggtaccngctgtgacatccgaattcgacccagtcctccactccctccctgtctgctatctagtggacgacagacgtaccaccatcctacgttcggaccgggcgtaagtcgacggacctatccgagtcgtactttcgttagccgttggtcgacgagacgaagaaaccggnggggcctaccgcccctagacgtagttaccggtagtcgtagtcggtcgacactacgtaagtagttacggaccggtaagggtcccggtaccaacgttccgtaaggtttacgaggtacggaacgttcgacgtacgttaccgggaggaactaacggtaacttaccgtactacgttacgtaactacgtcgaacgtacgtaccggtctagaccgtaacgtcgtaaagttaacgtttntttaacgactttaaaggtttactacggttaacgaaccttaaggtattaacgttacgtaccgtactaggtcgtacgtcggaacggtacggagtaaggtcgtaacgacgtacgagtgcgacgtgaacc

SEQ ID NO: 216589 - DNA, 427 bp, Homo sapiens
  misc_feature: GYAE6OF02ID9AQ.1.34.D01.1.454.CMB.1.raw
  modified_base (391)..(427): a, c, t, g, unknown or other
  misc_feature (391)..(427): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattaactgtacaaactagtattaatacgtacccctagtggacgttcggccaggggaccaaggtggaagtcaacgaactgaggctgcaccatctgtcttcactcttcccgcatctgaacgcatcgtctgacgcgggctggcaaggcgcatagnnnnnnnnnnnnnnnnnnnnnnnnnnnnnnnnnnnnn

SEQ ID NO: 216590 - DNA, 662 bp, Homo sapiens
  misc_feature: GYAE6OF02GEYFX.1.34.D01.1.454.CMB.1.raw
  modified_base (273)..(273): a, c, t, g, unknown or other
  misc_feature (273)..(273): n is a, c, g, or t
  modified_base (309)..(309): a, c, t, g, unknown or other
  misc_feature (309)..(309): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcgaggccatcagcgattcttagcctggttgcagacaacgaaaccgngggaccgacgcccctcgagatcgtagtctagtggtnacatccgagtagttgcgtaagggtcggtcccagtcgtaggttcaggtcggactagtgctatcggtacggggactaggtaacttaccgacttaccgtacctaacttactacgaacggacctacggtcccttggacctacggtaccgttaggtaaacgtttaacgttttacgacctttaaatttttaacgtttacgttacgttaacgtaaactttaagttaacgtttaaacgttaaacccgttacccgttacggttacgggtaccggttaccgggtaccggaaccggggtaaccgtaagggttacggtaaccggttaccgaaccggtaccgttagggtcggtacgtcggtacccg

SEQ ID NO: 216591 - DNA, 814 bp, Homo sapiens
  misc_feature: GYAE6OF02JE6MN.1.34.D01.1.454.CMB.1.raw
  modified_base (265)..(265): a, c, t, g, unknown or other
  misc_feature (265)..(265): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgattcttagcctggttgcagcagaaaccngggcgacgcccctacgagatcgtagtctagtggtcgacaactccgaagtacgtttggacgtaaacggggtcggggttccccaattccccgtaagggtttccaaggttgggccaaggttcggacaacgtttcggtacgggggaacctaaggtaactttaaactaccgttacttaaccgtaaacctttaagtaccgtaaacggaccgtaaccggtccccgttaggacccgtaacggtacccgttttaagggaaaacgtttaacgttttttcggaaacccgttaaaatttttttaaccgttaaaccgtttcggtaaccttaaaaaccgttagggtttaaacttttaaaaccgttaacccgggtttaaccccccgtttaaaccggggttacgggttaacccgggttttacccgggggtaacccccgggttaaaacgggggggtaacccccgttaaaaggggggttaacggttaaaaaccgggttacccgttaaaaaccccgggttaaacggtttaccgggtttaacgggggtaccctttccgggaaaaccccg

SEQ ID NO: 216592 - DNA, 708 bp, Homo sapiens
  misc_feature: GYAE6OF02I8Y82.1.34.D01.1.454.CMB.1.raw
  modified_base (233)..(233): a, c, t, g, unknown or other
  misc_feature (233)..(233): n is a, c, g, or t
  modified_base (703)..(703): a, c, t, g, unknown or other
  misc_feature (703)..(703): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacataccaattcgacccagtctaccatcccgtccctgtctgcatctagttggagacagacgtcaccatcacttcggccgggnagtcaggccatcagcgtattctttaagccgtggttgctagcaaggaaaccgagggacgacgtcccctacgagtacgtacggtacgtactagtcggtacgactaactaccgaagtacgttacggacggtaaacggggttccgggtaccccgtacgttacccggtaacggttacctaagggtacggacgtaaggtcgtaccgtattcggttacgggaaaccttaggtaaacgtaaccctaccttacctacgtaaactactaccgtaacggaccgtaaccgtccgttacggctaccggtacgttaacgttaaacggttattttacggaactttaaatttacctttagtacttaacgtaacgttagttaaacttaaacgttaaccgtaccgttaacggtacggtaccggttacgggaccggtaacgggaaccgtaagggtacgaagtacgaaccgttacgcggtacggtcgtanaaccg

SEQ ID NO: 216593 - DNA, 723 bp, Homo sapiens
  misc_feature: GYAE6OF02GS6WO.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagtctgtgacatccaattcgacccagtcctccattcctccctgtctgcatcctattggacacagagtccacatcacttggccgggcacgtcaggccagtcagcgtattctttagccgttggtcgcagaccaacgtaaccgagggctacgcccctagacgtacgtcggtacgtcgtagtcggtcgctactccgagtagttgacgtaaggggttcggtaccctagttcccgtaggttacgaggttacggactagggtcgaccgtagtccggtacggggaactaggtacctttaacacctttcgtactaacgttactacgaacgtccgtaccgtaccgtcgtaacgtaccgtcgttaaacgtaagtttctttttaacggactttaaagttttaaccgttactaccggttaactaacccggttaaattttaccgttaaaccgttaaccccgtaacccggttacgggttacgggttaccgttacccggggaaccggggttaacggggtaaacccgtaagggggttaaccggtaaaccgttacccgaaaccggttaaggtcggtttacgggtccgtacggtaaccccg

SEQ ID NO: 216594 - DNA, 582 bp, Homo sapiens
  misc_feature: GYAE6OF02FZ01Y.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcaagaaaccagggcgacgcccctcagatcgtagtctagtggtgcatccagtattgacgtaagggtcgggtacccagtccgtaggttcaggtcggcagtgctagtcgtagggacagtattacactctacactatcagcagcctgactagtcctagaacttattttcgacttaagtttacttacgtacgtacaacgttagttaactttaacgttaccgttaaccccgttagggttcggtaaccggtttaccgggaccggtaacgggggtaaccctaagggttacggaacgtaccgaaaccggtaacgtggtacggcttagacccg

SEQ ID NO: 216595 - DNA, 632 bp, Homo sapiens
  misc_feature: GYAE6OF02HD8BS.1.34.D01.1.454.CMB.1.raw
  modified_base (612)..(612): a, c, t, g, unknown or other
  misc_feature (612)..(612): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagccgttggttcgcagccgaagaaaacccgaggggccgaacgccccctagaagacttcggtaagttcctaagtgggtgactaactcccgaggtagttcggacgtaacggggttcgggggtacccctaagttcccgtagggtttcaggtggactaggtcgctacgtcggtacggggaacaggtaactttaccacttcctactactagtaccgagcctacggtccctggacctacggtccgtaagaacgttattttcgacttaagttttactacgtcgtaactaactagtactttaacgttaccgtacccgttaggtcggtacgttcggacggtacgggaacgtagggtacgacgtaccacgtacgtgtacggctagtacaccgtatcgtntcctctacgtccctcgtacc

SEQ ID NO: 216596 - DNA, 994 bp, Homo sapiens
  misc_feature: GYAE6OF02JNMNY.1.34.D01.1.454.CMB.1.raw
  modified_base (118)..(118): a, c, t, g, unknown or other
  misc_feature (118)..(118): n is a, c, g, or t
  modified_base (179)..(179): a, c, t, g, unknown or other
  misc_feature (179)..(179): n is a, c, g, or t
  modified_base (191)..(191): a, c, t, g, unknown or other
  misc_feature (191)..(191): n is a, c, g, or t
tcagacgagtgcgtcacgaccggtgctcgatttagatcgtctgtgttgggtttgggggtaggtcgtagaccctgtcaggacgacagcatggacatgagggtccccgcgtcagcctccnggggctcctgctgctctggcctcccaggtaccagcctgtgacatccaattcgacccagtcnccatccctcctntctgcactcctagttggacgactaggacttcaacccgaattcccgtaacgtttcgggaccccggggggtacaagggttcccgaacgggaccccgtaaatttcccggaaaacggccggttaaacgttttcccgtttttaaacgggaccccgtttcgggggttttacgaccggtaacggtacccgtaaacgggaaaaaccccgtacgggggaccgtaacccgggtacccccccgtacgaacggtacgtacccggttaagtaccgttacggttacggttcggacctaagttaccccgaggttaaacgtttcgggacggttaacgggggttaccgggggtccccctaaggttacccgtaaccggggtttacgtaacgggttacggggtacccgtaagggttcgggtacctaacggtttccggtaacgggggtaacgtaacgggtaacttttaaccggtaacctaccggttttaccgaaaccggtttacttacgggaaccgttccgaaccggttacccggttcggccgtaaccggtaccccgttagggaacctttaaacggttttacgtactttaaaaggttttaactccgtttaaccgggaaacttaaaacccgttaagtttaacgtttaaaaccggtttcccgttaaaacccccgttgggttaccgttaccggttaaacccggggttcccgggtaaacgggttaaaccggggtaacggtttaaacccgggggtaacttaaccccggggtaaaccggtttaaacccgggttaggttaaccccgggttacggttaccggtaaacccgg

SEQ ID NO: 216597 - DNA, 860 bp, Homo sapiens
  misc_feature: GYAE6OF02H65DU.1.34.D01.1.454.CMB.1.raw
  modified_base (217)..(217): a, c, t, g, unknown or other
  misc_feature (217)..(217): n is a, c, g, or t
tcagacgagtgcgtcacgaccggtgctcgatttagatcgtctgtggttggggtttgggggagtcagaccctgtccaggacacagcatggacatgacgggtcccccgcgtcagcctccgtggggcctcctgctgctctggcctcccgaggtaccagtctggtgacatacctaagttcgacccagtcctccatccctccctgtctgctatctagtgganacagactcaccatcacgttcggccgggacagtcaggccatcgagcgtatttctttagccgttggttcgcagcaacgaaaccgaggggaccgaccgccccctacaggtaacgttccggttagtaccttagtacgggtgacctacgtccaaggttaacgttggtaccggaacgggggttccggggtaccccctaacgtttccccgggtaggtttcgtaacgggttacgggaccgtagggtacgcgtaccgttcggtacggggaaactacggtaacgtttaacctaccttaccttacctaacggttactaccgacggacgtaccgccgtttacggacccgtacgtacccgttaagtaacgtttacgtttttacgacgtttttaaaacttttaacgtttaccgttaacgtttaacccaaaacggtttaacgttttaagttaaacccgtttaaacccggtttaacccccgggtttaaccggttaccgggggttttacccgggtttaacccgggggaacccgggttaaacccgggggggtaaacccggttaaacggggggttaccgggttaaaccggttaaaccccggtaaacccggggttaaaccggttacccggggttacgggttaccccggttcggttaacccccg

SEQ ID NO: 216598 - DNA, 730 bp, Homo sapiens
  misc_feature: GYAE6OF02HTCFF.1.34.D01.1.454.CMB.1.raw
  modified_base (166)..(166): a, c, t, g, unknown or other
  misc_feature (166)..(166): n is a, c, g, or t
  modified_base (183)..(183): a, c, t, g, unknown or other
  misc_feature (183)..(183): n is a, c, g, or t
  modified_base (223)..(223): a, c, t, g, unknown or other
  misc_feature (223)..(223): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccngtctccatcctcctttntgcatctagttggagacagagtcaccatcacgttgccggngagtcacggccatcagcgtatttctttacgccgttggtgcagacaaggaaaccgagggcgaccgcccctcagacttacggtagtcctagtggtcgacactccgaagtagttgacgtagggtcgggtacccagtccgtaggttactaggtcggacgtagtcgactagttccggtgggtaacgtacggttaactttaacgacccttacctaccttaacgtaacttaccgaacgtccgtaaccgtccgtacgtaccgaacgtcccgttaaggtaagtttaacgttttacgtaacgtttaactttttaacgttaacgttacgtaacctaaacgttaacgtttaacgttttaaccgttaaccgttaacccccgggtttaacgtacgggttacccggtttaccgggaaccggtaacggggtaaaccggtaacggggttaaccggtaaccggttaacccgtaacccggttaacggttaccggttcggtaaccggttaccgacccgttaacccgg

SEQ ID NO: 216599 - DNA, 719 bp, Homo sapiens
  misc_feature: GYAE6OF02JTT9E.1.34.D01.1.454.CMB.1.raw
  modified_base (230)..(230): a, c, t, g, unknown or other
  misc_feature (230)..(230): n is a, c, g, or t
  modified_base (277)..(277): a, c, t, g, unknown or other
  misc_feature (277)..(277): n is a, c, g, or t
  modified_base (343)..(343): a, c, t, g, unknown or other
  misc_feature (343)..(343): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtctccatcctccctgtctgcatctagttggagacagagtcaccatcattggccgggcagtcaggccatcagctattcttagcctggtncagcagaacagggcgacgcccctagagactacgtagtcgtagtggtncatcctagattgacgtaagggtcggggtacccacgtccgtacggttccaggtcggcgtacggtacncgtaagttcggtacggggaactaggtaacttaacctacgttacccttacaaccgttaaagtccgtaacggtcctacgtcccgtacgtccgaaacggtcccgttaaggaaagtttcgtttaggacttaaacgttttacgttaacgttacggtaacctaaacgttaagtttaaactttaaccgttaaccggttaaaccccgtttaggtaacggggtttaacccggttccgggaacccgggtaaacggggaacccggttaagggtaacggttaaccgtaaccgtaaccggtacggtcggttaacggaccgttacgaaccctaacgtacgtttcgtaacgtttcctacggttaaccttacccgttacccccttaaccccg

SEQ ID NO: 216600 - DNA, 708 bp, Homo sapiens
  misc_feature: GYAE6OF02I2XRI.1.34.D01.1.454.CMB.1.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
  modified_base (320)..(320): a, c, t, g, unknown or other
  misc_feature (320)..(320): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccatcctcctgtctgcatctatgganacagatcaccatcacgtcgccgggcagtcaggccatcagcgtattctttagccttggttgcagcaaggaaaccgnggggcgacgtcccctagagattcgtagtcgtagtggtgacactacganatgacgagggtcggtcccattccgaggttctaggtcggctaggtcgacacgttcggtagggacaaggtacgttacctaaccgttctaacgtaccttaacgtccgtaagacccgtaacggtacccgttcgaaccggtaaccgtaccgttaaaccggtaaagtttttacccgtttttaacggaacctttttaaaaattttacgttttaaacccgttaaccgtaaccttaaacgtaaggttttaaactttaaaccggtaaccgtttaaccccgttaacgttcggggttaaccggttacccggggtaccgtaaacgggggtacctaacgggggttacggaaacggttacccgtaaaccggacggttcgggtacgttaccgtacggaaccccg

SEQ ID NO: 216601 - DNA, 693 bp, Homo sapiens
  misc_feature: GYAE6OF02JK95N.1.34.D01.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagacgagtgcgtcacgaccggtgctcgatttagatcgtctgtgttgggtttgggggtaggtcgagaccctgtcaggacacagcatggacatgagggtcccgctcagctcctggggctcctgctgctctggctccaggtaccagctgtgacatccaattgacccagtctccatcctccctgtctgcatctattgganacagagtcaccatcacttgccgggnagtcaggccatcagcgattctttagtccttggttgcagcaagaaaccgtacgggacgacggcccctcgacgacgtcgtagtactagtgggtgacactaccgagtattggacgaaggtcgggtcccacgtccgaggttctaggtcggactacggtgtcgatcggtcgggactaggacttacgtactacgtcacttactacgacgtcgacgccgttgacctacgtccgtagtaacggttacttttacgggaacttaacgtttttattaaccgtttacggttaacctaaactttaacgtttaacttaactttaaacccggttaaccccgtttaaacgggttaccgggttttaaacccgggtccggttaaacccggggtaaccggggtaacggttaaccggggttaaggttaaacgggtacccgtaaacccgggttaacgttaacgggttccgggtacgttcggtaaaccccgg

SEQ ID NO: 216602 - DNA, 572 bp, Homo sapiens
  misc_feature: GYAE6OF02GAAE4.1.34.D01.1.454.CMB.1.raw
  modified_base (222)..(222): a, c, t, g, unknown or other
  misc_feature (222)..(222): n is a, c, g, or t
  modified_base (282)..(282): a, c, t, g, unknown or other
  misc_feature (282)..(282): n is a, c, g, or t
  modified_base (348)..(348): a, c, t, g, unknown or other
  misc_feature (348)..(348): n is a, c, g, or t
  modified_base (385)..(385): a, c, t, g, unknown or other
  misc_feature (385)..(385): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattctttagcctggttgcagcagaaaccagggcgacgcccctnagatcgtagtctatggtgcatccagattgcgaaggtgggtacccagtcctaggttcagtggcagtnactagtcgtaggacagtattaaccactctacacttanaccagccaagtcccgtagtacgacgtaccgttaagaaagttacttttggaacttaagttttaattactacgtaacaagtagtttaaacttagtaaccgttacccctaggtacggtacgttaccggacggtaacgggaacgtaaggtaggtaacgtacaaccggtacgtaggtacggtcgtcgaaccg

SEQ ID NO: 216603 - DNA, 695 bp, Homo sapiens
  misc_feature: GYAE6OF02HM76X.1.34.D01.1.454.CMB.1.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatccacttgccgggcgagtcaggccatcagcgattcttagcctggttgcagcagaaaccagggcgacgcccctnagtntcgtacgtctagtggtgcctatccagtattcggacgtaaggggtcgggtccccaagtcccgaggtttcaaggttggactagtcgactagttcgtagggtacaggtaattaccgaccttctacgactactacgacgccgacgtccctggaccgtacggtcccgttaggaaacgtttacgtttttacggaacctttaaagttttttacctaacgttaccggttactaaaccgtttaagtttaaccttttaaacgttaaccgtttaaaccccggtttacggtacgggttacccggttttaccggggaaccccggtaacgggggttaaacccggtaaacggggttaaccggtaaccggttaacccggaaaccggttaaccggttacgggtaccgggtacgtaccggtaacccg

SEQ ID NO: 216604 - DNA, 456 bp, Homo sapiens
  misc_feature: GYAE6OF02JGJ83.1.34.D01.1.454.CMB.1.raw
  modified_base (433)..(435): a, c, t, g, unknown or other
  misc_feature (433)..(435): n is a, c, g, or t
  modified_base (437)..(456): a, c, t, g, unknown or other
  misc_feature (437)..(456): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagcctagaagtattttgactaatttattactgtacaacagttattatacgtacccctagttggacttcgggccaagggggacctaagggtggaaagtaccaaccggtaactggtggactcggcaccatcctagtcttacgacttcctttacccacccttcctacacgcctacttcgtcgttcgacgccgggctcggaccgaaggtccgcagtagcnnncnnnnnnnnnnnnnnnnnnnn

SEQ ID NO: 216605 - DNA, 858 bp, Homo sapiens
  misc_feature: GYAE6OF02H1L52.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggcctcctgctgctctggctcccaggtaccagctgtgacatcccaattcgacccagtcctccactccctccctgtctgctactctattggaacacgtagacgtcaaccatcacctttcggccgggtcgagtcgacggcctatcgacgcgtactttcgtttacgtccgttcggtttcgcgacgaccgaacggaaaacccggacggggaccgacccggacccccgttacgaacggttacgtaccggtaggttaccgttaagttcgggttacgtacctaacttacccgtaaggtaacgttcggtaaccgggttaacgggggttcggggttaccccctaacggtttaccccggtaacggtttacggtaacgggttcgggacccgtaggtacgaccggttaacgttccggtaacgggggtaacctaacggttaaccggttttaaaccaccttaccctttaacccgtaacgttaacgtccggaacgaccgtaccggtacccgttggaccgtacgtacccggtaagttaaacgttacgttttacgtaacctttaaaagtttttaccttacgtttacgttaaccttaacgttacgtttaaacgttaaccgttaacccgttaccccgttagggttaccgggttaaccggtttcccggggaaccgggttaccggggaaaccggtaacggggttaacggaaccggttaaccgtaaccgggttaccgttagggtacccgggtcgttaccgaccccgg

SEQ ID NO: 216606 - DNA, 568 bp, Homo sapiens
  misc_feature: GYAE6OF02JZODV.1.34.D01.1.454.CMB.1.raw
  modified_base (207)..(207): a, c, t, g, unknown or other
  misc_feature (207)..(207): n is a, c, g, or t
  modified_base (523)..(523): a, c, t, g, unknown or other
  misc_feature (523)..(523): n is a, c, g, or t
  modified_base (538)..(539): a, c, t, g, unknown or other
  misc_feature (538)..(539): n is a, c, g, or t
  modified_base (541)..(568): a, c, t, g, unknown or other
  misc_feature (541)..(568): n is a, c, g, or t
tcagacgagtgcgtcacgaccggtgctcgatttagatcgtctgtgttgggtttgggaggtcaggccatcagcgattctttagcctggttgcagcagaaaccaggcgagccctcagatcgtagtctatggtgcatccagattgcaaggtgggtcccatccaggttcagtggcagtgcatctggggacagattacactctcactatcancagcctgcagcctagaagtattttggactaatttattacgtgtaccaactagttattaactaacgtacccctaacgtgggtaccgttcgcccgaagggggacctaaggtcggtaagtaccgaaaccgtaaaccgttggtcggtaccgtaggtacacccgtaattccgtacggttcctttaaccgtaacgttccccgttttccccgaccctttacccgtcaaccgtcccgtaaacctttccgttaccgtcggttaacggggccgggttcggttacgggtaccgtaaacgggcccgttaaccacggtaacggatacgngtgaactgagatcgnncnnnnnnnnnnnnnnnnnnnnnnnnnnnn

SEQ ID NO: 216607 - DNA, 601 bp, Homo sapiens
  misc_feature: GYAE6OF02FPAI1.1.34.D01.1.454.CMB.1.raw
  modified_base (197)..(197): a, c, t, g, unknown or other
  misc_feature (197)..(197): n is a, c, g, or t
  modified_base (266)..(266): a, c, t, g, unknown or other
  misc_feature (266)..(266): n is a, c, g, or t
  modified_base (284)..(284): a, c, t, g, unknown or other
  misc_feature (284)..(284): n is a, c, g, or t
  modified_base (436)..(436): a, c, t, g, unknown or other
  misc_feature (436)..(436): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcacatcacttgccgggcgagtcaggccatcagcgattcttagcctggttgcagcaagaaccngggcgacgccccgtcagntcgtagtctagtggtgctatccagtattgacgaagggtcggggtcccagtccgtacggttcaggttggacctaggtgctagtccgtagggacaggtacttacacgttcctacacttatcgagtcacgccgtgccgacgtccgtaggaacttnttttagaccttaattttacttacttcgtaactaactaagttaactttagtaacccgttaacccgttacggttacggttaccgttaccgggtcccggaaggggtaaccgtaaggttacggaacgttaacgaacccggttaagtacggtcggtaccgtagtaacccg

SEQ ID NO: 216608 - DNA, 693 bp, Homo sapiens
  misc_feature: GYAE6OF02GZV9V.1.34.D01.1.454.CMB.1.raw
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctcctgtctgcattctattgganacagagtcaccatcacgttgccgggtcagtcaggccagtcagtcgtacttcttacgcgtggttnaccgagcaacgaaacgagggcgaccgcccctanagactcgtagtactagtgggtnacctagtccgagtacttcggacggtaacggggttccggtaccctacgtacgtaggttacgaggtcggacgtagtcgacgtacgtcggtagggaactacgtaacttaccgacttacgtacctaacgttacacgacgtaccgaacgtcccgtagacgtacccggtacgttacgggaaactttacgttttacgaacttttaaagttttaccttacgtaacgttaacctaaacgtttaaggtttaacttaaacgttaacccgtaacccgttacggtcgggttaaccggtttcgggaaacccggttacggggaaaccgtaaccgggttagaaaccggttccgaaaaccggttcgtcggtaacggtctaccggtaacccg

SEQ ID NO: 216609 - DNA, 641 bp, Homo sapiens
  misc_feature: GYAE6OF02GUQVN.1.34.D01.1.454.CMB.1.raw
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (318)..(318): a, c, t, g, unknown or other
  misc_feature (318)..(318): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacgttggccgggcagtcacggccatcgagcgtatttcgtttagccgttaggttcncgagacaagaaaccgngggacgacgcccctgagtactcgtagtctagtggtcncactccagtacgttaggacgaagggtcgggtacccagtccgtaggttcaggtgacgagtcgctagtcgtgggaacaggtacttactactactacactatacgacgcgacgtcctagaccgtacgaccgttaaggaacgtttacgtttagtactttaagttttacttaacttacgttaactaacgttagtttaacttacgttaaccgttaccccgttagggttaccggttaacggttaccgggtaccggaacgggtaaccgtaagggttacggtaacgtaacccggtaaccgtaacggttacggtcggtaccgtacggtaaccc

SEQ ID NO: 216610 - DNA, 544 bp, Homo sapiens
  misc_feature: GYAE6OF02GFLH0.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctagtggtgcatccagtattgcaaggtcgggtcccagtccaggttcaggtggcagtgcatcgtgggacagattacactctcactatcagcagcctgcacgcctagaagttattttcgattaatttattactagtacaactagttaacttagtaccgttaccccttagtacggtaccggttcggaccgtaaggggacccgtaagggtaggtaacgtacgtaacccggtaaccgttggtcggtccgtgtaacccg

SEQ ID NO: 216611 - DNA, 519 bp, Homo sapiens
  misc_feature: GYAE6OF02G2FD7.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctagtggtgcatccagattgcgaagggtcgggtcccagtccgaggttcaggtggcagtcgctagtcgtgggacagtacttacactctacactatcagcagcctgcagcctagaagtatttgattaatttattactgttaacacttagttattactacgtaccctagtcgtacggtccggacgtacgggtaccaaggtacgagtacaacggtagtggtcggtcagtcc

SEQ ID NO: 216612 - DNA, 554 bp, Homo sapiens
  misc_feature: GYAE6OF02HWSIA.1.34.D01.1.454.CMB.1.raw
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttggccgggcagtcaggccatcagcgtattctttagcctggttgcagcaagaaccagggcgagcccctcagatcgtagtctagtggtgcatccagtattgacgaagggtcggggtcccaagtcccgtaggttcgaggtcggctagtcgactagtcgtgggacagtattacgtactctctactancancngccngcagcctagtaagtntttggacttaattttatactgtactaagtattaatttacacgttaaccctggttacggtacggttaccggccggaacggggtaccaagggttacggaacgttaccgaacgtacgttacggtgtacgtgtaaccg

SEQ ID NO: 216613 - DNA, 805 bp, Homo sapiens
  misc_feature: GYAE6OF02H1RM4.1.34.D01.1.454.CMB.1.raw
  modified_base (201)..(201): a, c, t, g, unknown or other
  misc_feature (201)..(201): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaaattcgacccagtcctccatccctccctgtctgcatctattgganacagagtcacatcacttggccgggcgagtcgacggccaatcagtcgtactttctttaacgccgttgggtttcgcgagacgaacggaaaaccgagggggaccgaaccgccccctacgaaggactttacggtaacgttacctaaggttcggtacgactaacgtccgaagttattacgggaacgtaaacgggggttcgggtacccaacgtttccgaacgggtttcaagggttcggacgtaaggtcgactaacgttcggtacgggtaaacgtaacggttaaacctttaaccgtaccgttaccgtttaccctaaaacctttaacgtaccgaaacgtcccgtaacggtacccgttgaacccgtaggtacccgttaaggttaaaacggtttgttttaacggaacctttaaaagttttttacgttaaccggttacgttaaaacctaaccgttaaaaggtttaactttaaacgttaaacccggttacccgttaacgggttacgggtaacccgggtttcgggaacccggtaaacgggggtaaccgtaaacggggtaacggtaaccgtaaccggaaaccggttaccgtacgggtacggttccgtacggtaacccg

SEQ ID NO: 216614 - DNA, 618 bp, Homo sapiens
  misc_feature: GYAE6OF02F15HG.1.34.D01.1.454.CMB.1.raw
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtccaccatcacgttcggccgggcgagtcaggccatcagcgattctttagccttggtncagcaagaaaccgngggcgacgcccctnagtactcgtagtctagtcggtgcatccagtattcgacgtaagggtcgggtacccagtcccgtaggttcaggttcggcaggtcgactagtcggtagggaactagtaacttacactctactactactcgacgcacgccngcgacgacgtagtaacgttntttagaacttaatttacttacgtacgtaactaacgttagttaactttaacaccgttaccccgtaaggtccggtaaccggttccggtaaccggtacgggtaaaccggtaacgggttacggaacggttaaccgtaaaccggtaacggttcggtacgggtaccgtacggtaacccg

SEQ ID NO: 216615 - DNA, 691 bp, Homo sapiens
  misc_feature: GYAE6OF02FHYU2.1.34.D01.1.454.CMB.1.raw
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtccaccatcaccgttcggccgggcgacgtcaggcccatcgagcgtattcttagccgttggttcgcagcgaacgaaaccgcggggtccacggtcccctanagtactcggtagtcctaagttcgggtacncctaattacccaggtacgttacggacggtaaacggggttccggggtaccctaagttcccgtacgggtttacgaggttcggaccaaggtcgacaacgtttcggagggtaccaaggttactaccgactcctaacgtacctatccaacggtccaacgtccgtcgactacggtacctaggactttacgtttcgaactttaagtttaacttactacgtaaccgtaacttaacggttacttaaacggttaccttaaccccgttaggtaccgggttaaccgtaccggggtaaccggtacggggtaaacccgtaagggttacggaaacgttaccgaaaccggttaacgcggtacgtacgtacgtaaccc

SEQ ID NO: 216616 - DNA, 624 bp, Homo sapiens
  misc_feature: GYAE6OF02HMXBQ.1.34.D01.1.454.CMB.1.raw
  modified_base (197)..(197): a, c, t, g, unknown or other
  misc_feature (197)..(197): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
  modified_base (476)..(476): a, c, t, g, unknown or other
  misc_feature (476)..(476): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatccacttcggccgggcgagtcgaggccatcagcgtatttctttacgccttggttcgcagacaacggaaaccgacgggcgaccgcccctgagtacgtcgttaggtctagtggtcacataccgaagtagtttcggacgtaaggggttcgggtacccagtccgtaggtttcgaggttcggactagtcgtcagttcggacgggacaggtacttacgactcgtaacacttanacgagccgacgtccngaccgacgtaccgtaagtaacgttnttttacgaattaattttacttagtcgtaactaacgttagttaatacgttaaccgtacccttgggtaccggttacggttcccggacgggtaacgggacgtaacggtacgggtaacgtaccgaaccggtagtcggtacgtctacgtaccg

SEQ ID NO: 216617 - DNA, 822 bp, Homo sapiens
  misc_feature: GYAE6OF02JLBOH.1.34.D01.1.454.CMB.1.raw
  modified_base (203)..(203): a, c, t, g, unknown or other
  misc_feature (203)..(203): n is a, c, g, or t
tcagacgagtgcgtcacgaccggtgctcgatttagatcgtctgtgttgggtttgggggtaggtcagaccctgtcaggacacagcatggacatgagggtccccgctcagctcctgggctcctgctgctctggctcccaggtaccagctgtcgacatccaattgacccagtctccatcctccctgtcctgctatccttattgganaccaggactcaaccctatcctaactttggacccgggacgtacgtccgacggacctatccgagaccggtattttacccgtttaggccctttagggttcgccgacggtaccctaaacgggaaacccgagggggtcccgaaccggccccccggttacgaacggtaacgttccgttaacggttccgttaaggttcggggtcgtacgtaacccgttccgaagttacgttcgaccgttaagggggtcccgggtaccctacgttacccggtaggtttaaccgacggtgggccttaaggtgaccctagttaccggtacgggtaacctaaggtacctttaaccgacttccgttaacaccgtttaacgtcgaacggttaccacgtcccgtatacccgacgttcccgtaagtaacgttctttaacgtacgtaaactttttactacgtttacgtaaacgtaccttaaaggttctttaacgttaaaccgccccgttttacggtacggttacccgggtttacccggaccggggtttaaacgggacccgggttaaaagggtccgggttaaaagttacccggaaaaccccgggttaggtttaacccggggtcgggttaaacctcggttaaccccg

SEQ ID NO: 216618 - DNA, 656 bp, Homo sapiens
  misc_feature: GYAE6OF02GEN7B.1.34.D01.1.454.CMB.1.raw
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
  modified_base (312)..(312): a, c, t, g, unknown or other
  misc_feature (312)..(312): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtccaccatcacttggccgggnagtccaggccatcagcgtatttcttagccttggttgcagacaagaaaccgngggacgacgcccctagagtactcgtagtctagtggtcncactcgagtacgttcgacgtaggggtccgggtacccacgtccggtaggttcgagggtcggacgtagtcgactagtcggtacgggaactacggttaacttaccgtaccttacgtaccctaacttacgtacgacgccgacgtcctgacgtacgtaccgtaagttaacgtttacgtttagacttttaaagtttacttacgttacgtaaacttaacgttagtttaactaccgttaacccgttacccgttacgggtacggttaccggttacggaaccgggtaacgggtaccgtaaagggtacggtaaacgttaccggaaccgttacggtggtacgtaccgtcgtaaccc

SEQ ID NO: 216619 - DNA, 586 bp, Homo sapiens
  misc_feature: GYAE6OF02F84VM.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctnagatcgtagtctatggtgcatccagtattgacgaagggtcgggtacccagtccgaggttcaggtggacagtgctagtcgtgggacagtattacactctcaactatcagcagcctgacagtcctagaatattttcgactttaaatttattaccgttagtacctaaacgttagttaactttaacgttaacccgttaaccccgttacgggttacggtaccggttccgggaaccggtaacgggggtaacctaaggggtacggtaacgtacccgaaaccggtaacgttcgggtacggtacctcggtaacccg

SEQ ID NO: 216620 - DNA, 518 bp, Homo sapiens
  misc_feature: GYAE6OF02F2HGS.1.34.D01.1.454.CMB.1.raw
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgacgcccctnagatcgtagtctagtggtcgcatccagtattgcgaagggtcgggtcccatccgaggttcaggtggcagtgcatcgtgggacagtacttacactctcactatcagcagcctgcagccgtagacgtatttgcttaaatttcttactgtacaatagtattagtaacgtaccctagtcggtacgttcggaccgaacgggacctaaggtcggaacgtcgaaccgtacgtggtacgcctgacc

SEQ ID NO: 216621 - DNA, 602 bp, Homo sapiens
  misc_feature: GYAE6OF02I702M.1.34.D01.1.454.CMB.1.raw
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtaccagctgtgacatccaattgacccagtctccatcctccctgtctgcatctattggagacagagtcaccatcacttggccgggcagtcaggccatccagcgattcttacgccgttggtgcagcagaaaccgagggcgacgcccctacagactacgtagtctagtggtgacactccagtattcgacgaagggtcggggtaccccagtcctagggttcgtaggttcggacgtaggtagaccgtagttccgtgggaacgtagtaacttacctaccgtctaccacttacgcaacgtcgacgtccgtagcgaagtcctaagtaacgttagtttttacgacttaaattttacttactagttaccaacgttatttacttaactaccgttacctaggtcgtacgttccgggaacgtacggggacaacgggttgtaacggtacgaaccgtaacggttggcggtaccgtagaccc

SEQ ID NO: 216622 - DNA, 531 bp, Homo sapiens
  misc_feature: GYAE6OF02FGSGG.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggcgagcccctcagatcgtagtctatggtgcatccagattgacaaggtggggtcccatccaggttcaggtggcagtgcatctgggacagattacactctcactatcagcagcctgcagcctagaagtatttgactaattttattactgtacaactagttatttatacgttaacccctaggtcggtaccgtttagggcccgtaaggggacctaaagggttgggaacgtcaaccgaactggtacggctacggctaccattcgtcgttccttcattccctcccgtaccg

SEQ ID NO: 216623 - DNA, 645 bp, Homo sapiens
  misc_feature: GYAE6OF02IHGWX.1.34.D01.1.454.CMB.1.raw
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacgttgccgggcgagtcaggcatcagcgtatttctttagccttggttgcagacagaaaaccgngggcacgcccctanagactcgtagtctatggngcatccagtnttgacgtagggtcgggtcccagtccgaggttcaggtcggacgagtgacgtagtcgtagggactaagtacttacgaccttctacgaacttataccgagaccacggtccttggacctacgaccgttagtaacgttattttacgactttaaactttttacttaccgtgttaaccaaacgttagtttaacttaacgttaacccgttaaccccgttaaggggttccggtaccggtttacccggggaccggtaaccgggggtaaccggtaaaggggttaccggaaaccggttaccgaaaccggtacggttagggtacggtccgtacgtaacccg

SEQ ID NO: 216624 - DNA, 673 bp, Homo sapiens
  misc_feature: GYAE6OF02GCYYO.1.34.D01.1.454.CMB.1.raw
  modified_base (290)..(290): a, c, t, g, unknown or other
  misc_feature (290)..(290): n is a, c, g, or t
tcagacgagtgcgtcacgaccggtgctcgatttagatcgtctgtgttgggtttgggggagtcagaccctgtcaggacacagcatggacatgagggtcccgctcagctcctggggctcctgctgctctggctcccaggtaccagctgtgacatccaattgacccagtctccatcctccctgtctgcatctatcggagacagacgtcaccatctacttggccggcgagtcaggccatcagcgattcttagcctggttcgcacgcaacgaaaccgagggaccgacgccccgtnacgactacgtagtctaagtgtcgacatccagtattagacgaaggtcgggtccacgtccgaggttcagtggacagtgctatcgtagggacagtactacgactcctactaactagtcacgaccacgtccgtgacctacgtaccgttaaggtaaagttcgttttacgacctttaaaagtttttaacctttacgttacggttaaacctaacgtttaaaggtttaaacttttaaacgttaaacccggtttaaacccccggttacgggttacggggttaacccgtttacccgggaaccggtaaccgggggggtaaaccccttaaggggtaccggttaaacgttacccgtaaaaccgggtacctttcgggtacggtacgtcgtaacccgg

SEQ ID NO: 216625 - DNA, 770 bp, Homo sapiens
  misc_feature: GYAE6OF02GEHLV.1.34.D01.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (564)..(564): a, c, t, g, unknown or other
  misc_feature (564)..(564): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggcctcccaggtaccagctgtgacatccaattcgacccagtctccatccctcctgtctgctatctagttgganacagagtccacctatcacgttcggccgggngagtcacggccatcgagcgtatttactttacgccgttggttcgacacggaccaaacggaaacccggaggggacccgaacccggtccccctacgaacggttacgttaccggttacgttacgtaacggttcgggtacgacctaacgttaccgaaggttcgttacggaccgggttaaaccgggggttccgggtacccttacgttacccggtaacggtttccgaaggtcggtaccgtaggtccgtacgtacggttccggtaacggggtactaacggtaactttaacccgtacgttaccctacgtaaacttacgtacgacggtaccgaccgtcccgngtaacctccggttaacgtaacggttaagttacgtttttacgaacgttttaacttttacgttactaacgttaactaaacgttattaacgttaaccgtaccgttacccgtacggttcgggttaaccgtcccggaacggggtacgtaaccgggtaaggtacggtaaccgtaacccgtaacgtaacggtcggtacgtccggtacgtaccg

SEQ ID NO: 216626 - DNA, 559 bp, Homo sapiens
  misc_feature: GYAE6OF02GC8AF.1.34.D01.1.454.CMB.1.raw
  modified_base (282)..(282): a, c, t, g, unknown or other
  misc_feature (282)..(282): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcacgcccctnagatcgtagtctatggtgcattccagtattggacgtaagggttcggggtcccactccgagggttcaaggttcgggctaggtcgacaacgttcgtaggggacaggtacttacactctcactancaggcacgcctgacagcctagaagttattttcgacttaatttacttacgtagtacaacttagttaacttactacgtacccctaggtcgggtacgttccggaccggagggaccaagggtagtaacgtaccaaccggtacgtggtcggtcgtgaccg

SEQ ID NO: 216627 - DNA, 734 bp, Homo sapiens
  misc_feature: GYAE6OF02I2UCF.1.34.D01.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
tcagacgagtgcgtcacgaccggtgctcgatttagatcgtctgtgttgggtttgggggagtcagaccctgtcaggacacagcatggacatggagggtccccgctcagctcctggggcctcctgctgctctggctcccaggtaccagctgtgacatccaattgacccagtctccactcctccctgtctgcatctattgganacagagtcaccatcacttcggccgggcgagtcgaggccancgagcgtatttctttacgccgttggttcgcgagtaccaaggaaaccgaggggaccgaccgtcccctgaaggacttacggtacgtctagttcgggtcgctaacgttaccgagtacgttgacggtaacggggttcccgggtacccaagtttcccggtaaggtttccgtaagggttcggactaggtcgtacgtacgtcggtacgggtaacaacgttaacttacgtaacctcttaacgaacttacgtaaccgacgtacgaccgtccgtaacgtcgaccgtccgtaagttaacgtttagttttacgaaacgttttaactttttacgtactttacgtaactaaacgttagtttaaacgttacccgttaaacccgtacccggtttaacgggtaccggtaccggttaccgggacggtaaaccgggtaaaccggtagggttaaccggaaccggtttaacccgaaaccgggttacgtcggttaaccggtcgttacccggtaccg

SEQ ID NO: 216628 - DNA, 615 bp, Homo sapiens
  misc_feature: GYAE6OF02FL3EZ.1.34.D01.1.454.CMB.1.raw
  modified_base (172)..(172): a, c, t, g, unknown or other
  misc_feature (172)..(172): n is a, c, g, or t
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (328)..(328): a, c, t, g, unknown or other
  misc_feature (328)..(328): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattgganacagagtcaccatcacttgccgggngagtcacggccatcagcgattcttagccttggtgcagcagaaaccagggcacgccctnagatcgtagtctatggtgcatccagtattgacgtaagggtcgggtcccatcccgtaggttcaggtggcaggtncgatcgtagggactagtattaccactctaccgacttatccagacaggtccctagacctacggtcctaggaaaccttattttacggacttaattttacgttaccttagtacctaaagtacgttaattaacgttaaccgtaccccttaggtacggtaccggtttccgggaccggtaacggggtaaccgaagggttacggaaacgtaccggtaaacgttaccgtagggtcgacgttccggaaccgtacctagttacgtcgtttaccttccgactttcccgtacccgtacc

SEQ ID NO: 216629 - DNA, 527 bp, Homo sapiens
  misc_feature: GYAE6OF02GEZL8.1.34.D01.1.454.CMB.1.raw
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgattctttagcctggttgctagcagaaaccagggcgagcccctcagatcgtagtctatggtgcatccagtattgcaagggtgggtcccagtccaggttccagtggcagtgcatcgtgggacaggtattacactcgcacgtatcagcacgcctgacagcctagaagtntttagctaatttatactgtactaactagttaatattacgtaccccgtagttcggtacgttcggaccgagggtaccgaagggtacgtaagtaccgaacgtaaccgtggtacggtcctgtacccg

SEQ ID NO: 216630 - DNA, 694 bp, Homo sapiens
  misc_feature: GYAE6OF02GC0B4.1.34.D01.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggnagtcaggccatcagcgattcttagcctggtgcagcagaaacnggcgacgccctnagatcgtagtctagtgtgcatccgagtattgacgaagggttcgggtcccagtccgtaggttacgaggtcggcaggtgctagttcggtagggaactaggtacttaacaccttctacctaacttactaccgaagtacctacgtcccgtaggacccgtaacgtacccgttaggtaaacgtttacttttacggaactttaaaacgtttttacgttaaccgttaccggttaaccttaaacgttaacgtttaactttaaacccggttaaccgtttaacccccggttaacgggttacgggtaaccgggttttcccgggaaaccgggtaaccgggggtaaacccggttaaaggggttaacgggtaaaccgttacccggtaaacccggttaacggttcgggttacgggtaccgttacggtaaccccg

SEQ ID NO: 216631 - DNA, 566 bp, Homo sapiens
  misc_feature: GYAE6OF02FUJSC.1.34.D01.1.454.CMB.1.raw
  modified_base (256)..(256): a, c, t, g, unknown or other
  misc_feature (256)..(256): n is a, c, g, or t
  modified_base (529)..(529): a, c, t, g, unknown or other
  misc_feature (529)..(529): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctagtggtgctatccagattgacgaagggtcgggtacccagtccgaggttcgagtggcagtcgctatcgtgggacagattacactctcactatcagcagcctgcagcctagagtatttgactaatttacttactgttactaatagttatttagtaaccgttacccctaggtacggtaccgtttcggaccggtaaggggtaaccctaaagggttaggaaacgtcgtaaccggtactagggtcggccgtacgaccgtaacccgtnttctacggttcttaccgactttcccgttcccgtaccc

SEQ ID NO: 216632 - DNA, 493 bp, Homo sapiens
  misc_feature: GYAE6OF02J2YO2.1.34.D01.1.454.CMB.1.raw
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (441)..(442): a, c, t, g, unknown or other
  misc_feature (441)..(442): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (469)..(472): a, c, t, g, unknown or other
  misc_feature (469)..(472): n is a, c, g, or t
  modified_base (475)..(476): a, c, t, g, unknown or other
  misc_feature (475)..(476): n is a, c, g, or t
  modified_base (478)..(478): a, c, t, g, unknown or other
  misc_feature (478)..(478): n is a, c, g, or t
  modified_base (480)..(481): a, c, t, g, unknown or other
  misc_feature (480)..(481): n is a, c, g, or t
  modified_base (483)..(483): a, c, t, g, unknown or other
  misc_feature (483)..(483): n is a, c, g, or t
  modified_base (485)..(486): a, c, t, g, unknown or other
  misc_feature (485)..(486): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtccatccaggttcagtggcagtgcatcgtgggacagtattacactcgtcactatcagcagcctgcagcctgagtattttgactaatttgtactgtacaactgttattagtacgtacccctagtggacgttcggccgagggacaaggtggaatcaacgatggtcgctgacacatctgttcctcacgttctcccgactactcgtacgaaccgtctacgttcgtcgtacggacggtccgggtctacggacaacggggtccaacgtacgtaggntctagtcnctgcgcngacnncncngcactcgcgcgtcgcgncncncnnnngcnncntnncncnngcngngc

SEQ ID NO: 216633 - DNA, 690 bp, Homo sapiens
  misc_feature: GYAE6OF02GV2W6.1.34.D01.1.454.CMB.1.raw
  modified_base (312)..(312): a, c, t, g, unknown or other
  misc_feature (312)..(312): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtcaccatcacttgccgggcagtcaggccatcagcgattcttagcctggttgcagcagaaaccgagggcgacgcccctacagactcggtagtctatggtgcactccagnttgcgaaggtcgggtcccagtccgaggttcaggtcggcgagtcgcagtcgtagggacagtacttaccgactcctacaacttacgttaccgagtacctacggtcccgttaggcctacgcccgttaaggtaacgttacgttttacggtactttaaagttttaacttttaccgtacgtttaacctaaagtttaaacgtttaaccttttaaacggttaaacccgtttaaccccggttaacgggtttaccgggttacccggtttaccggggaacccgggtaaccgggggttaaccggtaaaacggggttccgggtaaaacggttaacccggttaaaccggaaaccgggtttacgggttaccgggttacccgtacggtaacccg

SEQ ID NO: 216634 - DNA, 682 bp, Homo sapiens
  misc_feature: GYAE6OF02JPL0C.1.34.D01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (289)..(289): a, c, t, g, unknown or other
  misc_feature (289)..(289): n is a, c, g, or t
tcagacgagtgcgtcacgaccggtgctcgatttagatcgtctgtgttggtttgggggagtcagaccctgtcaggacacagcatggacatgagggtcccgctcagctcctggggctcctgctgctctggctcccaggtaccagctgtgacatccaattgacccagtctccatcctcctgtctgcatctatgganacagagtcaccatcacttgccgggnagtcaggccatcgagcgtattcttagcctaggttgctaggcaagaaacccgagggaccgtacgccccgtanagacgtcgtaagtcctaagtggtacgctaactcccgaggtaacttggaccgtaaacggggttcggggtacccctaagtcccgtaacggggtttctaagggtcggtacgtacgggttacgctacggttacgtgggtaaaacgacgtacgttaacaacctccgtactaactactacgaacgtcgaaccgtcctcgacgtaacgtccgtaagggtaaacttcgttttacgaacgttaaacttttaacttaccgttacgtacgtaaacttacgttacttaacgtaaccgttacccgttaggtacggtaccggtttaccggcggtaaaccgggtaccgtaaggggtaaccgttagggaaccctaaacggtaccgtacggtacgtccgtagtaacccgg

SEQ ID NO: 216635 - DNA, 529 bp, Homo sapiens
  misc_feature: GYAE6OF02IJEFR.1.34.D01.1.454.CMB.1.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggttgcagcagaaaccaggcgagcccctanacgatcgtagtctatggtgcatccagattgcaaggtgggtccatccaggttcaagtggcagtgcatctagggacagattacactctacactatcagcagcctgcagcctagaagtatttgacttaaatttacgtaccttgtaccctaaatagttaacttaactacgttaaccccttagtcggtaacgtttccggaacctaaggggaccaagggtacgaagtcaaacgtaactcgtaggcctagtaccg

SEQ ID NO: 216636 - DNA, 720 bp, Homo sapiens
  misc_feature: GYAE6OF02GCBL5.1.34.D01.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccntcacttgccggcgagtcgaggccatcagcgtattcttagccttggtncagcaagaaccgngggcacgcccctagagatcggtagtctagtggtacnctactaccgagtacttgacgtaaggggtcgggtacccagttcccgtaggtttcgaggtacggctacggttcgctaacgttcggtacgggaactagtactttaaccgaccgtttcgtacctaaacgttactacgtaacgccgtaaccggccttggaaccgtacggtacccgttaaggtaaactttcgggtttttaacaaccgtttaaactttttacgtttacccgtagtttaaccctaaacggtttaacgtttaacgtttaaacgttaacccgtttaacccgttaacggggtacggtttaccggtacccgggtaccgggtaaaccgggggtaccggttaaacgggtttacgggaaacccgtttaccggtaaacccgggtacgtttaccgggtcgggtacccgttacggtaaccccg

SEQ ID NO: 216637 - DNA, 667 bp, Homo sapiens
  misc_feature: GYAE6OF02I0E0X.1.34.D01.1.454.CMB.1.raw
  modified_base (227)..(227): a, c, t, g, unknown or other
  misc_feature (227)..(227): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (429)..(429): a, c, t, g, unknown or other
  misc_feature (429)..(429): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtcaaccatccacttggcccgggnagtcaggccatcagcgattcttagcctggttgcagacagaaaccgngggcgaacgcccctanacgacgtacgtagtctagtggtcgacactccaggtattggacgtaaggtcgggtaccccagtccgtaggttcaggtgcagtgcatcgtagggaactagtactacgtactaccacgtactacgtacacgacgtacgtaccncgacgtaccgtaccgtaagttaacgtttagtttacgtaaacttttaacgtttacgtttaacgtacgttaaactaaacggttaagtttaacttaaaccggtttaaaccccttaaccgggttaaccgttacgggtttaccggtaaccggtaaccgggtaaacggggtaccggtaaacgggttacggtaaacccgtacggaaacccggttaggttaccggttacggaccgtccgtaaccgg

SEQ ID NO: 216638 - DNA, 607 bp, Homo sapiens
  misc_feature: GYAE6OF02FU4DH.1.34.D01.1.454.CMB.1.raw
  modified_base (414)..(414): a, c, t, g, unknown or other
  misc_feature (414)..(414): n is a, c, g, or t
  modified_base (444)..(444): a, c, t, g, unknown or other
  misc_feature (444)..(444): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagccaagaaaccgagggccgacgccccctgaggtatcgtagtctagttggtgcatccagattgacgtaagggtcgggtacccagtcccgtaaggttccgaggttcggctaaggtcgcagtcgtaggggactaggtacttaacacttctacgacttancacgccagtcctgctagacctagtaagttnttttacgacttaatttattacgtgttacctaactaagttaacttacgttaaccgttaaccccgtggttacggtaccggtttaccgggacccggtaaggggtacccgtaagggtacggtaacgtaccggtaaccggtaacgtcggtacggtacgtcgtaacccg

SEQ ID NO: 216639 - DNA, 659 bp, Homo sapiens
  misc_feature: GYAE6OF02HCKXM.1.34.D01.1.454.CMB.1.raw
  modified_base (456)..(456): a, c, t, g, unknown or other
  misc_feature (456)..(456): n is a, c, g, or t
tcagacgagtgcgtcacgaccggtgctcgatttagatcgtctgtgttgggtttgggggagtcagaccctgtcaggacacagcatggacatgagggtccccgctcagctcctggggctactgctgctctggctcccaggtaccagctgtgacatccaattgacccagtctccatcctccctgtctgcatctagttggagacagagtcaccatcacgttggccgggcgagtcaggccatcgagcgtatttctttagccgttggttcgcagacaaggaaaccgagggcgacgcccctcagatcgtagtctagtggtgctatccagtattggacgtaaggggttcgggtacccagtccgtaggttcaggtcggacgagtcgactagtcggtagggactagtacgttacacttctacactatcacgtccgacgtcctgaccacgtaccgtaagtaacgttnttttaacggactttaaagttttacttaccgttacgttaacctaaacgttacgttttaaacttaccggttaaacccgtttaccccgttacggttacgggttaacccggtttaccggggaaccggtaaacgggggtaaccgtaaggggttaaccggaacgtaacccggtaaacggtacgttcgggtacggaccgttacggacccg

SEQ ID NO: 216640 - DNA, 652 bp, Homo sapiens
  misc_feature: GYAE6OF02G2D1P.1.34.D01.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagngtcaccatcactgccgggcgagtcaggccatcagcgattcttagccttggttncagcaagaaaccgagggacgacgcccctacagacgtcgtagtcgtagtggtgcatccagtattggacgtaaggggtcgggtacccagtccgtaggttcaggttcgaccgtagtgctatcgtgggactacgtattaccgacttctaacgacttacgtacgacgccgtacgtccctaggaccgtacggtccttaagggaacgtttacttttcggaaacctttaaagtttttaccttaacgttacggttaacctaaaccgttagtttaaactttacgtaaaccgtttaaccccgttagggtacggttaaccggttccgggtaaacccgggacggggtaaacccgtagggttaaccggaagttaaccccgaacggtaacgttggggtacctccgataccccg

SEQ ID NO: 216641 - DNA, 720 bp, Homo sapiens
  misc_feature: GYAE6OF02IFTKB.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctagttggagacagagtcaccataccacttcggccgggcgagtcgacggtccatcacgcgtatttctttacgccgtgggttcgcacggacaaggaaaccgaggggaccgacgccccctcgagtacgttccggtagtctaggtcggtgactacgtcctaagtagtttacggacggtaagggtccggggtcccctaagtccgtaggttccaggttcgggactaggtacgctacggttcgtacgggtaacagtaacgttacctaccttactaccaaccttactacgacgtacgaccggtcctagaccgaacgtccgttaagtaacgttattttaccgaacttttaaagttttacgtacttacgttacctaacgttaagtttactttaactaaccggtttaaccccgtagggttaccgggttacccggtttaccgggaacccggtaacggggtaaacccggtaagggttaccgggtaaacggttaccccgtaaaccggttaacggtacgggttacgggttccgtaccggtaaccccg

SEQ ID NO: 216642 - DNA, 755 bp, Homo sapiens
  misc_feature: GYAE6OF02I7P52.1.34.D01.1.454.CMB.1.raw
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgtattctttagcctggttcncagcaagaaacngggcgacgcccctnagagtcgtagtctaagtcggtgactagtaccaggtattcggacgtaaacggggtccgggtacccaagttcccgtaagggtttcaaggttcggtacctaaggtcgactaagttcggtacggggaactaaggtaactttaaccaccgtttaccgtactaaccgttaactaccgtaacgaccgtaaccgcccgttaggaacccgtaacggtcccgtaaggtaaaacgtttacgtttttacgggaacttttaaatttttaaccgttaacgttacggtaaacctaaacggttaagttttaaacgtttaaacggttaacccgttaaccccgggtttaacggtaccggggtttaaccggtttacccgggggaacccggtaaaccgggggttaaaccggtaaaccgggggtaacggtttaaacgggtacccgtaaacccggtaaggttaccgggtacggtaccgttacggtaaaccccg

SEQ ID NO: 216643 - DNA, 757 bp, Homo sapiens
  misc_feature: GYAE6OF02HJ7FE.1.34.D01.1.454.CMB.1.raw
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccatccctccctgtctgcatctagttggagacagacgtcaccatcctacttcggccgggcgagtcgaggccatcagcgtatttcttacgccgttggttncgacgacaaggaaaaccgnggggccgacgcccctacgaggtacttacgtagtctaagtggtacgctactaccagtattcggacggtaacggggttcggggtacccctacgttcccgtaagggtttaccgaggtcgggctaggtcgacacgttcggtaggggtaaccaggtaactttaaccgtaccttaccgttacctaacttactacgtaacggtacccgtacgggtcccttacggaccgttaacggtacccgttaggtaaaacgtttcgtttttacggtaacctttaaaagtttttaacgttaccgttacgttaaccttaaacgttagttttaaactttaacgttaaccccgtttaccccggttaagggttaccgggttaaccgggtttccccggggaacccggtaacgggggtaaccgttaacggggtacggaaccggttaacccggaacgggttaccggttgggtaccggtcgtaaccgtcccg

SEQ ID NO: 216644 - DNA, 637 bp, Homo sapiens
  misc_feature: GYAE6OF02GMM67.1.34.D01.1.454.CMB.1.raw
  modified_base (289)..(289): a, c, t, g, unknown or other
  misc_feature (289)..(289): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacgttggccgggcgagtcaggccatcagtcgattctttagcctggttcgcagacaagaaaccgagggcgacgcccctnagtactcgtagtctagtggtgcatccgagtattggaccgtaaggggtcgggtccccagtccgaggttccaggtcggacaggtcgctagtcgtgggaacagtactttacaccttcctacgaacttacgtacgagaccngccctggaccacgtcgttagaagtttactttcggaacttaatttattaccgtattaaccgtaaattactttaatttaacggttaaccgttaccccgttaacgggttaccggttaccggtttacgggacccggtaacgggggtaaccgaacggggttaacgggtaaccgttacgaacccggttacgttagggtcggtacgtacgtaaccccg

SEQ ID NO: 216645 - DNA, 653 bp, Homo sapiens
  misc_feature: GYAE6OF02FO2YY.1.34.D01.1.454.CMB.1.raw
  modified_base (315)..(315): a, c, t, g, unknown or other
  misc_feature (315)..(315): n is a, c, g, or t
  modified_base (445)..(445): a, c, t, g, unknown or other
  misc_feature (445)..(445): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgattctttagccgttggttgctagcgaagaaaccgaggggccgacgcccctcgagacgttacgtagtctaagtgggtnacgtatccgagtagttgacgtaaaggggtcgggtcccgaattcccgtaggttacgtaggtcggacgtaggtcgacgtacgtcggtagggaacgtaggtaacttaccgtaacttccgttacctaaacgttntaccgaacgccaacggtcccgtacggacctacggtaccttaagggtaacgttactttttcggaacctttaaggtttaactttacgtacgttaacgtaacgtaatttacttaacgtaaccgtaccccgtagtacggtccgtacgggaccgtacgggtaccgtaagggtacgaacgtaccgaaccgtaagttcggaggtcgtgtaacccg

SEQ ID NO: 216646 - DNA, 763 bp, Homo sapiens
  misc_feature: GYAE6OF02HNPOE.1.34.D01.1.454.CMB.1.raw
  modified_base (196)..(196): a, c, t, g, unknown or other
  misc_feature (196)..(196): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattgganacagatcaccatcacttggccggcgagtcaggccatcagcgattctttagcctggttgcagcaagaaaccgagggcgacgcccctacaggactccggtagttctagtgggtcgctactccgagtacttggacgtaaggggttcggggtaccccacgtccgtaggtttaccgaggttcgggaccgtaagggtcgtccgtaacgttccggtaacgggggtaacctaaggtaactttaacccgtaacgtttcccttaaccgtaaacccttaacgttaccgtaaacgggtacccgtaaacgggtccccgttaggacccgtacggtaccccgtttaagggtaaaacgttttacgtttttttaaaggtttaaaacttttttaacgttttaaccgtttacggttaacctaaacgtttaacgtttaaacttttaacgttaaacccggtttaacccccgttaacgggttcgggttaacccgggtttccgggaacccggtaacgggggtaacccgtaagggggtacggtaacgtaccgaaacccggtagtcggtacggtcgtacgtacccgtaaccg

SEQ ID NO: 216647 - DNA, 640 bp, Homo sapiens
  misc_feature: GYAE6OF02INQ6N.1.34.D01.1.454.CMB.1.raw
  modified_base (184)..(184): a, c, t, g, unknown or other
  misc_feature (184)..(184): n is a, c, g, or t
  modified_base (223)..(223): a, c, t, g, unknown or other
  misc_feature (223)..(223): n is a, c, g, or t
  modified_base (447)..(447): a, c, t, g, unknown or other
  misc_feature (447)..(447): n is a, c, g, or t
  modified_base (633)..(633): a, c, t, g, unknown or other
  misc_feature (633)..(633): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctcctgtcngcatctatggagacagacgtcaccatctactggccgggngacgtcaggccatcagcgtattcttagccgttggttgcagacaagaaaccgagggtcgacgtccccgtcgaagtacgtcgtatcgtaagttgggtcgccattaccgagttacgtgacgtaagggtcgggtaccctataccggtaggtttacgaaggttcgggacgtagttcgactaacgtccggtagggaactacggtactttaccaccgtactaccacttacnccgaacgccgtaacgcccgtagaccgtacgtccttaaggaacgtttactttagacctttaattttacgttacttcgtaacaataagtttactacttaaccggttaccctaggtacggttaccgttaccggcggaaacgggtaccgtaagggtacggaacgtaacgacccgtagttcggacggtccngtacccg

SEQ ID NO: 216648 - DNA, 754 bp, Homo sapiens
  misc_feature: GYAE6OF02HQWUB.1.34.D01.1.454.CMB.1.raw
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctcctggggcctcctgctgctctggctcccaggtaccagctgtgacatccaattcgacccagtcctccatcctccctgtctgcatctatgganacagatcaccatccacgtcggccgggcagtcacggccatcagcgtatttcttagcctgggttgctagacaagaaccgtaggggccgacgcccctnaggtactcgtagtctagtcggtgacactaccaggtaacgttggaccgtaacggggttcggggtaccccacgtttaccggacggtttaccgaggttcgggacgtaacggtcgtacctacgggttacccggtaggggaactaacggtaacgtttaccctaccgttcttacccgaacttacgttacgacggtacaccggtaccgtgaaccgtacggtacccttaagggtaacgttatttttccggacttttaaaattttacgttaacgtacgttaacgtaaacgttaacgtttaacttaaccgttaacccggtttaaccccgttacggttaccgggggttaacccggtttacccgggaccgggtaaacccgggggtaccggtaaaggggtaaccgggtaaccccggtttaccggaaacccggttacggttacgggggttacccgtaccgtaccggttaacccc

SEQ ID NO: 216649 - DNA, 605 bp, Homo sapiens
  misc_feature: GYAE6OF02HIG68.1.34.D01.1.454.CMB.1.raw
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (454)..(454): a, c, t, g, unknown or other
  misc_feature (454)..(454): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacgttgccgggcgagtcaggccatcagcgtattctttacgcctggttgcagcaagaaaccgngggccacgcccctnagactcgtagtctagtggtncatccagtatgacgtaaggtcgggtacccagtcccgtaggttcaggtcggcgtagtcgcgtagttccggtagggaccagtaacgttaccacttcctactaacttactacgagcctacgcccgtaggctaaccgtcgtagtaacgttnttttacggattaattttacttacgtgtaactaacgttagttaacttacgtaccgttaccccttgggaccggttacggttaccgggccggtaacgggaacctagggtaccgtaacggtaaccgaaccggtacgttcggacggtcacgtaccg

SEQ ID NO: 216650 - DNA, 645 bp, Homo sapiens
  misc_feature: GYAE6OF02G8SI4.1.34.D01.1.454.CMB.1.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (416)..(416): a, c, t, g, unknown or other
  misc_feature (416)..(416): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagccttggttgctagcaagaaaccgngggcgaacgcccctanagactcgtagtctagtggtnacatccagtattggacgtaggggtcgggtcccagtccgtaggttcaggtcggactagtcgactacgtcggtagggacagtacttactactccgtacctactactcganaccgacgtccgtggacacgtaccgtaagtaacgtttacttttacgtaactttaagtttttactacgtttacgttactaacgtttaagtttaactttaacgttaacccgttaacccgttagggttacgggttaaccggtttaccgggaccgggtaacggggaaccgttaaagggtacgggtaacgtaccgtaaacccggtagttcgggtacggtaccgtacggtaacccg

SEQ ID NO: 216651 - DNA, 764 bp, Homo sapiens
  misc_feature: GYAE6OF02F5IIR.1.34.D01.1.454.CMB.1.raw
  modified_base (132)..(132): a, c, t, g, unknown or other
  misc_feature (132)..(132): n is a, c, g, or t
  modified_base (156)..(156): a, c, t, g, unknown or other
  misc_feature (156)..(156): n is a, c, g, or t
  modified_base (159)..(159): a, c, t, g, unknown or other
  misc_feature (159)..(159): n is a, c, g, or t
  modified_base (754)..(754): a, c, t, g, unknown or other
  misc_feature (754)..(754): n is a, c, g, or t
tcagacgagtgcgtcacgaccggtgctcgatttagatcgtctgtgttgggtttgggggtaggtcgagaccctgtcaggacacagcatggacatgagggtcccgctacacgctcctgggctctcgctgctcgngcctcccacggtaccaggctgtanacntaccaattcgacccagtctcccatccctccctgtctcgacactccgtattcggaacgactaagcgtaccacccaatcctacgttcggaccgggctacgttaccgacggcccataccgacgtacgagttccgttacgtccgttggttcgtcgacgtcgaacgtaaccgacgggtaccggtaccgacccccgtagacgtacgtacggttactacgtacgtcggttacgcctaagtaccctagaacgttcggaccgtaagggttcgggtacccgtacgtacccgtacggttacggaaggttcggaccgtaacggtcgtaccgtattaccgggtcgggtaacccaagggttaaccgttaacgtacccgttaccgttaccttaaacccggttataaccccgtacggctaaaccgggtccttccgggacctacgtaacccgtacgttaacgtacgttttgacttttaaagttacttagtttcgtaccagttaacttaactagttaccgttaaccttaccggttagtaaccggttcgtaaccgggtaccggtaacggaacggttacggtacgtaactaacccggtaagtacggttacccggngaccgttacg

SEQ ID NO: 216652 - DNA, 786 bp, Homo sapiens
  misc_feature: GYAE6OF02HR5C5.1.34.D01.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcagtcaggccatcagcgattcttagcctggttgcagacaacgaaccgagggccgacgtccccctanacgtatcgtagtctagtggtgactactccgagtacgttgacgtaacgggtcggtaccccgtagtcccgtaggtttcgacgggttacggaccgtacggtcgtaccgtagttccggttacggggaacctaacgtaacgttaacccgtacctttaccgttaaccgaaccgttacttaccgtaacggtacgtaaccggtcccgtacggtaccgtaaccggtacccgttaaaggttaaacgtttaccgttttaacggttaacttttaaacgtttttaaaccgttaaccggtttaaccgttaaaccggaaaccgttttaaaggttttaaccgtttaaacgtttaaccccgtttaacccccggttaacgggtttacggggttaacccggtttcccggggtaaacccgggtaaccgggggttaaacccgtaacggggttaaccgggtaaacgttaccgggtaaaccccgtacggttaagggtacccggtaccggtacggtaacccg

SEQ ID NO: 216653 - DNA, 577 bp, Homo sapiens
  misc_feature: GYAE6OF02HRC47.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacagagtcaccatcacttcggccgggcgagtcacggccatcagcgtattcttagcctggttgcagcaagaaccagggcgacgcccctnacgatcgtacgtctagtgggtgccatccagtattgactaagggtcgggtccctagtccgtaggttcaggtcggtcaggtgaccagtcgtaagggacaggtatttaaccgacttcgtaccactaactcgaagcacgccgtggacctacgtcctaggaagttactttgacttaagttttactactgtacaattagttaatactaaccgtaccgttaaggtcggttaacggttccggccgtaacggggtaaccaagggttacgaacggttccaaacgtgttaggtgacgtagacc

SEQ ID NO: 216654 - DNA, 791 bp, Homo sapiens
  misc_feature: GYAE6OF02JGA9V.1.34.D01.1.454.CMB.1.raw
  modified_base (224)..(224): a, c, t, g, unknown or other
  misc_feature (224)..(224): n is a, c, g, or t
  modified_base (318)..(318): a, c, t, g, unknown or other
  misc_feature (318)..(318): n is a, c, g, or t
tcagacgagtgcgtcacgaccggtgctcgatttagatcgtctgtgttgggtttgggggaggtcagaccctgtcaggacacagcatggacatgagggtccccgctcagctcctggggctcctgctgctctggctcccaggtaccagctgtgacatccaattgacccagtctccatcctcctgtctgcatctattggacgacagagtcaccatcacttcgccgggnagtcaggccatcagcgtagttcttagccttggttacgtcgagtcgaagaaaccgagggcgacgcccgtacgacgactcggtagtctagtggtcncgactccaggtatttcggactaaaggggttcggggtaccctacgttccgtacgggtttaccgaggttacggacgaacgttcgacgttaacgtccggttacggggaccgtaacggtaacgttaacccgtacgttacccgttccgtaaacccttacgtaacctaacggaccgtaaccggtcccgttaggacccggttaaccgtaccggttaaccggtaaacgtttacggtttttaccgaacggttttaaaacttttaaccgtttaacggtttaaccctacgttaaaacccggttagtttttaaaacgtaaacgttttaaccgttaaacccccggtttaacgtttaccggggtttaacccggttaccggtaacccggttaacgggggtaaacccgaaacgggtttaaccgggtaaacgttacccggtaaaccgttaacggttaaccgggttaacggtaccggtttaccgaacccgg

SEQ ID NO: 216655 - DNA, 581 bp, Homo sapiens
  misc_feature: GYAE6OF02JDWQL.1.34.D01.1.454.CMB.1.raw
  modified_base (238)..(238): a, c, t, g, unknown or other
  misc_feature (238)..(238): n is a, c, g, or t
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcagtcaggccatcagcgnttcttagcctggttgcagcagaaccagggcgacgcccctcagatacgtgtcctagtcggtgcatacccagtattgacgtaaggtcgggtcccagttccaggttcagtggcagtcgctaatcgtgggacaggtaacttacacttactcgattactcagacgacggcctgacacgtcctagaagtacttttnaccgttaaatttattactagttccaacttagttaacttaacgttaccgttacccgtaaggttcgaccggtttacggtcccggtaacgggtaccgtaagggtacggtaaaccgttacgaaacccgttacgtacggtacggtcgttacgaacccg

SEQ ID NO: 216656 - DNA, 617 bp, Homo sapiens
  misc_feature: GYAE6OF02HA7MB.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtccaccatcacttggccgggcgagtcaggccatcagcgattctttagcctggttgcagcagaaccagggcgagcccctnagatcgtagtctagtggtgcactccagattcggacgaaggggttcggggtcccagtcccgaggtttccaggttggctaggtgctagtcgtagggacagtacttacacttctacgacttacgtcacgcgacgtccctggcacgtccgttagtaacgttagttttcggaactttaaagtttttacttactacgttacctaattagttaatttacgtaaccgttaccccgttaggttacgggttaccggtttccgggaacccggtaacgggggtaacctaaggggttacggtaacgtacccgtaaaccggtaacgtgggtacggtccgttaggacccg

SEQ ID NO: 216657 - DNA, 471 bp, Homo sapiens
  misc_feature: GYAE6OF02F2MA9.1.34.D01.1.454.CMB.1.raw
  modified_base (262)..(262): a, c, t, g, unknown or other
  misc_feature (262)..(262): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (443)..(471): a, c, t, g, unknown or other
  misc_feature (443)..(471): n is a, c, g, or t
tcagacgagtgcgtcacgaccggtgctcgatttagatcgtctgtgttgggtttgggtagtcgaggccatcagcgattctttagcctggttgcagcagaaaccagggcgagcccctcagatcgtagtctatgggtgcaatccgagattgcaagggtggggtcccatccaggttcagtggcagtgcatcgtgggacagattacactctgtactatccagcagtcctgccagtcctgaaagtcttttgacaaatttttagtaacngttacaaactagttaattatacgacccctagtggacgtttcggccgaaggggtaccaggtaggaagtccaaacgaacttggcgactgcaccgtatccttgtcttctatccttcccgccatctcgaacgtccacgtgtctagtggcggcgtacggtacagggtcacgtatcggantncntcnnnnnnnnnnnnnnnnnnnnnnnnnnnnn

SEQ ID NO: 216658 - DNA, 821 bp, Homo sapiens
  misc_feature: GYAE6OF02G6TAJ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtatttctttagcctgggttcgacaacgacgaaacgaaccggacgggaccgacccgacccctagagtacgtacggttacgtagtaggttcggcgtactacctaacgtaacgttaggttacgaacgggttacgggggttcccggtacctaccgtaccgggttaggttacggtagggtaccggacgtagggtaccgtacgttagttaccggggacgggtaaacgtacgtttaaccttaccgtaccttaccgtactaaacgttaccgtaccgaccgtacgtaacccggtcccgtacgacccgtaacccgggttactaaacgggtttaacgttttacgtttaccttaaaacgtttttaaagtttttacctaaccgtttaaccgttaaccgtttaaacgtttaagtttttaaaacctttaaccggttaaacccccgtttaacccgggtttacgggttacccggggttttacccggtacccgggggtaaacccgggggtaacggggtaaacccggtaggggtaaaccgggttaaccgtaaacccgggtaaccggttacggtaccgggtcgttacccgtacggtaacccc

SEQ ID NO: 216659 - DNA, 683 bp, Homo sapiens
  misc_feature: GYAE6OF02GVAV7.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctagttggagacagagtcaccatcacttggccgggacgagtcgacggccatccgagtcgatttcctttaggccttggttcgacagacgaaacgaaacccgacggggcgaaccgccccctacgagtacttcggtagtctagtcgggtgaccactaccgaagtgtttaggacgaacggggttccgggtaccctacgtaccgtagggttcaggttacggctaaggtcgctagtccggtagggaactaggtacttaaccacttctacctaacgttactccgacgtacaccgtccgttgaaccgtacgtaccgtttaaggaatttacgttttcgaaattttaaacttttacgtttacgtacgttaacctaagttaagtttaacttacgttaacccgttacccgttaggttacggttaccggttaccgggaacccggtaaggggtaaccgtaagggtacgaacccggtaactaaccggtcgttaggtcggaccgtagacc

SEQ ID NO: 216660 - DNA, 603 bp, Homo sapiens
  misc_feature: GYAE6OF02GWFZK.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccgagggcgacgcccctcagatcgtagtctagtggtgcatccagtagttgacgaagggtcggggtcccgacgtccgtaggcgttttttttttttaggcggcgagtgctatcgtggacagtatacactctcactatacagcacgcctcgcacgcgtagtaagtagtttacgtacttaatttaacttacgttacgtactaactaagttattactacgttacccgttacggttacggtaccggttacggtaccggaacggggtaacggtaacggtacggtaacgtaacgaaccgtaacgtacggtcggtacgtcgtaccgaccgtacgtcgttcgttccttacctaccttacccgttcccgtacccg

SEQ ID NO: 216661 - DNA, 597 bp, Homo sapiens
  misc_feature: GYAE6OF02HA710.1.34.D01.1.454.CMB.1.raw
  modified_base (288)..(288): a, c, t, g, unknown or other
  misc_feature (288)..(288): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccactccctccctgtctgcatctatggagacagagtcacatcacttggccgggtcgagtcgacggccatcagcgtattctttagacgtgttgcagcagaaaccgaggcgacgcccctnagctcgtatcgtatggtgcatccatagttgacgtaagggtcgggtacccagtccgtaggttacgagtcgganagtcgtacngtacgtcggactagtacttactacgtctacatancctagcacgcctgaccacgtcgtagtaagttatttcgacttaatttatttaccagttactaaattacggttaacttaacgttaccgtaccccgttaggtaccggttaccgttccgggaaccgtacggggaaccgtaaacgggtacgtaaggtacccgaaaccggttacgtacggttacggtacctgtaaccccg

SEQ ID NO: 216662 - DNA, 649 bp, Homo sapiens
  misc_feature: GYAE6OF02I59FV.1.34.D01.1.454.CMB.1.raw
  modified_base (115)..(115): a, c, t, g, unknown or other
  misc_feature (115)..(115): n is a, c, g, or t
  modified_base (600)..(600): a, c, t, g, unknown or other
  misc_feature (600)..(600): n is a, c, g, or t
  modified_base (603)..(603): a, c, t, g, unknown or other
  misc_feature (603)..(603): n is a, c, g, or t
  modified_base (608)..(608): a, c, t, g, unknown or other
  misc_feature (608)..(608): n is a, c, g, or t
  modified_base (612)..(612): a, c, t, g, unknown or other
  misc_feature (612)..(612): n is a, c, g, or t
  modified_base (616)..(649): a, c, t, g, unknown or other
  misc_feature (616)..(649): n is a, c, g, or t
tcagacgagtgcgtcacgaccggtgctcgatttagatcgtctgtgttgggtttgggagtcaggccatcagcgattctttagcctggttgcagcagaaaccagggcgagccccctnagatcgtagtctatggtgcatccagattgcaagggtcggggtcccatccgaggttcaccggtggcagtgcatcgtgggacagtacttacactctacacttatcagcactccctggaccacgaccctaggtaacggttattttcgacttaaaacgtttttacttacctaggttactaaaaccgtagtttaacttaacgtaccggttaaccccccgttaggttacggggtaccccgttttaccgggacccggaacgggggggttaaccctaaagggggttacgggaaaccggttaccccggaaaaccgtaacggttccgggtaagggtccttacgacccgtaccctaggtttcctacggttacccttaccgttaaccttcccggttttcccccgacctttagtacccgttagtaaacccgtctacccggttcctacggttggaccgggtccgggacgtcggaacggtaacgggcaactagtaacggnacnagtcnggantacnnnnnnnnnnnnnnnnnnnnnnnnnnnnnnnnnn

SEQ ID NO: 216663 - DNA, 666 bp, Homo sapiens
  misc_feature: GYAE6OF02JK896.1.34.D01.1.454.CMB.1.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
  modified_base (441)..(441): a, c, t, g, unknown or other
  misc_feature (441)..(441): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctattgganacagagtcaccatccacttcggccgggcgagtcaggccatcagcgattcttagcctggttgcagcagaaaccaggggcacgcccctcgacgtactcgtagtctagtggtncactccgagtagttcgacgtaagggtcgggtacccagtccgtaggttcgtaggtcggcgtagtcgactagtcggtgggaactaggtactttaaccgacttcgtacctaactacgtacgacggtcacgtacccnggtaccgtaacggtcttaaggaaacgtttcgttttacgacttaaatttttacgttaacgttcgttaactaaacgttagtttaaactttaaccgttaaccgttaccccgttaagggttccggttaacgggttcccgggtaaccggtaaacggggtaacccggtaaggttaaccgggtaataacccgggtaaccgtaacggttcggtccgggtacttacggaacccg

SEQ ID NO: 216664 - DNA, 776 bp, Homo sapiens
  misc_feature: GYAE6OF02IZ66M.1.34.D01.1.454.CMB.1.raw
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (375)..(375): a, c, t, g, unknown or other
  misc_feature (375)..(375): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctcctgtctgcatctattggagacagagtcaccatccacttggcccggggcgagtccaacgggccatcagcgtatttctttagccttggttgcagcaggaaccagggcacgccctnagntcgtagtctagtggtnacatccagtattcgacgaaggggtcgggtaccctagtaccgaggtttcaaggtgggactaggtncgtagttcggtggggaactaggtaacttaacccgacttcgtacctaacctactaccgtacgccgtaacgcccgttggaccctacggttacccgtaacggtaaacggtttacgtttttcgttaaacgttaaacgttttttaacgtttaccctttaaccgggttaacttaaaaccgtttagggtttttaaaaacctttacgggtttaaacccccggttaaacccgtttaccgggggttacgggtttaacccgggttttacccggggaacccgggggtttaaaccgggggggaaacccgttttaaaacggggggtaacggggttaaaacccgggtttaacccggtaaaacccgggtaaccgtttaccggggggttaccgtaccgggttaccggttaacccccgg

SEQ ID NO: 216665 - DNA, 668 bp, Homo sapiens
  misc_feature: GYAE6OF02IYR3Y.1.34.D01.1.454.CMB.1.raw
  modified_base (143)..(143): a, c, t, g, unknown or other
  misc_feature (143)..(143): n is a, c, g, or t
  modified_base (303)..(303): a, c, t, g, unknown or other
  misc_feature (303)..(303): n is a, c, g, or t
  modified_base (407)..(407): a, c, t, g, unknown or other
  misc_feature (407)..(407): n is a, c, g, or t
  modified_base (452)..(452): a, c, t, g, unknown or other
  misc_feature (452)..(452): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccngctgtgacatcctaattgacccagttctccattcctccctgtctgcagtctattggagacagagtcaccatccacttcggccgggcgagtcaggccatcagcgtattcttagcctggttgcacgtcaacgaacgaggggcacgtcccctagagactcgtnttactagttggcgaccacgttccgagtagttcggacgtaaacggggttcgggtacccagtaccggtacggttcaagggttcggacctgttcgactagttaccgngggaacctagtaactaacgtactaccgtactaacttagccgtaanccaggtccctaggtcctaaggtcccgttaagtaacgttcgttttagaacctttaattttacttacgtgttaaaccaagtacgttttaacttaccgttaaccgtaaccccggttacgtttacgggaccgtttaccggggaacccggaaggggttaaccggtacgggtaagggtaaccgttaaccgaaccgtttacggaggttcgaccgtgtaaaccg

SEQ ID NO: 216666 - DNA, 707 bp, Homo sapiens
  misc_feature: GYAE6OF02IPANK.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcgccgggcgagtcgaggccatcagcgtattcttagccgtggttgcagcgaagaaaccgagggccgacgtcccctacgaggtacgtcggtacgtcctagtgggtgcagtaccagtattgacgagggtcggtacccagtccgaggttcgaggtcggacgtaggtcgacgtacgtcggtaagggtactaagtaactttaaccaaccgtttcctaacctaacgttaacgtccgaacggtaccgaacgtacccgttaggaccgtaacggtacccgttaaggtaaacgtttacgttttacgaacgttttaaactttttaacgtttaacctacgtttaaacaacgtttaagtttaaaccttaacggttaaacccgtttaccccgttaagggttacgggttaacccgggttaccggggaccggtaaacccgggggtaccgtaaaggggtacggtaaacgtacccgaaacgggtacctaggggtaccgtcgtacgtacccg

SEQ ID NO: 216667 - DNA, 731 bp, Homo sapiens
  misc_feature: GYAE6OF02GZ53Q.1.34.D01.1.454.CMB.1.raw
  modified_base (102)..(102): a, c, t, g, unknown or other
  misc_feature (102)..(102): n is a, c, g, or t
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (289)..(289): a, c, t, g, unknown or other
  misc_feature (289)..(289): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccgaggtaccagctgtgacatccaattgacccagtcctccatcctcctgtctgcatctagtgagacagntacacctatcacgttggaccgggngagtccgaggcctancagcgtatttcctttagccttggttcacgacgtcgaaggtaaaacccgngggaccgtaccgcccctagaaggtaacttcggttagtaccgttaagttgggtacgacctaattacccgagggttaacttacgggaccgtaaacgggggttccgggttaccccaagttcccggtaaggtttccgaaggttacggaccgaggttcgtactaacggtccggtagggaactacggtaacttaccgactttaccacgtaaactctacgaacgttccaacgtcctacggacgtagtaaccgtagtaaacgttttcgtttacgaactttaaaggttttacttacgtacgttaacctaaagttacgtttaaaagttaccgtttaaacccgtacccgttaaggttccgggtaacggtttaccccggacgggtaaacccgggtaacgtaaagggtccggtaaaccgtaccggaaactacggttaggtcgtccgtagaacccg

SEQ ID NO: 216668 - DNA, 750 bp, Homo sapiens
  misc_feature: GYAE6OF02HITE8.1.34.D01.1.454.CMB.1.raw
  modified_base (102)..(102): a, c, t, g, unknown or other
  misc_feature (102)..(102): n is a, c, g, or t
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattcgaccctagtctccactccctccctgtctgcatctattgganacagatcaaccatctacttggccgggngacggtcaggccatcgacgtcgtattcttacggccgtggttcgcgtagcaacggaaaccgaggggaccgacgccccctagacgtacgttccggtacgttctagtcgggttcgacgtactcccgaaggtactttacgggaccggtaaacggggttccggggtacccctacgtttaccggtaacgggttcggtaacggtcgggactacgggtacgaccgtaggttccgggacgggttaacgaacggtttacttaaccctaccgtttaccgtaacctaaacgttactacggtacggtacctaacggtcccgttacgacccgttacgtacccgtaaggtaaagtttattttaaccgggtaactttaaacgtttttaacgttaccgttacgtaacctaacggtttaactttacgttaaacgttaacccgttaacccggttacggtacggtaaccggttccggaacggtaccggtaacggtaagggtacgaacgtaccgaaccgtaacgtgggacgtcgtacgtaccg

SEQ ID NO: 216669 - DNA, 574 bp, Homo sapiens
  misc_feature: GYAE6OF02F2V29.1.34.D01.1.454.CMB.1.raw
  modified_base (269)..(269): a, c, t, g, unknown or other
  misc_feature (269)..(269): n is a, c, g, or t
  modified_base (357)..(357): a, c, t, g, unknown or other
  misc_feature (357)..(357): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcagtcaggccatcagcgattctttagcctggttcgcagcagaaaccngggcgacgcccctcgagatcggtagtctagtggtgcatccagtattgcgaagggttcgggtcccagtccgaggttcaggtcggcagtnactatcgtagggacagtacttacgactctactatactcagcacgcctgacncnctagtaagtattttgaacttaatttacttacgtagtaacaacgttagtttaacttacgtaaccggttaccctagggttacggttaccggttacgggaccggtaacgggtaactaacgggttagaacgttaccgaacggtaagtcgtagggtcctacgtaacccg

SEQ ID NO: 216670 - DNA, 458 bp, Homo sapiens
  misc_feature: GYAE6OF02F05U2.1.34.D01.1.454.CMB.1.raw
  modified_base (373)..(373): a, c, t, g, unknown or other
  misc_feature (373)..(373): n is a, c, g, or t
  modified_base (420)..(458): a, c, t, g, unknown or other
  misc_feature (420)..(458): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatccagcagccctgcagcctagaagtattttgactaatttattactgtcaactagtattatacgtacccctagtggacgttcggccgaagggggaccaagggtgaacggtacaaaccggactggtgctgcaccatctgtcttcacttccttcccgctatcctacgaacnctactcgtctggacggcgggctcgggacgaacggccgacgatggacnnnnnnnnnnnnnnnnnnnnnnnnnnnnnnnnnnnnnnn

SEQ ID NO: 216671 - DNA, 791 bp, Homo sapiens
  misc_feature: GYAE6OF02HRANR.1.34.D01.1.454.CMB.1.raw
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccatccctcctgtctgcatctagttggagacagagtccaccatccacttcggccgggcgagtcgacggccacgtcgagcgtaatttcgtttacgccgttggttcgcgtacggacgaaacggaaaaccggngggtaccgaaccgccccgtacgaagacgttacgtactcttagtcggtacgacctacgtccgtaagtagttacggtacggtaaaggggttccgggtaccctacgtccgtaggttacgacggtacgggtacgtaggtacgcgtaacgttcggtacggggaactaaggtaacttaaccgtaccttaccgttacgtaaccgttacgtaccgacggaccgtacgtaccgtacggaaccgtacgtaccgttaagtaaaacgttttgtttaaccgtaagttttaaacttttaacgttttaccgtaacgttaacttaaaacgttaagttttaacgttaaaccgtttaacccggtttaaccccgtacgggtttacccgggttacccgggtttacccgggaaccgggtaaaccggggtaccggtaaagggttaccgggtaaaaccggtacccgtaaacccgggtacggttacggggtaacggtcccggtacgtaacccg

SEQ ID NO: 216672 - DNA, 764 bp, Homo sapiens
  misc_feature: GYAE6OF02J0BD6.1.34.D01.1.454.CMB.1.raw
  modified_base (203)..(203): a, c, t, g, unknown or other
  misc_feature (203)..(203): n is a, c, g, or t
tcagacgagtgcgtcacgaccggtgctcgatttagatcgtctgtgttggggttgggggagtcagaccctgtcaggacacagcatggacatgagggtcccgctcagctcctggggctccgtgctgctctggctcccacggtaccagctgtgaccatccaattcgacccagtctccatccctcctgtctgcattctagttggganacgagacgtccacctatcctacgtcggccgggcgacgtcgaggacctagtcctaggcgtatttccgtttagccgtggttcgccgagtaccaaggaacccgacgggccgacgcccctagtacgtacgtcgtacgtcgtagtgggtagctacgttacccgagttacgttacggcggtaacggggtaccggggtccctacggttaccggtacggtttacgaagggttcgggacgttacggtcgtactacgtccggtacgggactacggacttacccgcttcgtacctactacgtacgtagctacgtccgtagtaccgtacgtaccgttaggtaacttagttttacgtaacgttttaacgtttacgtttaaccgttaacgtaccgttaaaccggtttaagttaaaccgtttaaccggttaaccggtttaacccgtttacgggttaccgggtaccggggttttaacccggacggggtaaacccgggtaactaaccgggttacgtaccgggtaaccttaacggtaacccgttaaaccggtacggtttacccgggttacggtaacccg

SEQ ID NO: 216673 - DNA, 525 bp, Homo sapiens
  misc_feature: GYAE6OF02FHHU8.1.34.D01.1.454.CMB.1.raw
  modified_base (375)..(375): a, c, t, g, unknown or other
  misc_feature (375)..(375): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagccttggttgcagcagaaaccaggggcgagcccctcagatcgtagtctatggtgcatccagattgcaagggtggggtcccatccaggttcagtggcagtgcatcgtgggacagattacactctcactatcagcacgcctgcagccctgaagtntttgactaattttattactgtacaactagtattactacgtaccctagtggtaccgttcggacccgagggacctaagggtgaacgtacaccgtaactggtaggctcggacctaccattccgtcgttaccttcacttccttacccctacccc

SEQ ID NO: 216674 - DNA, 591 bp, Homo sapiens
  misc_feature: GYAE6OF02II6A7.1.34.D01.1.454.CMB.1.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgtattctttagcctggttncagcagaaaccngggcagcccctnagatcgtagtctatggtncatccagtattcgacgagggtcggtcccattccaggttcaggtggctgtcntatcgtgggaacagtaggttacncttctacactatcagacacgccgtgaccgtagaccctagtaagtacttttagactttaatttacttaacgttgtacctaatagtttaaattacgtaaacccgttaccccttaacgggttcgggttaacccggtttccgggaccgggtaaccggggtaaccgtaaagggttcgggaaacgtcccgaaaccggtacgttaggtcggtaccgtcgtaacccg

SEQ ID NO: 216675 - DNA, 795 bp, Homo sapiens
  misc_feature: GYAE6OF02IJAII.1.34.D01.1.454.CMB.1.raw
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattgganacagacgtcaccattccacttggccggggacaggtcacgggccagtcagcgtattctttagctggttancagcagaaaccagggcgaacgcccctacagtactcgtagtctagtcggtgacctattccgaaggtaatttcggaacggtaaacggggtcggggtacccctaagtacccgaagggtttaccaacgggtcgggtacctaaggggttcgacgttaacgttacccggtacgggggtaaacctaacggttaaaccgtttaccgtaaaccctttccgttaaccccgttaaaccgttaagttacccgaaacggtaccgttaaacggccccgtttaaggacccgtaaccgtacccgttaaggaaaaccgttttatttttacgggtaacctttaaaacgtttttaacgtttaaccgttaacgtttaaccttaaacgttaacgtttaaagttaacgttaacccggttaacccgttacggtacgggttaacccggttttccgggaacccgggttaacgggtaaccggtaaacgggtttaacggtaacggttacccgtaaaccggaacgttacgggttaccggtacgttaccgtaacccg

SEQ ID NO: 216676 - DNA, 630 bp, Homo sapiens
  misc_feature: GYAE6OF02FYXQJ.1.34.D01.1.454.CMB.1.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattgganacagatcaccatcacttgccggngagtcaggccatcagcgattcttagcctggtncagcagaaacngggcgacgcccctnagatccgtagtctagtgtgcatccagtattgacgaacgggtcgggtcccaagtcccgtaggtttccgaaggtcggacaaggttgactaagttcggtaggggaactaggtaactttaaccgaccttactacgtaactactacgaacgcacggccttgactagccctagaagttagttttcgactttaaatttacgttacttcgtaacaaacgttagttaaacttacgtaaccgttaaccccgtaggttacggtaacccggttaccggaaccggtaacggggaaaccgtaacggggttacggaaacgttaccgtaaaacccgggtagtttacgggcggtacgtaccgtaacccg

SEQ ID NO: 216677 - DNA, 862 bp, Homo sapiens
  misc_feature: GYAE6OF02FVI87.1.34.D01.1.454.CMB.1.raw
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
tcagacgagtgcgtcacgaccggtgctcgattagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcattctattggagacaggagtccaccatcacttggccgggcgagtcaggccatcagcgtatttctttagccttggttgcagcaagaaaccgngggcgacgcccctcagactcgtagtctagtggtncatccgagagttgacgtaacgggtcggggtaccccagttacccgtagggttaccgtaggtacggaccgtaaggtaggtaaacgttccggtaagggggtaacctaacggtaacgttttaacccgaaacctttcccgttaacctaaacgttaacttacgaaccggtacgaaccgtccccgtagaccggtaaccgaccgtttaaggaaacgttttacgtttttaccggaaacctttaaacgttttttaacgttaaccgtttaacgtaaaccgttaaaaacccgttagggttttaaaaccttttaaacgtttaccccggggttaaaacccccgtttaacgggggttttaacccggggttaacccggggtttttaacccggggggaacccccggggttaaaacggggggggtaaaacccccgggtttaaaacggggggttaacccggggtaaaacccgggtttaaacccccgggtaaaaacccggggttaacccgggttttaaccggggttaaaccggggttacccgttaccgggtaaaccccgttaaaccccggg

SEQ ID NO: 216678 - DNA, 812 bp, Homo sapiens
  misc_feature: GYAE6OF02HG5AY.1.34.D01.1.454.CMB.1.raw
  modified_base (130)..(130): a, c, t, g, unknown or other
  misc_feature (130)..(130): n is a, c, g, or t
tcagacgagtgcgtcacgaccggtgctcgattttagatcgtctgtgttggggtttagggggagtcagaccctgtcaggacacagcatggacatgagggtccccgctcagctcctggggctcctgctgctntggctccgaggtaccagctgtgacatccaaattgacccagtcctccatcctccctgttctgccatctattggagacgagacgtacaaccatacaccttcggcccgggacgacgtcaacggaccaattcacgtcgtaactttacctttaagtccgttagggttcaccgacgtacgaaacggaaacccgaggggcccgacgtaccccctcgaaggtacgttacgttagtcgttagtcgggtcgtacctaacgtaccgaaggtagttcgaacgtaaggggtccgggttacccaagtccgggttaggtactagggtcggagtaacggtactaccgtaagtccggtacgggtaaccgtaagtaactttaaccgacgttacctaccgtaacgtactaccgacggtacctaacggtaccgttacggttaccgtacgttacccgttaaggaacgtttacgttttacgaaaccgttttaacgttttaacttaaccgtttacgtaaacccgttaagttaacggtttaaacgttaaccgttaaacccgttaacccggtttaccgggtaccgttacggggtttaaccccgggaaccggtaaccgggggtaacccggttaaacgggtacgggtaaaacccgtaccggtaaacccggtaccgtttagggttacccgggttccttacccggtacccg

SEQ ID NO: 216679 - DNA, 620 bp, Homo sapiens
  misc_feature: GYAE6OF02HTFZ8.1.34.D01.1.454.CMB.1.raw
  modified_base (319)..(319): a, c, t, g, unknown or other
  misc_feature (319)..(319): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaaccatcacttcggccgggcgagtcaggccatcagcgatttcttagccgtggttcgcagacaagaaaccgaggggaccgacgcccctagagtacgtacgtacgtctagtggtancatccgagtacttggacgtaagggtcgggtaccctagtccgtaggttcgaggtcggactagtcgactagtcggtagggactagtacttactactactactactatacacgacacgctagctacgaccttagaacgttattttacgactttaatttacttacgtacgtaactaagtaagtttaacttacgttaaccgttacccgttacggttacggttaaccggttaccgggaccggtaacggggaacggtaaacggttaggaacgtaccgaaccggtacgttaggtacggtcgtacaaccg

SEQ ID NO: 216680 - DNA, 569 bp, Homo sapiens
  misc_feature: GYAE6OF02FV0VI.1.34.D01.1.454.CMB.1.raw
  modified_base (257)..(257): a, c, t, g, unknown or other
  misc_feature (257)..(257): n is a, c, g, or t
  modified_base (391)..(391): a, c, t, g, unknown or other
  misc_feature (391)..(391): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagtattgacgtaagggtcggggtacccattcccgagggttcaggtggcagtcgacatcgtgggaacagtacttacacttctcactatcagcagccagcacgctagaaagtntttgacttaatttattactgtactaactagtaatttacgtaccgttacccgtaggtcggtacgttaccggaccgaggggtaacctaagggtaggaacgtaccaaccggtaactggtacggtacgtaccggacctactacgttcgttcgttacctttcgaccttcccgtccccgtcccc

SEQ ID NO: 216681 - DNA, 661 bp, Homo sapiens
  misc_feature: GYAE6OF02GL7UW.1.34.D01.1.454.CMB.1.raw
  modified_base (225)..(225): a, c, t, g, unknown or other
  misc_feature (225)..(225): n is a, c, g, or t
  modified_base (295)..(295): a, c, t, g, unknown or other
  misc_feature (295)..(295): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacataccaattgacccagtctccatcctcctgtctgctatctattggagacgagagtcaccatcacttggccgggngagtccacggccatcgagcgtattctttagccttggttcgcagcaacgaaaccgagggacgacgcccctnagtagtcgtagtctagtggtgactacgtccgagtattcggacgtaacggggtccgggtacccagttcccggtaaggtttcgaggttcggactagtacgctacgtcgtagggactagtacttacactactactactactacgaacgcaacgccgtagactacggtcctaaggtaagttagtttagtaactttaatttacgtttacgtagttactaaacgttagttaacttaaaccgttaccgttaacccttagggttacggttaccggtttacgggaaccggttacggggaaccgttaacggggtacggttaaaccggtaacccggtaaaccggttaccgtgggttccgggtaccttggtaaccccg

SEQ ID NO: 216682 - DNA, 779 bp, Homo sapiens
  misc_feature: GYAE6OF02FJ7LU.1.34.D01.1.454.CMB.1.raw
  modified_base (247)..(247): a, c, t, g, unknown or other
  misc_feature (247)..(247): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggcctcccgaggtaccagctgtgacactccaattcgaccctagtcctccacttcccgtccctgttcctgcctatactagttggagacagtacgtccaccatccacgttcggcccggggntacgtcgacggccatcagcgtattcttagccgttggtcgacacgacaaacggaaaccggcgggtaccgaaccgcccctacgaaggtacgtcggttacgtacgtagtggtcgactactccgagtacttaggaccggtaacggggttccgggtaccctacggtacgtacggtttacgagggtcgacgtaacggtgtaccgagttcgtacgggaactacggttacttaaccgtaccttaacgtactaaccgttacgtaccgtacgaaccgtacgtcccggtacgtccgaacgttaccgtaggtaaacggttttacttttaaccggtaactttaaacgttttacgttacgttaacgtaacgtaaccccctttaaaggtttaactttaaacccgttacccggtttaaccccgttagggttaccggtacccgggttaccgggaaccggggtaacggggttaaaccgtaaggggtttaaccgtaaccgggtaacccgtacccggtaagttccgggtacggttacccgtcggtaaacccg

SEQ ID NO: 216683 - DNA, 815 bp, Homo sapiens
  misc_feature: GYAE6OF02FK5DS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtccaccatcacttggccgggcgagtcaggccatcagcgattcctttagcctggttgctagcacgaaaccgagggcgacgcccctagagacgtcgtagtctagttggtcgactactaccaggtatttggacgaaggggttcggggtaccctagtcccgaggtttaccgagggttacggcgaaggttcgactacgtacgtacggggacctaaggttaactttaaccgtaccttactaccgtaaccgttaacttaccgaacggtccaaccggtcccgttacggacccggtaaccggtccccgttaagggtaaacggtttaacggtttttttacgaacccgttttaaaagttttttaaaccgttttaaccgttacggtttaaacccttaaaaccgttaacgggttttaaacttttaaacgttaacccgggtttaacccccttaacggggtttaccgggttaacccggggtttaccccgggaaccccgggttaaaccggggggtaaacccccgggttaaaaggggttacggggttaaaaccgggttaccgttaaaccccgggtaaaaaccgggttaaccggtttaccgggggttacccgggtaccgttaacccggg

SEQ ID NO: 216684 - DNA, 606 bp, Homo sapiens
  misc_feature: GYAE6OF02HOZ6I.1.34.D01.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctatgganacagatcacatcacttggccgggnagtcaggcatcagcgtattcttagctggtncagcagaaaccnggacgacgcccnagatcgtagtctagtggtcgcatccagtattggacgtagggtcgggtacccagtccgaggttcaggtcggacgtaggtgacgtacgtcggtacggggacagtattaccgactctacactancgtacgcacgtcctgacctacgacgtaggtaaagttcgttttcgaattaacgtttattacgtcgtaactaacgtatttaacgttaactaacccgttacccggtaacgttcgggttaccggttaccggaacgggtaccggggtaacggtaaccggtagggtaacctaacccggtaaacccggtacgttaccgggtgtaccggtgtaacccg

SEQ ID NO: 216685 - DNA, 388 bp, Homo sapiens
  misc_feature: GYAE6OF02JE33A.1.34.D01.1.454.CMB.1.raw
  modified_base (380)..(388): a, c, t, g, unknown or other
  misc_feature (380)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtatttgctaatttattactgtcaactagtattatacgtacccctagtggacgttcggccaggggaccaaggtggaatcaaccgatgtgctgcaccatctgtcttcatcttcccgcatctgaacgcacgtcgctgacgcggctggcaaggcgcatgnnnnnnnnn

SEQ ID NO: 216686 - DNA, 637 bp, Homo sapiens
  misc_feature: GYAE6OF02G8X2N.1.34.D01.1.454.CMB.1.raw
  modified_base (200)..(200): a, c, t, g, unknown or other
  misc_feature (200)..(200): n is a, c, g, or t
  modified_base (317)..(317): a, c, t, g, unknown or other
  misc_feature (317)..(317): n is a, c, g, or t
  modified_base (430)..(430): a, c, t, g, unknown or other
  misc_feature (430)..(430): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctagttgganacagagtcaccatcacgttcggccgggcagtcaggccatcagcgtattcgttagccttggttgcagcaacgaaaccgagggaccgacgccccagagacgtacgtagtctagtggtcncactccgaagtcttggacgtaggggtcggtacccacgtccgaggttcgaggtcggacgtaggtcgactaacgtcggtagggtactagtaacttacctacttactacaacttancgacggcacgtccgtagctaccgacgtagtaagttactttacgaactttaaagttttacgttactacgtaacctaagttattaagttaactaaccgttacccgtaaggttcgggtaacccgtttccgggaacggtaacgggtaccgtaaagggtacggtaaaccgtaccggtaaccgtacggtacgggtacgtacgtaccgtaaccg

SEQ ID NO: 216687 - DNA, 688 bp, Homo sapiens
  misc_feature: GYAE6OF02JF624.1.34.D01.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (265)..(265): a, c, t, g, unknown or other
  misc_feature (265)..(265): n is a, c, g, or t
  modified_base (337)..(337): a, c, t, g, unknown or other
  misc_feature (337)..(337): n is a, c, g, or t
  modified_base (438)..(438): a, c, t, g, unknown or other
  misc_feature (438)..(438): n is a, c, g, or t
  modified_base (464)..(464): a, c, t, g, unknown or other
  misc_feature (464)..(464): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtcctccatccctccctgtctgctatctattgganacagngtcaccatcacttggccgggtcagtcacggccatcacgcgtattcctttagccttggttcncaagcgaagaaaccgaggggcaaccggtcccctcgaacgtaacgtccgtacggttacctaagttcggggtcncgaacttccgaagtatttcggacgttaaagggtcgggttacccacgtccgtaaggtttcgagttcggcagtctaccgagtcgtaggaacgtagacttaacnctttaccacgtaactactcgaacgtnaccgtcgtacgactacgtaccgtagtaacgttagttttacgactttaaacgttttcttaacgtcttaacaacgtttattaaacttaccgttaaccgtccccgttaacggttaccgggaaccgtttcccggggaccggttaaacgggtacccggtaaagggtttaaccgacgggttaaacccaaaccggggttacccgtaagggtcgtacggttaccgtaacccg

SEQ ID NO: 216688 - DNA, 708 bp, Homo sapiens
  misc_feature: GYAE6OF02IZZPH.1.34.D01.1.454.CMB.1.raw
  modified_base (201)..(201): a, c, t, g, unknown or other
  misc_feature (201)..(201): n is a, c, g, or t
tcagacgagtgcgtcacgaccggtgctcgatttagatcgtctgtgttggggtttgggggagtcagaccctgtcaggacacagcatggacatgacgggtccccgctcagctcctggggctcctgctgctctggctcccaggtaccagctgtgacatccaattgacccagtcctccatccctcctgtcctgcatctattgganacagagtcacctatccacttgaccggggcaggtcagggcctatcgagcgacttcttagccttggttgctagcaagaacccgagggccgacgcccctagacgtatccggtagtcgtagtcggtcgactagtcccagtattaggacgtaaggggtcgggtacccagtcccgaggttcaggtggcgagtgcgtagtcgtacggggactacgtactttaccgacttactacccgtaacttagtaccgaacggtacccgtaaaggtaccccgttaggtactaacccggcccgtttaaggtaaacgttttaaccgttttacggaaaccttttaaacgttttaactttaacccggtagttaaccctaaacggttaacgttaacgtttaaaccgtaaccggtttaaccccgttaacgggttacggtacccggtttaccgggaaccggtaacgggtaccgtaagggtacggtaaccgttaccggaaccggtaaccgttcgggtacgcgtacgtacc

SEQ ID NO: 216689 - DNA, 551 bp, Homo sapiens
  misc_feature: GYAE6OF02IJM9W.1.34.D01.1.454.CMB.1.raw
  modified_base (102)..(102): a, c, t, g, unknown or other
  misc_feature (102)..(102): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
  modified_base (409)..(409): a, c, t, g, unknown or other
  misc_feature (409)..(409): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtccagctgtgacatccaattcggacccagtcctccatcctccctgtctgcatctagtgganacagntcaccattcagttgccgggacagtcaggctatcagcgatttcttagccttggtgcaagcaacgaaacnggcgtacgcccctnagatcgtagtctatggnactntcagtatgacaggtggtcccatccaggttcaggcggacnggtgctaagtcctagggacaggtactctaactccttacgatattcaagcacgtccaggaccanaccgttgaaattcctttcgatttaaacttttnacgttctanaacgtagtattacacgtaccctaggtggtaccttaccggcggaacgggaccggtaagtaccgggtaatcccaaaacggtccgtaagtcggcgttcacccgg

SEQ ID NO: 216690 - DNA, 583 bp, Homo sapiens
  misc_feature: GYAE6OF02HMOUX.1.34.D01.1.454.CMB.1.raw
  modified_base (440)..(440): a, c, t, g, unknown or other
  misc_feature (440)..(440): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttggccgggcgagtcaggccatcagcgattctttagcctggttgcagcaagaaaccgagggacgacgcccctcagactcgtagtctagtggtgcatccagtagttggacgtaagggtcgggtacccacgtaccgaggttcgagtcggactagtgcagttcgtaggggaactagtacttaccacgtctacactactcgacgctacgcctgactacgtcctaggaagttnttttacgaacttaattttatactgtactaacgttattattaactaacgtacccgtaggttacggtacgtttccggacggtacggggaaccgtaaggtacggtaacgtaccgtaacggacgttcggtacggtacctcgtaaccg

SEQ ID NO: 216691 - DNA, 646 bp, Homo sapiens
  misc_feature: GYAE6OF02IH9CH.1.34.D01.1.454.CMB.1.raw
  modified_base (276)..(276): a, c, t, g, unknown or other
  misc_feature (276)..(276): n is a, c, g, or t
  modified_base (322)..(322): a, c, t, g, unknown or other
  misc_feature (322)..(322): n is a, c, g, or t
  modified_base (370)..(370): a, c, t, g, unknown or other
  misc_feature (370)..(370): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatcctccctgtctgcatctattggagacagaagtcaccatcacttggccgggcgagtcacggcactcagcgtatttctttagcctggttgcagcaagaaaccgngggcctacgcccctacagtactcgtagtctatggtgcatccgagtnttacgacgaacgggtcggtcccagtccgaggttcaggtggactaggtncgtagtcgtagggactaggtacttcgacttctaccactatcacgaccagtcctgacgtacgtccgtaagttaagttactttttacggaactttaaatttttaccttaacgtcgttaactaacttacgtttaaacttaacgttaaccgtttaaccccgttagggttaccgggttaccggttccggaaccggtaaccgggggtaaccgtaacggggtttacggaaaccggttacccgtaaacccggtaacgttcgggtacgggcccttacggtaaccc

SEQ ID NO: 216692 - DNA, 735 bp, Homo sapiens
  misc_feature: GYAE6OF02IFQXH.1.34.D01.1.454.CMB.1.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (363)..(363): a, c, t, g, unknown or other
  misc_feature (363)..(363): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcagtcaggccatcagcgattctttagctggttcgcagcagaaccagggcacgcccctanagatacgtagtctagtggtnacatccgagtattgacgaagggttcgggtaccctagtccgacggttcaggtggacgtaggtcncgtacgtacgtaggggaactaaggtacgtttaacctaccttaccgtaccgtaaccttagttaccgaacggtaccacggttacctacggaccctaacggtacccgttaggtaaaacgtttactttttaacggaaccttttaaagtttttaaccctttaaccgttaacggttaaccttaaacgttaacgttttaaacctttaaccggttaaaacccgtttaaccccccggtttaacgtttaccggggttaacccggtttcccggggtaacccgggtaaccgggggtaaacccggtaaggggttaaccgggtaaaaccggttacccgtaaacccgggttaaacgttgggttaaccgggccgttaccgtaacccgg

SEQ ID NO: 216693 - DNA, 485 bp, Homo sapiens
  misc_feature: GYAE6OF02IWQT8.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccagttcagtggcagtgcatctgggacagattacactctcactatcagcagcctgcagcctgaagattttgcaatttattactgtcaacagtattatagtaccctacgtggacgtgcagggaacgaacggtaggaagtacaaccgaactagtaggcgtgc

SEQ ID NO: 216694 - DNA, 658 bp, Homo sapiens
  misc_feature: GYAE6OF02IUM79.1.34.D01.1.454.CMB.1.raw
  modified_base (186)..(186): a, c, t, g, unknown or other
  misc_feature (186)..(186): n is a, c, g, or t
  modified_base (199)..(199): a, c, t, g, unknown or other
  misc_feature (199)..(199): n is a, c, g, or t
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctccccaggtaccagctgtgacatccaattgacccagtctccatccctccctgtcngcatctattgganacagatcaccatcacgttggccgggcgagtcaggccatcgagcgtatttcttagcctggttgcagcaagaaaccgngggcgacgcccctgagatcgtagtctagtggtncatccagtatggacgaggggtcgggtcccaagtccgtaggttcaggtcgacgtaggtcgacgtacgtcggtagggactaacggtattaaccacttctacgtactatcagccacgtcgtcgacgacgtcccgtaagtaacgttactttcgttaacgttaactttttaacgttaacgtacgttaacctaaacgttaacgtttaacgttaaacgttaacccgttaaccccgttaagggttaccggtaaccgggtttccggggaaccggtaaaccgggggtaaccgtaagggtacgggtaaaccgttaacccgaacggttaaccgttagggttaccgaccgttccggtaacccg

SEQ ID NO: 216695 - DNA, 862 bp, Homo sapiens
  misc_feature: GYAE6OF02JDYYI.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgctatctattggagacagagtcaccatcgacttggccgggcgagtcacggtccatcgacggcgtattttccgtttacggccgttagggttcgacctaacggaccaaacggaaaacccggacgggggtaccgaacccggtccccctacgaaggaccgttcggttaacgtcttaggttcgggttcgacgtaatcccgaaagtcgttacggtacggtaaacgggggttccgggtacccgaactttccggtaacgggtttcgaacgggttacgggtctagggtacgtaccgtagttacccggtaacgggggaacctaaagggtttaaccttaaaccgtaacccgttactacccggttaaaccttacgtaaccgtaacgtcccgtaacgtacccgttacgaaccggcgttacccgtttaagggaaacgttttaccgttttaaggtaacctttaaactttttacggttttaaccgtaccggtttaaacttaaacgttaagttttaaaccgtttaaccgtttaaacccgggttaaccccgtttacggttacggggtttaaacccgggttccgggtaaacccgggtaacgggggttaaacccgttaacgggggtaaaccgttaaccggttaaccgggaaaacccgtttacggttaaccgggttcgggtacccgtacggttaacccg

SEQ ID NO: 216696 - DNA, 687 bp, Homo sapiens
  misc_feature: GYAE6OF02G147D.1.34.D01.1.454.CMB.1.raw
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcagaaaccgngggcgacgcccctnagatcgtagtctatggtgcatccgagtattggcgtaagggtcggggtaccctagtcccgaggttcaggtcggcagtcgacacgtcgtagggactaagtacttaaccacttcctacctaacttactaccgaacgtaccgaacggtcccttacggaccgtacggtcccttaagggtaaagttacgttttacgaccgttaaattttacgtttacgtacgttaacctaaacttagtttaaactttaacgttaaccggttaaccccttaacgggttacgggtaaccggtttcgggacccgtaaacggggggtaacccgttaaacggggtaacgggtaaaaccggtaaaccgtacgttacggtacggtaccgtcggacctaaccgtacttccgttacgttaccttcgtaccgtttcccgttacccgacgtaccg

SEQ ID NO: 216697 - DNA, 430 bp, Homo sapiens
  misc_feature: GYAE6OF02F2TRC.1.34.D01.1.454.CMB.1.raw
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (395)..(395): a, c, t, g, unknown or other
  misc_feature (395)..(395): n is a, c, g, or t
  modified_base (402)..(406): a, c, t, g, unknown or other
  misc_feature (402)..(406): n is a, c, g, or t
  modified_base (408)..(430): a, c, t, g, unknown or other
  misc_feature (408)..(430): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagtattacactctcactatcagcagcctgcagcctagaagtattttgactaattttattactgtacaactagtatttactacgtacccctagtggacgttcggccgaggggaccaaggtgaacgtcaaccgacgtgtcggctgacacctntctgtcctcatcctccgcntcngacnctactcgtctgacgtcggctagggacagggcntagtagnnnnntnnnnnnnnnnnnnnnnnnnnnnn

SEQ ID NO: 216698 - DNA, 555 bp, Homo sapiens
  misc_feature: GYAE6OF02F0FPG.1.34.D01.1.454.CMB.1.raw
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (314)..(314): a, c, t, g, unknown or other
  misc_feature (314)..(314): n is a, c, g, or t
  modified_base (429)..(429): a, c, t, g, unknown or other
  misc_feature (429)..(429): n is a, c, g, or t
  modified_base (453)..(453): a, c, t, g, unknown or other
  misc_feature (453)..(453): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaaccatcacttgccgggnagtcaggccatcagcgattcttagcctggttgcagcagaaaccngggacgacgcccctnagtatcgtagtctatggtcncgtatccaagtnttagcgaagggtcgggtacccatccgagttcaggtgacgagtgctagtcgtcgggaacagtacttaacacttccactactatcagcacgtccctaggcacgtcgtagtaaacgtnttttaggactaagtttacttactntaactaactagttaacttagtactaacccctagtacgtacgtcggaaccgacgggtaacgtaaggtacggtaagtccaaacgtaccgtaggtcggactgacc

SEQ ID NO: 216699 - DNA, 848 bp, Homo sapiens
  misc_feature: GYAE6OF02FHYCX.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtccaccatcacttggccgggcgagtcaggcccatcgagcgtattaccgtttagccgttggttcgcacgtacgaacgaaacccgacggggccaacggccccctagacgacttcggttagttctaagttggtacgactactacccgaagtactttacggacgtaacggggttccggggtaccccacgttacccggtacgggtttacgacgggttcggacctaagggttacggtccctaacggttccggttaacgggggtaaccctaagggtaacctttaacccgaacccgtttcccttaacccgtaaacctttaacgtaccgaacggtaccctaaccgggttcccgtacggttaccgaacccgggtaccttaacgggtaaacgttttaacgttttttaaccggtaacttttaaaaccgtttttagttaaacccgtttacggttaaacccttaaaacggtttaagttaaccttttaaaaccgttacccggtttaaacccccgtttaacgggttacggttaacccgggtttaccgggaaccccgggtaacggggggtaaaccccgttaaaggggggttaaccgtaaaacccgggttaccgaaacccgggttaaccggttacgggtacggttacccgtacggtaaccccg

SEQ ID NO: 216700 - DNA, 643 bp, Homo sapiens
  misc_feature: GYAE6OF02JB6S9.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtcctccatcctccctgtctgcatctattgganacagagtcaccatcacttgccgggcagtcaggccatcgagcgtactttctttagccttggtttgcacgtcaaggaaacccgagggccgtacgcccctacgacgtacgtccgtagttaccttagtcgggttgactacgtcccaaggtgttacgacgaaacgggttcggggtccccagtcccgaggtttcaggtcggccagtacgcctagttcgtacgggaactaggtacttaccgacgttctactactatcagtccacgtcctgtacacgtccgtagtacgttagtttacgtattaacttttacgtacgttcgtaactaacgtagtttaacttaacgttaaccgttaccccttaggtacggttaccggtaccgggtaaccgtaacgggaccgtaacgggttacggtaacgtaaccgaccgtaaagtggtacggtacgtcgtaacccg

SEQ ID NO: 216701 - DNA, 588 bp, Homo sapiens
  misc_feature: GYAE6OF02IF2S4.1.34.D01.1.454.CMB.1.raw
  modified_base (196)..(196): a, c, t, g, unknown or other
  misc_feature (196)..(196): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacttgccggcgagtcaggccatcagcgtattctttagcctggttgcagcaagaaaccgngggcgacgcccctnagactcgtagtctatggtancatccagtattggcgtaagggtcgggtcccatccgtaggttcaggtcgcgagtgctagtcgtagggacagtacttacactctacactatcacgcacgtcctgaccacgtcctagaacttagtttacgactttaaattttatacctacgttaacaacgttagttaacttacgttaaccgttaccccgtaggttaccggtaccggtttccggaacccggtaagggtaaccgtaagggtcggtaaagtaccgaaaccggtacgttagggtacggtacgtcgtaacccg

SEQ ID NO: 216702 - DNA, 466 bp, Homo sapiens
  misc_feature: GYAE6OF02HQOON.1.34.D01.1.454.CMB.1.raw
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (431)..(466): a, c, t, g, unknown or other
  misc_feature (431)..(466): n is a, c, g, or t
tcagacgagtgcgtcacgaccggtgctcgatttagatcgtctgtgttgggtttggtagtcaggccatcagcgtattctttagcctggttgcagcagaaaccagggcgagcccctcagatcgtagtctatggtgacatccagattgcaaggtgggtcccatccaggttcagtggcagtgcatctggacagattacactctcactagtcagcagctncagcctagaagtnttttgctaatttatactgtacaacgagtattagtacgtacccctagtgacgttcggccgtagggaccaaggtggaagtcaaccgtaacgtgtaggctgctaccagtcctgtacttcagttcctccccgtctaagtctgaaccgtctaacttcgtactggacgtcgggcttggctaaaggccgtcaagttacgcgngngngngnnnnnnnnnnnnnnnnnnnnnnnnnnnnnnnnnnnn

SEQ ID NO: 216703 - DNA, 525 bp, Homo sapiens
  misc_feature: GYAE6OF02IU32I.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctnagatcgtagtctatggtgcatccagattgcaaggtcgggtcccatccgaggttcagtggcagtgcatcgtgggacagattacactctcactatcagcagcctgcagcctgaacgtattttgactaatttattactgtactaacgtagttaacttataacgtaccctaggtcggtacgttcggaccgtaaggggtaccctaaggtcggaacgttaccgaaccggtaacgtggtacggcttaggaccc

SEQ ID NO: 216704 - DNA, 605 bp, Homo sapiens
  misc_feature: GYAE6OF02ID2CJ.1.34.D01.1.454.CMB.1.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
  modified_base (362)..(362): a, c, t, g, unknown or other
  misc_feature (362)..(362): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttgcagcagaaaccgagggccgacgcccctnagatcgtagtctagtgtgcatccagtattggacgtaagggtcgggtccctagtccgaggtttcaggtggctagtgctatcgtggacagtactacactcacatancagacagcctagcagccgtagtaagtatttagacttaattttacttactcgttacaaacttagttaattacgtacgttaaccccttaggtcggtaaccgtttccgggaccggtaaggggtaaccgtaaagggtacggtaaacggtacccgtaaaccgttacggttcggtacgggtcctaccggtacctaaccctagtttcgttacgtttccctttaacgtccgtttacccccttcccggaacc

SEQ ID NO: 216705 - DNA, 602 bp, Homo sapiens
  misc_feature: GYAE6OF02IS10B.1.34.D01.1.454.CMB.1.raw
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtcaccatcacttggccgggcgagtcacggccatcagcgtattcttagctggttgcagcaagaaccgngggcgacgcccctnagactcgtagtctagtggtncatccagtattgacgagggtcggtacccatccgaggttcaggtcggacgtagtcgactacgtcgtagggacagtacttacgacttctacactactcgagcacgcctgacctacgtcctaggtaacgttatttcgaactttaagtttacttacgtacgttaacctaacgttaacgttaactttaacgtaaccgttaacccgtacgggttacggtaccgggtttaccggaccgggtaacggggaaccggtaagggtacggaacgttaaccaaccggtacgtggtacggcgtacgtaccg

SEQ ID NO: 216706 - DNA, 632 bp, Homo sapiens
  misc_feature: GYAE6OF02FXSU9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccggcgagtcaggccatcagcgtattctttagcctggttgcagcagaaaccagggcgagcccctcacgactcgtagctatggtgcatccagtattaggcgtaaggtcgggtacccagtcccgtaggttcaggttcggacgtagtggactagtcgtagggactaagtactttaaccgacttcctactaacttactacgtacgcgaacgtcctgaccgtacgtcccgtagtaacgttacgttttagaactttaatttaactttacgttagttacgtaaaccgtagtttaaacgtttacgtaaccgtttacccgtaacggtttacggtacgttacccggggtaccgtaacgggggtaacccgtaagggtacggtaacggttaccgtaacccggtaacgtaggtacggtacgtcgtacccg

SEQ ID NO: 216707 - DNA, 637 bp, Homo sapiens
  misc_feature: GYAE6OF02JWQX1.1.34.D01.1.454.CMB.1.raw
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (482)..(482): a, c, t, g, unknown or other
  misc_feature (482)..(482): n is a, c, g, or t
  modified_base (616)..(616): a, c, t, g, unknown or other
  misc_feature (616)..(616): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctcctgtctgcatctatggagacagagtcaccatcacttgccgggcagtcaggccatcagcgtattcttagccttggtgtagacagaacgaggcgacgccccgtnacgctacgtacgtntacgtggtgcatccagtagttcgacgaacggttcggggtaccctagtccgtaacggttacgtacgggttacggacgtacggttagccgtaacgttcggtacggggaagtaacgtagttaacctacgtcctacgtaactaacgtcctaagccgaacgtcccgtagacgtacggtaccctaggtaaacgttntttaacgtacttaaagttttacttaacgttcgtaactaacgtaagttactttaacgtaccgttacccgtacgttacggtacgttcggacggtacgggtaacgtaacggtaggtaacgtaacgtaaccgacggtnttacggcgtacgttaccgacg

SEQ ID NO: 216708 - DNA, 670 bp, Homo sapiens
  misc_feature: GYAE6OF02JCF0V.1.34.D01.1.454.CMB.1.raw
  modified_base (199)..(199): a, c, t, g, unknown or other
  misc_feature (199)..(199): n is a, c, g, or t
  modified_base (271)..(271): a, c, t, g, unknown or other
  misc_feature (271)..(271): n is a, c, g, or t
  modified_base (317)..(317): a, c, t, g, unknown or other
  misc_feature (317)..(317): n is a, c, g, or t
  modified_base (468)..(468): a, c, t, g, unknown or other
  misc_feature (468)..(468): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatcctccctgtctgcatctattgganacagagtcaccatcacttgccgggcagtcagtccatcagcgattcttagcctggttcgcagcaagaaaccgngggacgacgcccctcacgatcgtagtctagtcggtgactagtaccngtaacttggacgtaaaggggttccggggtacccaccgttaccggtaacgggttttccgaagggtggaccgtaggttcgacgtacggtacgttacggggactaggtaactttacgaacctccgtacctaactatcaacggctacgtcgtacnccgtaatcccgtaagtaacgtttatttacgactttaagtttacttacgtacgtacttaaacctagttaatttacgtaaaccgtacccttagggtaccgggtaccgggttccggtaaccgggtaacgggtaaccggtaacggtacgggtaagttaacccgtaaccgggtaccgttacgggtaccgggttacgtgtaaccccgg

SEQ ID NO: 216709 - DNA, 670 bp, Homo sapiens
  misc_feature: GYAE6OF02H4COC.1.34.D01.1.454.CMB.1.raw
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattgganacagatcacatcactgccggnagtcgaggccatcagcgtatttcttacgccttggttcgactagaccgaacggaaacccgaggggaccgaacgacccccttagaaggtacgttaccgtagtccgtaagtcggtagaccaacgtccgaagtacgttcgaacgtaacggggttcgggtacccagttccgtaggttcaaggttcggactagtcgactagtcggagggtaactacggtaacttaccgacctttaccgtactaacgttaacgacgagaccgaacgtccgtgaccgttacgacgttaagtaagttcttttaacgacgtttaaatttactacgtttacgaactaacttaagtttaacttaaccgtaccgtacccgttacggttgtacccggtttacggaccggaacggggtaacctaaagggtcgtaaaccgtacggtaaccggtaactcgggtacgcgtacggtaccc

SEQ ID NO: 216710 - DNA, 742 bp, Homo sapiens
  misc_feature: GYAE6OF02HYK88.1.34.D01.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (286)..(286): a, c, t, g, unknown or other
  misc_feature (286)..(286): n is a, c, g, or t
  modified_base (312)..(312): a, c, t, g, unknown or other
  misc_feature (312)..(312): n is a, c, g, or t
  modified_base (438)..(438): a, c, t, g, unknown or other
  misc_feature (438)..(438): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctatgganacagatcacatcacttggccgggcgagtcacggccatcagcgtattcttagcctggttncagacaacgaaaccgagggacgacgcccctanacgtacgtcgtagtcttaagtggtcncactccagtattgacgtaggggtccgggtccctagtccgtaggttacgaggtcggactaggtcgctacgttcggtgggactagtacttacgacttccgtacaaccttatcaacgccacgtccgtanaccgacgcccgttaaagtaacgtttacgttttactaacgtttaaacgtttttaacttttaaccgttacgtaaccgttaaaccgttaagtttaaaccttttaaacgttaaccccgtttaaccccggttaaccgggttttagggtaaccccgggttttacccggggggtaacccggtaaaccggggggggttaaacccgttaaaggggggtttaaccgggtaaaacccgggtttaacccgtaaaaaccccgggttaaccggtttaaccgggggttaccgggtttacccgttaccgggtaaaccccg

SEQ ID NO: 216711 - DNA, 545 bp, Homo sapiens
  misc_feature: GYAE6OF02GZLKN.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcagtcaggccatcagcgtattcttagccgttggttgcagcgaacgaaaccgagggcgacgcccctacagtactcgtagtctagtggtgcatccgagtattgacgtaaggtcgggtacccagtcctaggttcaggtcggcgagtcgactatcgtagggactagtacttacactctactactatcagcacgcctgcacgtactagtaacgttatttcgacttaatttattactagtactaactattatactacgtaccctagtgtacgtcggaccggtacggacgtaaggtacgtaagtaccgaacggtagtcggtacgactgacg

SEQ ID NO: 216712 - DNA, 550 bp, Homo sapiens
  misc_feature: GYAE6OF02JAYMH.1.34.D01.1.454.CMB.1.raw
  modified_base (221)..(221): a, c, t, g, unknown or other
  misc_feature (221)..(221): n is a, c, g, or t
  modified_base (509)..(509): a, c, t, g, unknown or other
  misc_feature (509)..(509): n is a, c, g, or t
  modified_base (513)..(550): a, c, t, g, unknown or other
  misc_feature (513)..(550): n is a, c, g, or t
tcagacgagtgcgtcacgaccggtgctcgatttagatcgtctgtgttgggtttggggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcaactatcagcagcctgcancctagaatattttgactaagttttattactgtacaacgtagttaattaatacgtacccctagtaggaccgttcggaccgaggggaaccctaagggttcggaacgtacgaaacccgtaacgtggttggcctacgacctacgtaacttcgttaggtacctttacacttacccgtttcccccgaccttccgtacgtaaccggccttaaaccgttcgttaccgttacggaacgggtcccggggtactacggggacccaaaacgggtcccgataacggtaaggcttaggatcngacnnnnnnnnnnnnnnnnnnnnnnnnnnnnnnnnnnnnnn

SEQ ID NO: 216713 - DNA, 803 bp, Homo sapiens
  misc_feature: GYAE6OF02HX88G.1.34.D01.1.454.CMB.1.raw
  modified_base (198)..(198): a, c, t, g, unknown or other
  misc_feature (198)..(198): n is a, c, g, or t
tcagacgagtgcgtcacgaccggtgctcgatttagatcgtctgtgttgggtttgggggagtcagaccctgtcaggacacagcatggacatgagggtccccgctcagctcctggggcctcctgctgctctggctcccaggtaccagctgtgacatccaattgacccagtcctccatcctcctgtctgcatctattgganacaggacgtcaccatccacgttcggccgggcgagtcaggccatcgagcgtactttcttacgtccgtggttcgcgagacaaacggaaaaccgaggggtaccgaccgcccccttagaacggtacgtacggttaacggtccttaagttcgggtacggacctaacttacccgaaggtaacgtttacgggacgtaaacgggggtttccgggtacccctaaacgttcccgtaagggtttacgtacggtttacggacgttacggtcgtactacggtaccggttaggggaacctaagtaacgtttaccgtaacccgttacgttaaccaaaccgttaacgtccgtaacggacctacggtaccgttagacccgtagaacccggttagtaaacgttactttacggtaactttaaagttttaaccttacgtacgttaaacgtaaacgtaacgttttaaacgttaaacgtttaacccggtaacccgttacgggttacgggttaaccgtttcccggggaacggttaacccggggttaacgggtaaacggggtttaaccggaaacggttaaccgtaaaccccgggtaagttaccgggtacgggttccgtacgtaaccccg

SEQ ID NO: 216714 - DNA, 522 bp, Homo sapiens
  misc_feature: GYAE6OF02FLUI7.1.34.D01.1.454.CMB.1.raw
  modified_base (215)..(215): a, c, t, g, unknown or other
  misc_feature (215)..(215): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccagtaccagctgtgacatccaattgaccccagtctcccatcctccctgtcctgccatcctattgggagacagagtccaccntcacttgcccggcgagtcaggcccatccagcgatctttagcctgttgcagcagaaaccagggcaggcccctcagatcgtagtctatggtgcagtccagatttgcaaggtgggtcccatccaggtttcagtggcagtgcatcgtgacagatttacactctcactatcagcagcctgcagcctgaagtattttgactaattattactgttaccaaactagtattaactacgttacccctacggtgacgttcgggtccgacgggaaccgacggtaggtaacgtacaaccgtaaccgtgtacggctgaccg

SEQ ID NO: 216715 - DNA, 809 bp, Homo sapiens
  misc_feature: GYAE6OF02GKYEC.1.34.D01.1.454.CMB.1.raw
tcagacgagtgcgtcacgaccggtgctcgatttagatcgtctgtgttggggtttgggggagtcagaccctgtcaggacgggacagcatggacatgacgggtccccgctcagctccgtgggctcctgctgctctcggcctcccaggtaccagctgtgacatccaattcgacccagtcctccactccctccctgtctgctatctattggagacagacgtccaccatcctacgttcggccggggacgagtccgacggccatcgagcgttatttcgttacgtccgttggttcgacacgaccgaaacggaaaccggaggggaccgacccgacccccgtacgaacggtaacgttccggttacgttcgttaggttcgggtacgacctaacgtaccgtaaggtactttacggacggtaacgggggttcccgggtacccctacggttccggttagggttccgtagggttacggcgtaagtcgactacgttcggtacgggaactagtacgtactactactacctactactacgacgacgtacgaccgtacgacgtacgtacgtacgtaagttacgtttacgttaactttaacgggggggggggggggggggggggggggtttaactttacgttacgttaaccgtaacgttaacgttaacgtttaaccgtttaacccgttaacccggttaccgggttaccgggttaccggttacccgggtaacccgggtaaccgggtaaccgggtaacgggttaacgggtaaccggttaacccggtaaccggtaaccggttacgggtccggttaccggtaccggtacccg

SEQ ID NO: 216716 - DNA, 574 bp, Homo sapiens
  misc_feature: GYAE6OF02GWH9D.1.34.D01.1.454.CMB.1.raw
  modified_base (257)..(257): a, c, t, g, unknown or other
  misc_feature (257)..(257): n is a, c, g, or t
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcagtcaggccatcagcgtattcttagcctggttncagcagaaccgagggccgacgcccctgagtacgtcgtagtctagtggtgcactcctagtnttggacgtaagggtcggcccatccgaggttcnggtgcgagtgcgtatcgtgggaactagtacttacaccttctactactactcgagccgacgcctgccacgtaccgtagtaacttatttgaactttaagtttacttacgtagttaaccaagttagttaacttacgtaaccgtacccgttaggtcggtaccgttcggaccggtaagggaccgtaaggtacgtaacgtaccgaacggtacgtggtcggtacgtcgaccg

SEQ ID NO: 216717 - DNA, 703 bp, Homo sapiens
  misc_feature: GYAE6OF02IOKOO.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctccccaggtaccagctgtgacatccaattgaccccagtctccatccctcccctgtctgctattctagttggagacagtctcacctatcctacgttcggccggggcgacgtcgacggctatcgagtccgtattttcgtttacgcgtttggttgcgtagcgaaacgaaaaccggcgggacgaccgcccccctagacggtacttcggtagttacctagtcgggttcactacgtaccgtagtagttcggaacgttaacggggggtcggtaccctacgttccggtacggttcgaggtcggctaggtcgtactacggttcggtacgggactagtaacgttacctacttactaccgtacgttactacgacgtaccgtcgtaccgtcgacgtaccgtccgttaagtaacgtttcgttacgttaactttaacttttacgtcttacttaacgaactttagttacttacgtaaccgttaccgttacggtcggttacggttccggaaccggttaagggaacccggtaaggtaccggtaaccgtaaccggaaaccgttccggtacggtacggccgtagtaacccg

SEQ ID NO: 216718 - DNA, 604 bp, Homo sapiens
  misc_feature: GYAE6OF02I8LDW.1.34.D01.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctagttgganacagagtcaccatcacttggccgggngagtcaggccatcagctattcttagcctggtncagcaagaaccngggcacgcccctanagtatcgtagtctagtggtcacactccgagtattcgacgtagggtcgggtaccctagtcccgaggttcaggtcgctagtcgctagtcgtagggacagtactacnctctcactancagcgacgcctgacgacgtcgtaggtaactttctttacgaactttaatttactacgtagtaactaacgttaagtttaacgttaaccgtaaccgttacccgtagggtcggttaccggtcggaacccgggtaaacggggaccgtaaaggggtacggtaaaccgtaaccggtaaaccggtagttacgggtacggtacgtaccgtaacccg

SEQ ID NO: 216719 - DNA, 721 bp, Homo sapiens
  misc_feature: GYAE6OF02F6UEY.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtccacatcacgttggccggcgagtcaggccatcgagcgtattcttagccgttggttcgcagcaacgaaaccgagggccgacgcccctacgagacttacggtagtactagtggtcgactactaccgagtacgttcggacggtaaggggtccgggtaccctaagttcccgtaggttacgagggtcggacgtacggtcgaccgtacgttcggtacgggaaccgtaaggttaaccttaaccgtacccgttactacctaaacttacgtaccgaacggtccgtaaccgtcccgtaggaacccgaccggttaccgttaaggtaaccgtttagttttaccgtaaacttttaaacgttttaccgttacgttaccgttaacctaaacgtttagtttaactttaaaccgttaacccgtttaaccccgttagggttaccggttaaccggttccggaacggtaacgggtaccgtaagggtacggtaacgtaccgtaacggtacgttacgggtaccgtagtaccgtaaccg

SEQ ID NO: 216720 - DNA, 909 bp, Homo sapiens
  misc_feature: GYAE6OF02HP161.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccatccctcctgtctgcatctattggagacagagtccacctatccacgttcggaccgggacgacggtcgacgggacccagtacgaacggtccgttaagttttccgttttaacggccgttgggttacgaccgtaggaccaaacggaaaacccggagggaccggtaaccgtcccccctagaacggtacgttacggtacgttaccgtaaggttcgggtaccgtactaaccgttacccgtaaaggttacgtttacgggaaccgggtaacgggggtttacccggggtaccccctaacggtttacccggtacggggttttaaccgaagggttaccggacgtaacgggtttccgaaccgttacggttaccggttacggggaacttaacgggttaactttaaccggtacctttccgttaacctaaacgttacgtaccgaacggtaccctacggtcccttacgggacccttaccgggtacctttaaagggttaaaccgtttagtttttaaccggaaactttttaacccgtttttaaattacccggttaacgttaaaaccgttaaacgttaacggttttaaacccttttaaaccggttaaccccggtttaaccccggtaggggtttacccgggtacccggtttacccgggaacccgggtaacgggtaaaccgggtaacggggttaacggtaaccggttaacccgaaaccggttaacggttacggttccgggtaccttaccgggaacccc

SEQ ID NO: 216721 - DNA, 613 bp, Homo sapiens
  misc_feature: GYAE6OF02IM1RP.1.34.D01.1.454.CMB.1.raw
  modified_base (309)..(309): a, c, t, g, unknown or other
  misc_feature (309)..(309): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatctacttggccgggcgagtcaggccatcagcgtattcttacgccgtggttgcagacaagaaaccgagggcgacgcccctgagagtcgtagtctagtcggncactccagtatgacgagggtcggtaccctagtccgtaggttcaggtcggacgtagtcgctacgtcggtacgggactaggtacttaccgtacttcaccgtaactacgtacgacgcaccgtcctggacacggtcctagtaagttatttacgacttaaattttacttacgtagtaactaacgtagttaacttaacgtaaccgttaccccgttaggttacgggtaccggttacgggaccggtaacggggaccgtaaagggttcggaacgttaccgaaaccggtacgtcggtacgggtacctgtacccg

SEQ ID NO: 216722 - DNA, 672 bp, Homo sapiens
  misc_feature: GYAE6OF02HVMYO.1.34.D01.1.454.CMB.1.raw
  modified_base (199)..(199): a, c, t, g, unknown or other
  misc_feature (199)..(199): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatcctaaattcgacccagtctccatcctcctgtctgcatctagtgganacagagtcaccgatcacttcggccggacgagtcacggccatcagcgtattctttacgccttaggttcgctagcaaggaaaccgagggtaccgaccgcccctagagtactacggtagtcgtagtcggtactcgactcgaagtattcggacgtaaggggttccgggtaccctaagtaccgtagggttactaaggttcggacgtaaggtcgactagttcggtagggacctagtacttacgtacttcgtactaactatacgacgctaacgccctaggacctacgtaccttaaggtaacgttacttttacgaactttaattttactacgtacgtaactaacgtaatttaacgttacgtaaaccgttacccgtaagggttacggttaccggttaccggaccggggtaagggtaaaccgtagggttaacggtaacgtaccgtaaaccggtaacgttcgggtacgtaccgttcgtaacccg

SEQ ID NO: 216723 - DNA, 625 bp, Homo sapiens
  misc_feature: GYAE6OF02JQUG7.1.34.D01.1.454.CMB.1.raw
  modified_base (587)..(587): a, c, t, g, unknown or other
  misc_feature (587)..(587): n is a, c, g, or t
  modified_base (592)..(594): a, c, t, g, unknown or other
  misc_feature (592)..(594): n is a, c, g, or t
  modified_base (596)..(625): a, c, t, g, unknown or other
  misc_feature (596)..(625): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctgaagtatttgactaattttatactgtacaaactgttaattactacgtaccccctaggtcggtaaccgtttccgggaccgaacgggggaacctaagggttacgggaaaaccgtcctaaaaccggaaacttgggtacgggaccttcggaacctaacccgtagttaccgtcggttacctttacgaacgttttccccgtttcccccggtccccttaccgtttaccgaaacccggttccctaaacccgtttcccgggttaccttaccgggtaaaccgggcccgggggtttaccctacgggggtaccgtaaaaacgggggccccggtaaccgttaacggttaccgggacttacgcgtagccggtatcggtancactnnncnnnnnnnnnnnnnnnnnnnnnnnnnnnnnn

SEQ ID NO: 216724 - DNA, 762 bp, Homo sapiens
  misc_feature: GYAE6OF02IUUMF.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagatccaccatcacttcggccgggctagtcaggccatcagctatttctttagccgtggttgcagcaacgaaaccgaggcgacgccccgtcagtacgtcggtacgtcgtagtcggtagctacgtaccgtagtacttacggacgtaacggggtccgggttaccccagtcccgtagggttaccgtaggtacggctaaggtgacctacggttacggtagggtaacctaaggtacgtttaacctaccgttaccctacgtaaaccgttactaccgtacgaccgtaacccggccgttaccggaacctacggtacccgttaaggttaaacgtttacgtttttaccggaactttaaacgttttttaacgtttaccgttaacgttaaccgtaaactttaaacgtttaacgtttaaaccgtttaaacccgtttaacccccggttaaccggttaccggggttaacccgggtttacccggggaacccggttaaaccggggggtaaacccggtaaaggggtacggtaaaccgtaaccgtaacggtaaccggtacggttacggtccgtacgtacccg

SEQ ID NO: 216725 - DNA, 658 bp, Homo sapiens
  misc_feature: GYAE6OF02HKG2H.1.34.D01.1.454.CMB.1.raw
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatccctccctgtctgcatctatggagacagacgtcaccatctacgttggccgggcagtcaggccatcagcgtatttctttagccttggttcncagcaacgaaaccgagggcgacgcccctanagtatcggtagtctagtggtcgacatccgagtagttacggcgtaacggggtccgggtacccagttaccgtaagggtttaaggtggaccgtaggtcgacgtacgtccggtagggaactacggtaaacttacccaccgtttcctaactactactaccgagtaccgacggtacccgtgacctacggtaccctaggttaacgttacgttttagactttaaattttacgttaccttagtacgtaaattagtttaaacgttaacgttaaccgttaaccccgtagttacgggtaccggttccggtaaccggaagggtaacccgtagggtcgaaacgtaccgaacggtacgtggtcgaccgtcgacctaacg

SEQ ID NO: 216726 - DNA, 573 bp, Homo sapiens
  misc_feature: GYAE6OF02IE479.1.34.D01.1.454.CMB.1.raw
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (400)..(400): a, c, t, g, unknown or other
  misc_feature (400)..(400): n is a, c, g, or t
  modified_base (424)..(424): a, c, t, g, unknown or other
  misc_feature (424)..(424): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcacggccagtcagcgtattctttagcctggttgcagcagaaaccngggcacgcccctnagatcgtagtctagtggtnacatcagtatgacgagggtcggtacccagtccgaggttcaggtcggactaggtgacgagtcgtgggacagtacttaccacttctacacttatcacncacgcctagcacgcctagaacttntttagacttaattttactctacttacaattacgttaatacgtaccgttacccgtaggttccgggtaacgttccgggaccgtaacgggggtaaccctaaggggttcggaaacgttcccgaaaccggttacgtggtacggtactacgtacc

SEQ ID NO: 216727 - DNA, 680 bp, Homo sapiens
  misc_feature: GYAE6OF02JTZ2H.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagacgtcaccatcacgttgccgggacagtcacggtccatcgagcgtatttcctttaggccttggttgctagctaagaaacccgaggggtccgaacggcccctagacgacttaccgtacgtctagtcggtcgtacacgtaccgagtagttacggaccgtaaggggttccggggtccctaacgttcccgtaggttaccgaagttcgggctaggtcgtaccgtagttcgtacgggactagtaacctttacgaacttccgttaccaaccgttagtacctacggtctaacgtcccgtagaccgtacgtaccgtagtaacgttagtttaccgaattaattttacgtacgttacgttaactaacgttacgtttaacttacgttaaccgtaccccgttaaggtccgttaacggttcccggacgtaaccggggtacgttaaagggacgtaaccgtaccgtaaccgacgttcggtacggtactcgtaaccg

SEQ ID NO: 216728 - DNA, 615 bp, Homo sapiens
  misc_feature: GYAE6OF02G9E4W.1.34.D01.1.454.CMB.1.raw
  modified_base (410)..(410): a, c, t, g, unknown or other
  misc_feature (410)..(410): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttggccgggcgacgtcaggcccagtcagcgtattcttagccttggttgcagcaagaaaccgagggcgacgcccctcagactcgtagtctagtggtgcatccagtattgcgaaggtcggtcccacgtccgaggttcaggtcggcagtgctatcggacggaacagtactactactctactaactacgtcacgacgacnccgtgaccacgtacctagtaacgttattttacgacttaagttttacttctacgtactaacgttagttaacttacgtaacccgttacccgttacgggttacggtaccggttccggtacccgggtaacggggtaaccggttaacggtaacgggtaacggtaaccggtaaccccggtaacggttcggtaccgggtactcgtaaccccg

SEQ ID NO: 216729 - DNA, 657 bp, Homo sapiens
  misc_feature: GYAE6OF02I9X08.1.34.D01.1.454.CMB.1.raw
  modified_base (275)..(275): a, c, t, g, unknown or other
  misc_feature (275)..(275): n is a, c, g, or t
  modified_base (332)..(332): a, c, t, g, unknown or other
  misc_feature (332)..(332): n is a, c, g, or t
  modified_base (430)..(430): a, c, t, g, unknown or other
  misc_feature (430)..(430): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacataccaattgacccagtctccatccctccctgtctgctatctagttggacgacaggactacaccctatcgtacttcggccggggcagtccgacggccaatcagcgtattcttagccgtaggttncagcaaggaaaccggggtacgactcccctacgagacgtacggtagtcgtaagtgggntaccacgtaccagtacgtagacgaaggggtcgggtacccagtccgtaggtcaggtcggactaggtgctattcggtagggaactacggtaacttaaccnctacgttaccgaacttacgtcacgtacgtcctaccgtcggaacttacgaccgttaagttaaacgttattttaccggtaaacttaactttaacgttacttaagtaaccgttaacgtagtttaactttacgtaaccgttacccgttacggtacggtacgttaccgggaccggtacgggtaaacgaggtaacggtataaccgaacgttagacggtacgtacgtcgtaacg

SEQ ID NO: 216730 - DNA, 767 bp, Homo sapiens
  misc_feature: GYAE6OF02HN31C.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtctccatcctccctgtctgcatctatggagacagagtcaccatcacttggccgggcagtcaggccatcagtcgtattcttagcctggttcgcagcagaaaccgagggcgacgcccctacagtactcgtagtctagtggtgcatccagtagttagacgtaggggtccgggtccctagtcccgtaacggttcaacgggtcggcgtaggtcgctaacgttcgggtacggggaacctaaggttaactttaaccctaacgttacccttaaccgtaacctttaacaccgtacgtaccgacgtaccccgttaggccgtaaccgtaccggttaagtaaacgttacgttttacggaactttaacggttttaacttaccgttagtaacccgtaaacgttagttaactttaaccttaacccggttaacccccgttagggttaccgggtaccgtttaccggggaaccccgggtaacggggggtaaacccgttaaaggggttaccgggtaaacggttaccccgtaaaccggggtaacgtttccgggtaacgggtacccgttacgtaacccgtaacccgttaacgtttcgtccgtttaaccgtttcccgtaaccgtttccccgttacccccgttacccg

SEQ ID NO: 216731 - DNA, 443 bp, Homo sapiens
  misc_feature: GYAE6OF02G0K05.1.34.D01.1.454.CMB.1.raw
  modified_base (373)..(373): a, c, t, g, unknown or other
  misc_feature (373)..(373): n is a, c, g, or t
  modified_base (423)..(443): a, c, t, g, unknown or other
  misc_feature (423)..(443): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattactgtcaacagtattatagtacccctacgtggaccgttcggccagggggaccaagggtggaaagtccaaaccgaactggtaggctgccaccaattcctgtcctttcacttccttcccgcctatctgaaccncacctctcctggacgccgggctagggacctaagggccgactaatacggannnnnnnnnnnnnnnnnnnnn

SEQ ID NO: 216732 - DNA, 715 bp, Homo sapiens
  misc_feature: GYAE6OF02GSLYL.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtccaccatcacttcggccgggcgagtcacggccatcagcgtattctttagcctggttgcagcaagaaccgaggcgacncccctacagactcgtagtctagtggtcgctatccagtattcggacgtaaacggggttcgggtaccctacgtaccgttacgggttacgaacggtcgggtacctaagggtcgaccgtaagttccggtaggggaaccgtaagaactttaaccgaaccgttacttaccaacttagtaccgaggtaccaacgtccccgtagtccgaaacggttccgtaagtaaacgtttattttacggaactttaaagttttaactttaccgttaacgttaaccgtaaacttaagtttaactttaaacgttaacccgtttaaccccgtaacggtttaccgggtaacccggtttaccgggaacccgggttaaggggaaccccggttaaagggtaaccgggtaacgtaacccggaaccggttaaccgtgggtacgggtacctaggtacccg

SEQ ID NO: 216733 - DNA, 625 bp, Homo sapiens
  misc_feature: GYAE6OF02IZODZ.1.34.D01.1.454.CMB.1.raw
  modified_base (126)..(126): a, c, t, g, unknown or other
  misc_feature (126)..(126): n is a, c, g, or t
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctntggctcccaggtaccagctgtgacatccaattcgacccagtctccatcctccctgtctgcatctagtggagacagagtcaccatcctacgttcgccgggcaagtccgaaggccatcgagcgtattctttagccttggttcgcagcagaaaccgngggcgacgcccctanagntcgtagtctagtggtgcactcagtntagcgtaaggtcgggtccagtccgacgttcgagtcggctaggtcgactagttcggtagggaacgagttacctactacctctactaacttatccgaagccgtaccggcccttacggacctacggtccgttagtaaacgtttcgtttacactttaagttttacttacgtacgtactaaacggtatttaacgttacgtaaccgttacccgtaaggttccgtacggttacccgggacggtaacggggtaacccgtaagggtacggaacgttaccgaaccgttaccgtaggtcggtacgtgtacccg

SEQ ID NO: 216734 - DNA, 634 bp, Homo sapiens
  misc_feature: GYAE6OF02G50BU.1.34.D01.1.454.CMB.1.raw
  modified_base (201)..(201): a, c, t, g, unknown or other
  misc_feature (201)..(201): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (326)..(326): a, c, t, g, unknown or other
  misc_feature (326)..(326): n is a, c, g, or t
  modified_base (432)..(432): a, c, t, g, unknown or other
  misc_feature (432)..(432): n is a, c, g, or t
  modified_base (468)..(468): a, c, t, g, unknown or other
  misc_feature (468)..(468): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtcctccatccctcctgtctgcatctagttgganacagacgtcaccatccacgttggccggggcagtcacggccaatcgagtcgtatttcttacgccgttggtcncagacaacggaaaccgngggcaccgtcccctgagtagtcgttagtctagtggcncactccgagtattcggacgtacggggtccggtccagtccggtaggttcgaggtcggactagtgactgtcggagggtactagtactacactctacgtatactcgacncgcgtaccgtgacgtacgtacgttaagtaacgtttntttacggaactttaagttttaaccttagtacgtaactaagttaagtttaaccttacggtaaaccgtacccggtttagtaccgggtaccggttaccggacggaaacgggtacgtaagggttacggaacgttaaccgaaccggtacttcgggtacgtcctaggtaccg

SEQ ID NO: 216735 - DNA, 625 bp, Homo sapiens
  misc_feature: GYAE6OF02G4RUD.1.34.D01.1.454.CMB.1.raw
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaaattgacccagtctccatcctccctgtctgcatctattggagacagagtcaccatcacttgccgggcgagtcaggccatcagcgtattctttagcctggttncagcagaaaccgaggcgacgcccctnagatcgtagtctagtggtgcatccagtatgcgaagggtcgggtcccagtccgtaggttccgagtcggctagtgactagtccgtgggactaggtacttaaccgacttctacgaacttacgacacgacaccgtctcggcctaacgccgtagtaacggttacttttacggaacttaagttttactactttacgtaacctaaacgtagtttaacttacgttaaccgttacccctaggttacgggtacccggtttcggaaccggtacggggtaaaccgtacgggtaacggggtaacctaacccggttaaccggaaacgttccgggttacggaccttaggtaccccg

SEQ ID NO: 216736 - DNA, 788 bp, Homo sapiens
  misc_feature: GYAE6OF02IQLAE.1.34.D01.1.454.CMB.1.raw
  modified_base (312)..(312): a, c, t, g, unknown or other
  misc_feature (312)..(312): n is a, c, g, or t
  modified_base (330)..(330): a, c, t, g, unknown or other
  misc_feature (330)..(330): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatccaattcgaccctagtcctccactcccgtccctgtctgctattctagtggacgacaggacgtccacctatcctacgttcggccggggcgaagtccgacggcctagtcgagccgtactttcgtttacgccgttggttcgcgacgactaaacggaaaccgngggaccgaccgcccctanagtacgtcgtagtctagtggtacacgtactacgagtagttcggacggtaacgggtccgggtaccctacgtccgtaggttaccgagggtacggacgtacggtacgacgttagtaccggtaacggggactaaggttaacttaccgaccttacgtactaacctagtacgaacgccgtacgtccgacgcgtacgtaccgttaaggtaacgtttacgtttacgaacttttaaacgttttacgttaacgtaacgttaaccgttaaacgtttaacggtttaaacttttaaacccggtaacccggtttaaccccgtttaggggtacccggtttaacccgggtttaccccggggaaccgggtaaccggggggttaaaccgtaacggggttaaccgggttaaacccggttaaacccgtaaccggggttaacccgttggggtttacccggacgttacccggtaaacccg

SEQ ID NO: 216737 - DNA, 613 bp, Homo sapiens
  misc_feature: GYAE6OF02GV6YF.1.34.D01.1.454.CMB.1.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
tcagacgagtgcgtcacgaccggtgctcgatttagatcgtctgtgttggggtttgggggagtcacgaccctgtcaggacacagcatggacatggagggtccccgctcagctcctggggctcccgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgacgcccctnagatcgtagtctagtggtgcatccagtatttggacgtaaggggttcggggtccccagttcccgtagggttccgaaggtcggctaggtgactacgttcgtaggggactaggtactttaccacgttctacacttatcgagcacgctgccagtcctagaagttatttagacttaaattttacttactagtacaaacgtagttaactttaactaccgttaaccccgttaggttacggtaccgttccgggaccggtaaggggtaaccgtaaggggtacggtaaccgttaccgaaacccggtacgttagggtacggtacgtacggacctaacccg

SEQ ID NO: 216738 - DNA, 525 bp, Homo sapiens
  misc_feature: GYAE6OF02GAZT2.1.34.D01.1.454.CMB.1.raw
  modified_base (364)..(364): a, c, t, g, unknown or other
  misc_feature (364)..(364): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctagtggtgcatccagattgcgaaggtggggtcccagtccaggttcaggtggcagtgcatcgtgggacagattacactctcactatcagcagcctgcngcctagaagtatttcgactaatttacttactgttacaatagttaactttaatacgttacccctaggtcggtacgttccggaccgtaaggggaccaagggtagaagtccaaccgatggtacggctaggccacctagtctgttccttcacttcctcccgtacc

SEQ ID NO: 216739 - DNA, 691 bp, Homo sapiens
  misc_feature: GYAE6OF02HCB36.1.34.D01.1.454.CMB.1.raw
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctncatctatgganacagagtcaccntcacttcggccgggcgagtcacggcctatcagcgtattcttagccttggtgcagacagaaccgngggcacgccctnagtatcgtagtctagnggtgctatcctagtnttagacgtaagggtcgggtacccagtcccgaggttcaggtcggactagtcgctagtcgtacgggactaagtaacttaccncgttactactaacttacgtcacggactacggtcccttaggacctacggttacccttaagggaaacgttttacgtttttaccgaacttttaaaggtttttaacctacggtttaactaccttaaaccggttagtttaaacgtttaaccgttaaaccggtttaaccccggttacgtacggggttacccgggtttacccgggaaacccggttaacggggggaaacctaaacggggttacggtaaacggttaccccgtaaaacgggttaaccgtcgggtaaccgttccggttaagaccccg

SEQ ID NO: 216740 - DNA, 626 bp, Homo sapiens
  misc_feature: GYAE6OF02FLGVI.1.34.D01.1.454.CMB.1.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (346)..(346): a, c, t, g, unknown or other
  misc_feature (346)..(346): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcactgccgggcgagtcaggccatcagcgattctttagcctggttncagcagaaaccngggcacgcccctnagatcgtagtctatggtgcatccagacttgactaagggtcgggtacccagtcctaggttcaggtgnagtgctatcgtgggacagtacttacactctacactatcagctacggcctggacacgtccgtagaacgttacttttagacctttaaagttttaacttaccgtacgttacctaaacgttaagtttaacgtttaaacttaacccggttaacccccgttagggttacccgggttaacggtttacccggggtaacccgggtaacggggtaaaccggtaaacggggttcgggtaaaacggttacccgaaaccggtaaccgttcgggtacggtccgtacgtaacccg

SEQ ID NO: 216741 - DNA, 590 bp, Homo sapiens
  misc_feature: GYAE6OF02JLPBZ.1.34.D01.1.454.CMB.1.raw
  modified_base (229)..(229): a, c, t, g, unknown or other
  misc_feature (229)..(229): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (475)..(475): a, c, t, g, unknown or other
  misc_feature (475)..(475): n is a, c, g, or t
  modified_base (584)..(584): a, c, t, g, unknown or other
  misc_feature (584)..(584): n is a, c, g, or t
tcagacgagtgcgtcacgaccggtgctcgatttagatcgtctgtgttgggtttgggggtaggtcgagaccctgtcaggacacagcatggacatgagggtccccgctcagctcctgggctcctgctgctctggctcccaggtaccagctgtgacatccaattgacccagtctccatcctccctgtctgcatctattggagacagacgtacaccatccacttggcccgggngagtcaggccaatcagcgtacttccttgaccttggttcgacgtacgacacgaaacccgaggggccgacggcccctacagacgtcgtacgctaagtggtcgctactcagtatcgagttaacggcgggtcccagtaccgaggttcgagtggatacgtagtcagtcgtcgggtaanagtactacgactctaacacgtancgagactgcctgtacncgtctagtattattactattaatttacttacgtntactaatattacgtaactaaccgttaccgttagtcggtaacggtccggtacggtaacgggtacggtagggtaacgtaacggtaaccgtaacggtacgtggtacggtacncggtac

SEQ ID NO: 216742 - DNA, 551 bp, Homo sapiens
  misc_feature: GYAE6OF02JXCLG.1.34.D01.1.454.CMB.1.raw
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(551): a, c, t, g, unknown or other
  misc_feature (516)..(551): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcancagcctgcagcctgaaagtnttttgacttaattttattactgtcaaacagttatttaanacgttaaccccctggtacggtaccgtttcggccctaaggggggaacccaaggggttggaaacttccaaacccggtaactggtcggacttggacctaacctatcgttagttccttctacgttccctttccccggacctaagtttcccgagtaaacccgtctacctccgggtttaccagggaaccgtcgggggtacccttcgggaccgtaaacggggtccgtacgtaccgttaggctacggncgtngntnnnnnnnnnnnnnnnnnnnnnnnnnnnnnnnnnnnn

SEQ ID NO: 216743 - DNA, 713 bp, Homo sapiens
  misc_feature: GYAE6OF02J2FA3.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcacatcacttgccgggcagtcaggccatcagcgattcttagcctggttgcagacagaaccgagggcgacgcccctcgacgacgtcgtagtctagtggtcgctagtcccagtaacgttgaccgtaaggtcggggtcccgtagttacccgtagggttacctaggtcggaccgtaaggtcgtacgtagtaccgtaggggaacctaggtaactttaaccgacttcctacaacttacgtaccacggtcaacgtcccgtagccgtaacgtccgtagaaagtttacgttttacggtacttaaacttttacgtttaacgttcgttaacccgtaaacgttaaagttaacgtttttaaaccgtaacccggtttaacccccgtttaaggtaccgggtttaaccgttcccggggtaaacccggtacgggggttaaacccggtaaggggttaccgggtaaacgtaaaccccggtaaccgggtaaaccggttttacggtccgggttaacgtaccggttaacccg

SEQ ID NO: 216744 - DNA, 785 bp, Homo sapiens
  misc_feature: GYAE6OF02JCRWB.1.34.D01.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (291)..(291): a, c, t, g, unknown or other
  misc_feature (291)..(291): n is a, c, g, or t
tcagacgagtgcgtcacgaccggtgctcgatttagatcgtctgtgttgggtttgggggtagtcagaccctgtcaggacacagcatggacatgagggtccccgctcagctcctgggctcctgctgctctggctcccaggtacccagctgtgacactccaattgacccagtcctccatcctccctgtctgcatctattcgganacagatcaccatcacttggccgggnagtcaggccatcgagctattcttagccgtggttgcagacaacgaaccgagggtcaccgcccctanaagtacgtacgtaggttacctaggtgggttcggacctactacccgtaagtagtttacggacgtaaggggttaccggggtaccctaacggttccctacgggtttaccgaaggttcggggtaccctaaggtccggtactaaccgttaccggggttacggggtaacctaacgggttaaccttttaacccgacccgtttaacctaacccgttaaacttacgttaccgacgtaccgacgtccctaggtaacccgtacgtaacccggttagtaaacgttttacgtttacgtactttaaattttacgttaacctaggttaacctaacgttaaagttttaacctttacgttaaaccggtttaccccgttaacggttacgggttaacccgggttccggtaaacccgggaacggggttaacccggtaaacgggttacgggttaaaccgggtacccctaaacccgggtaggttaaccggtcggggttaaccctacgggtaacccg

SEQ ID NO: 216745 - DNA, 607 bp, Homo sapiens
  misc_feature: GYAE6OF02GIQEW.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctattggagacagagtcaccatcacttggaccgggagagtcacggccatcagcgtattctttagcctggttgcagcaacgaaaccgagggccgacgcccctcaagatcggtagtctagtggtgcatccagtatgacgaagggtcgggtcccagtccgtaggttcaggtcggcgtagtgctagtcggtagggaacagtacttacacgtctacactatcgagaccacgccctgccgacgtcccgtagtaacgttcgtttacgtaactttaatttactttactacgttactaaacttaagttaacttaacgttaaccgtaccctacggttacggtaaccggtccggaaccggtaacgggaacccggtaagggtacggtaaggtaaccgtaaccgtaacggttcgtacggtactacggaccc

SEQ ID NO: 216746 - DNA, 422 bp, Homo sapiens
  misc_feature: GYAE6OF02FT429.1.34.D01.1.454.CMB.1.raw
  modified_base (323)..(323): a, c, t, g, unknown or other
  misc_feature (323)..(323): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (398)..(422): a, c, t, g, unknown or other
  misc_feature (398)..(422): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaagttttattactgtcaacagtatttatagtaaccccctacgtggaccgtttcggccagggggaccaaggtggaagtcaaccgaactgnggctgcacatctgtcttcatcttcccgctatctagaacgctactcgtctgacgcggntggcaaggcgcatgnacnnnnnnnnnnnnnnnnnnnnnnnnn

SEQ ID NO: 216747 - DNA, 628 bp, Homo sapiens
  misc_feature: GYAE6OF02H3S3F.1.34.D01.1.454.CMB.1.raw
  modified_base (227)..(227): a, c, t, g, unknown or other
  misc_feature (227)..(227): n is a, c, g, or t
  modified_base (319)..(319): a, c, t, g, unknown or other
  misc_feature (319)..(319): n is a, c, g, or t
  modified_base (427)..(427): a, c, t, g, unknown or other
  misc_feature (427)..(427): n is a, c, g, or t
tcagacgagtgcgtcacgaccggtgctcgatttagatcgtctgtgttgggtttggtggagtcagaccctgtcaggacacagcatggacatgagggtccccgctcagctcctggggctcctgctgctctggctcccaggtaccagctgtgacatccaattgacccagtctccatcctccctgtctgcatctagttggagacagacgtcaaccatcacttggcccgggngagtcaggcccatcagcgtattctttagccttggttcgcagacaggaaaccgagggcacgccccctagagatcggttagtctaagtggtacncatccgagtattagacgtaaggtcggggtccctagtcccgtaaggttcgaggtacggacgtagtcgactagtcggtagggaactagtactttaccactctacaactanctacgacacgtcctaggcacgtacctaggtaaatacgttttgaacttaattttaacgtacgttacgtactaaaacgttacgtttaattaacgttaaccgttaaccccgttacggttacgggtacccggttcgggaaccggtacggggaaccgtaaggtacggtaacgtaccgaaaccgtaaggtcggtaccggtctaaccg

SEQ ID NO: 216748 - DNA, 648 bp, Homo sapiens
  misc_feature: GYAE6OF02GIHI8.1.34.D01.1.454.CMB.1.raw
  modified_base (402)..(402): a, c, t, g, unknown or other
  misc_feature (402)..(402): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttggccgggcgagtcacggccatcgagcgtattctttagccgttggttgctagaccgaagaaacccgaggggcgaccgccccctgacggatcgtagtacttagtgggtcgcatcccagtattggacgtaaggggttccgggtacccacgtccgtaggttacgaggtcgggacctaggtcgactagtccgngggacaggtacttacgacttcctctactactcgaacgtccacgacctcgacgtacgtccgtagtaagttactttgaacttaaagtttacttaactacgttaaccaacttaacggttaacttaacctaaccgttaaccccgttagggtacgggttaacggtttaccggaccgggtaacggggtaacccgtaagggttacggtaaccgtaaccgtaaccgttacggtcgtacgggacctacgtacccg

SEQ ID NO: 216749 - DNA, 617 bp, Homo sapiens
  misc_feature: GYAE6OF02F1Y5P.1.34.D01.1.454.CMB.1.raw
  modified_base (269)..(269): a, c, t, g, unknown or other
  misc_feature (269)..(269): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagatcaccatcacgttgccgggcgagtcgacggccatcagcgtattcttagcctggttgcagcagaaacgngggacgacgcccctgagatcgtagtctagtggtgactatccgagtgttgacgtaacggggtcgggtaccctagtccgtaggttcaggtcggactagtcgactacgtcggtagggaactagtaattacgaccttctacctaacgttactacgacgtaccacgtcccgtgacgacgtaccgttaggaaacgtttacgttttaggaaccttttaaagttttacttacgtacgttactaacgttaagttacttacgtaacgtaccccgttaggtaccggtaccggttcgggaccggtaacgggtacgaaggtacgaacgtacgaaccggtacgtaggtcgtacgtactaccg

SEQ ID NO: 216750 - DNA, 775 bp, Homo sapiens
  misc_feature: GYAE6OF02IVRLV.1.34.D01.1.454.CMB.1.raw
  modified_base (501)..(501): a, c, t, g, unknown or other
  misc_feature (501)..(501): n is a, c, g, or t
  modified_base (721)..(721): a, c, t, g, unknown or other
  misc_feature (721)..(721): n is a, c, g, or t
tcagacgagtgcgtcacgaccggtgctcgatttagatcgtctgtgttgggtttgggtcgatggacatgagggtcccgctcagctcctgggctcctgctgctctggctcccaggtaccagctgtgacactcaattcgaccagtctccatcctccctgtctgcatctattggagacagagtcacatcgacttcggccgggacgagtcaggcctatcgagcgtatttaccgttacgccgttgggttcgacaacgtaccgaaacggtaaaacccgaggggtaccggaccgtcccccgttacgaaggtaacgttaccggttaacggttacctaacggtggggttacgacctaacgttccgtaagtaacgttcggacggtaaacgggggtttccgggaacccctaacgttacgtaacgggttcgtagggtacgggcctaagggtcgtcgaacgtttcgggtacgggaactaaacggtattaacccgtattaccgtactaacgttacncgaacgcaacgtccgtacacgcgtcctaggtaacgttatttcgactttaaactttactaggtttacaacctaaattaaaggttcttaaacggttacccgtaacccgttaggacgggtttaccgtaccggacggtaacgggaacccggttaaggaaagggttaaccgtaaccggtaaccgtacggttaggtggtaacccggtctaaacccggaccgtttanaccgggtttttactacccgttactttaaacccgtcccccgttccgtaaccccgg

SEQ ID NO: 216751 - DNA, 609 bp, Homo sapiens
  misc_feature: GYAE6OF02I73IY.1.34.D01.1.454.CMB.1.raw
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacgttgccgggcgagtcgacggccatcagcgtattctttagcctggttgcagcaagaaaccgngggcgacgcccctgagctcgtagtctagtggngcagtcagtatgcgaaggtcggtacctagtccgaggttcagtggactgtgctacgtcgtagggactagtactaactactctacgtactagtcacgacgtacgtcgtacgctacgtccgttaagtaacgttagttttcgaacgtttaaattttacttaccgtcgttaaactaacgttaacgtttaacttaccgtttaaccgttaccccgttacggtacgggtttaccggtcgggtaccggaacgggtaccggtaaggtacggtaacgtaccgaacccgtagtcggtacggtacgtacggtaccc

SEQ ID NO: 216752 - DNA, 619 bp, Homo sapiens
  misc_feature: GYAE6OF02HVPQ8.1.34.D01.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (286)..(286): a, c, t, g, unknown or other
  misc_feature (286)..(286): n is a, c, g, or t
  modified_base (331)..(331): a, c, t, g, unknown or other
  misc_feature (331)..(331): n is a, c, g, or t
tcagacgagtgcgtcacgaccggtgctcgatttagatcgtctgtgttgggtttgggggagtcagaccctgtcaggacacagcatggacatggagggtccccgctcagactcctggggctcctgctgctctggctcccaggtaccagctgtgacactcccaaattcgaccctagtctccatcctccctgtctgcatctattgganaacgngagtcacctatcactgccgggcacgtcgacggccatccgagcgtattcttaagcctggtacgctagcagaaaaccgngggccgtacgccccctacgagtacgtcgttagtctaagtcggtanacctacttaccgaacgtatcgacgtaagggtcggtcccagtccgtaggttcaaggtcggactaagtgaccagtaccgtggggaactagtaacgttactactacttaccgaacttagaccgtaacgacgtaccgtccgttcgaccacgtctacggaagtactttttacgaattaacgttattacgtacgtacaacgtagttaacttactacgtaccctaggtacggtacgttacggcgtaacgggacgaaggtacgaagtactaaccggactaggacgtcgtacgtacc

SEQ ID NO: 216753 - DNA, 602 bp, Homo sapiens
  misc_feature: GYAE6OF02F65ZV.1.34.D01.1.454.CMB.1.raw
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagttgagacagagtcaccatcacttggccgggcgagtcgacggccatcagcgtattctttagcctggtgcagcagaaaccagggacacgcccctanagatcgtagtctagtcggtncatccagtatgacgtaagggtcgggtacccagtccgtaaggttcgaaggtcggactagtgactagtcgtggggaacaggtacttaacacttacnctactancagacacgtcctacgcaacgtccgtaggtaaagttagtttgaacgtttaaatttacttacttacggtaacctaagtaacttaatttactaaccgttaacccggtacgttcggtaaccgttccggacgggtaacggtaccggaaggttaggaaaccgtaccgtaaccggaacggttcgtacggaccgtagtacccg

SEQ ID NO: 216754 - DNA, 566 bp, Homo sapiens
  misc_feature: GYAE6OF02G1F91.1.34.D01.1.454.CMB.1.raw
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
  modified_base (560)..(560): a, c, t, g, unknown or other
  misc_feature (560)..(560): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttgccgggcgagtcaggccatcagcgtattcttagccttggttgcagcaagaaaccgagggcgacgcccctcagatcggtagtctagttgggtcgcactccagtattggacgtaaggggttccgggtcccattaccgaggttacgagtcggcgagtcgcagtcgtggggaactaggtacttaaccncttctctactatcagcagcccngaccacgtccagtaacgttatttagacttaaattttacttactacgtacaattagttaattactacgtacccttagagtaccgttacggcgaaggggaccaagggtacgtaacgtaccgtaacgacgttggtacgtcncgtacc

SEQ ID NO: 216755 - DNA, 517 bp, Homo sapiens
  misc_feature: GYAE6OF02GD84H.1.34.D01.1.454.CMB.1.raw
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagccttggttgcagcagaaaccagggcgagcccctcagatcgtagtctatggtgcatccagattgcaaggtggggtcccatccaggttcagtggcagtgcatctgggacagacttacactctcaactatcagtcagcctgacagcctgaatatttgactaatttattaactgtacaanagtattaatacgtaccctagtcggacgttacggccgtaggggaccaaggtagaacgtcgaaccgaactgtggtactaggacacctagtctcgttcttaccattccgtaccctaccccg

SEQ ID NO: 216756 - DNA, 582 bp, Homo sapiens
  misc_feature: GYAE6OF02HJNKT.1.34.D01.1.454.CMB.1.raw
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (414)..(414): a, c, t, g, unknown or other
  misc_feature (414)..(414): n is a, c, g, or t
  modified_base (456)..(456): a, c, t, g, unknown or other
  misc_feature (456)..(456): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagacgtcaccatcacgttggccgggcgagtcaggccatcgagcgtattctttagcctggttncagcaagaaaccgagggcgacgcccctanagtactcgtagtctagtggtgcatccagtattgcgtaagggtcgggtcccagtccgtaggttcaggtggctaggtgcattcgtagggactagtattactactactcaacgtatcagcagtccngcacgtcctagaagttatttcgaacttaagtttacttacgtntaactaacgtagttaactttaactaaccgttaccccttaggtaccggtaccgtttcgggaaccggtacgggtaacctaagggtacgtaacgtaccgaacccggtagttcggacgtcgacgtaaccg

SEQ ID NO: 216757 - DNA, 737 bp, Homo sapiens
  misc_feature: GYAE6OF02JS79J.1.34.D01.1.454.CMB.1.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
tcagacgagtgcgtcacgaccggtgctcgatttagatcgtctgtgttgggtttgggggagtcagaccctgtcaggacacagcatggacatgagggtcccgctcagctcctggggctcctgctgctctggctccaggtaccagctgtgacatccaattgaccctagtcctccatcctcctgtctgacatctatgganacagacgtccaaccntcaacgttcggccggggntagtcaggcccatcgagcgtattacttacgccgttgggttcacgtacgcgtaaacgaaccggagggtacgaccgtaccccgttagaacgttacgttacggtaacgttccgttaaggtcgggtactacgtaacttacccgtaaggttacgttacggaacggtaacggggttcccgggtaccaacgttccggtaggttacacgggttggacctaggtcggactacgttacgacggggtaactacggtaacttaccgtacttcgtactaacgttactacgacgtaccgtacggtaccgtggaacctacggtacttacggtaactttaacggttttcaacgttttaacgtttacctttacggtacgttaactaacgtttagtttaaaccttacggttaaccgttacccgtaagggttcgtaacccggtttacgggaaccgggttaaccggaacggtaacgggtacggtaaccgtaccggaacgttaccggtggtaccgttgtaccgtacccg

SEQ ID NO: 216758 - DNA, 805 bp, Homo sapiens
  misc_feature: GYAE6OF02HR3I9.1.34.D01.1.454.CMB.1.raw
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcattctagttggagacagacgtacaccatcctacgttcggccgggacgagtcgaggtccatcgagtcgttatttcgttacgcgttggtcncacgacgaacgaaaccggnggacgaccgcccctagagtacgtacggtagttcgttaggtcggtacacgtactccgagtacgttcggaacgggtaacggggtccggtaccctacgttaccggtacggttcgtacgggtcgacgtacgtacgctaacggtcggtaacggaacgtaacgtaacgttacctaccgttacctacgtaacttacgacgtacgctaacgtcccgtacgacgtaccgtacgttaaagttaaacgtttacgtttaacgtaaccttttaaatttttaaccggttaacctttaacggtaaaaccgttaaacgttttaacgttttaaaccgtttaacccgttaaaaccccgggtttacccccgtttaaggggtttacccgggttaaccccggggtttacccggggtaaaacccgggtaaaccggggggttaaaccggttaaacgggggttaacggtaaaacccggttaaacccgtaaccgggttaaccggttacgggttacggtaccgttaccgtaccccgg

SEQ ID NO: 216759 - DNA, 732 bp, Homo sapiens
  misc_feature: GYAE6OF02HT75U.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctattggagacagagtcaccatcacttggccgggcgagtcaggccatcagcgtattctttagcctggttgcagcaagaaccgagggcgacgcccctcgagtatcggtagtctagtggtcgcactaccagtattgacgtaacggggttcgggtaccctacgttaccgtaggttccgtaggtcggacgtaggtcgcgtaacgtcgtacggggacaacgtactttacccacttctactacttagtcgacgctaccgccgtacgaccgtacgtacccggttaagtaaacgtttacgtttttacgaacgtttaaacgttttttaacgttaccgttagttaaccgtaaacgttaacgttttaacgttaaaccgttaaacccgggttaacccccgtttacggggttaccgggtttaacccggtttacccggggaacccgggttaacccggggggaaaccggttaagggggtaaccggttaaaccggttaacccggtaaaccccgggttaacggtttccgggtaaccgggtaccgttaccggtaaccccgg

SEQ ID NO: 216760 - DNA, 600 bp, Homo sapiens
  misc_feature: GYAE6OF02GBFOK.1.34.D01.1.454.CMB.1.raw
  modified_base (102)..(102): a, c, t, g, unknown or other
  misc_feature (102)..(102): n is a, c, g, or t
  modified_base (222)..(222): a, c, t, g, unknown or other
  misc_feature (222)..(222): n is a, c, g, or t
  modified_base (594)..(594): a, c, t, g, unknown or other
  misc_feature (594)..(594): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctatggagacagagtcacatcacgttcgccgggnagtcaggccatcagcgtattcttagcctggttcgcagcaagaaaccagggcgacgcccctagagactcgtagctagtggtgactatcccaagtacttgacgtaacgggtcgggtcccagtccgaggttcaggtcggacaggtcgacgtagttcgtggggaacctaaggtactttaacgacctttaccgactaacttactacacggtccaaccggtcctgggcctaacgccgttaagtaagttcttttacggactttaaatttacttaacgtgtactaagtacgttaattactaacgtaccccgttagtcggtacgttaccggacggtaacggacgtaagggtacgaagtacgaacgttacgaggtcggtacngtaccg

SEQ ID NO: 216761 - DNA, 682 bp, Homo sapiens
  misc_feature: GYAE6OF02I9439.1.34.D01.1.454.CMB.1.raw
tcagacgagtgcgtcacgaccggtgctcgatttagatcgtctgtgttgggtttgggggagtcagaccctgtcaggacacagcatggacatgaggtcccgctcagctctgggctcctgctgctctggctcccaggtaccagctgtgacatccaaattgacccagtctaccatcctccctgtctgcatctattggatacgagacgtcaaccgatctacttggcccgggtcgagttccaggccgtatcgagcgatttcttagccttggttcgcgagtccgaacgtaaaccgaggggaccacgccccgtacgtaagtactaccggtaaggttcctaagtcgggtagactacgtaccgagtaacgttcggacgaagggttaccgggtaccctaagtccgtaggtttccaaggttggacgtacggttgactaagtcggtacgggactaaggtacttaccgacttacgtacctaacgtactaccggtagaaccacggttaccgtcggaacgtaccggcttaagggtaaactttctttacgacgtttaaacttttaacgttcttacggctaacgccgtaacggtaacgctaacggttcctacggtccttaccgtcgttaccggttaccggggacggttaccgggacccttaggggtcgaaacgttaccggaactaaacggttcgtacggg

SEQ ID NO: 216762 - DNA, 652 bp, Homo sapiens
  misc_feature: GYAE6OF02GQAMT.1.34.D01.1.454.CMB.1.raw
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatccaaccatccacgttgccgggcgagtcaggccatcagcgtatttcttagcctggttgcagcagaaaccngggcgacgcccctnagtatcgtagtctagtggtncatccgagtatgacgtaaggtcgggtcccagtccgaggttcacggtggactagtcgactagttcgtgggaacgagtataccgtaactccttcaacttcncgtaaagcgtaacgccctaggccctagtaccgtaagtacttagttttaccgactttaaactttacgtttacctagttacctaaacgttaaggtttaacttaacgttaaccgttaaccccgttacggttacgggttaaccgtccggggtacccggaaacgggggttaacctaaacggggttaaccgggtaacgttaaccccggaaccggttaacgttacggggttacggtaccgttacggtaaccccg

SEQ ID NO: 216763 - DNA, 697 bp, Homo sapiens
  misc_feature: GYAE6OF02HS8CF.1.34.D01.1.454.CMB.1.raw
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcattctattggagacagacgtcaccatcacgttggccggcgagtcaggccatcagcgatttcttagcctggtncagtcaagaaaccgngggccgacgcccctagagtacgttacggtagttaccgtaatgggcgtaccaagttccgagtaagtttgaccggtaagggtcgggtacccatcccgtaggttacaggttcggctaggtnaccgtaaggtcgtaggggactagtaacttaccgaacttctaccgaacgtttaagccgaagtccgtaacgtccgtagacccgtaagccgttaaaggtaaggtttacttttacgaacctttaaattttacgtacgtaccgttaacaacgttagttacgttaaacgttccggttaaaccccgttggtaccgggttaccggttaccggaacccgggtaaacgggggtccctaaagggggttacccgtaacgttaacccggttaaacccggtacggtttccgggtacggttccggtaccgtaacccgg

SEQ ID NO: 216764 - DNA, 790 bp, Homo sapiens
  misc_feature: GYAE6OF02I0Z7W.1.34.D01.1.454.CMB.1.raw
  modified_base (224)..(224): a, c, t, g, unknown or other
  misc_feature (224)..(224): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggngagtcgaggccatcagcgatttctttagccttggttcgcagccagaaaaccgaggggcgacgccccctagacgatcgtagtctagtggtgcactccagtacttggacgtaaacggggttcggggtaccccagttcccgtaagggtttctaggtacgggtctaggtcgctacgtacggtgggaacaggtacttaccaacttctactaactatctaacggactacgtcccgtgaccgtacgtcccgtaggtaaacggtttcgtttttacgaacgtttaaactttttaacgtttaaccgtttacggttaaaccgtaaactttaacggtttaaacttttaaaccgttttaaacccggggttaacccccttttaacgggggtttaccggggttttaaaccggggtttttacccggggtaaaccccggggttaaaccgggggggttaaacccggttaaaacggggttttaacccggggtaaaaccggggttaaacccccgggtaaaacccgggtttaaacccggttaccgggggtttacggggtaccccgtttaccggggtaaaacccccgg

SEQ ID NO: 216765 - DNA, 703 bp, Homo sapiens
  misc_feature: GYAE6OF02HGS7A.1.34.D01.1.454.CMB.1.raw
  modified_base (433)..(433): a, c, t, g, unknown or other
  misc_feature (433)..(433): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatctacgttcggccgggcgacgtcaggccatcaggcgtatttcttacgccgtggttcgcagaccgaaagaaaccggaggggccgtaccgccccctagaagtacgtacggtagtctagtgggtgcatccgagtattgacgtaggggtcggtcccactccgtaggttcaggtcggcgtagtcgacagttcggtagggaactagtaacttaccaccttctactaactanaccgagtaccgacgtccctaggacctacggtacggttagtaaagtttcgttttacgacgttttaacggtttttaacgttacgtacgtaccgtaacggacgttaacgggtaaccgttaaacggcccgttaaccgggtaccgggtttcccctacccgggttccctttaacccgggtttacgggtttacccgggggaacgggggtaaacccgggtaacggttaacggggtaacgggttaaccggaaccggttaaacgaaccgggtttaacggg

SEQ ID NO: 216766 - DNA, 650 bp, Homo sapiens
  misc_feature: GYAE6OF02GJYXC.1.34.D01.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
  modified_base (380)..(380): a, c, t, g, unknown or other
  misc_feature (380)..(380): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctcctgtctgctatctagttgganacagagtcaaccatcacttggccgggcgagtcaggccatcagcgtattcttagcctggttncagcaagaaccgngggcacgcccctagagactcgtagtctagtggtcnctactccgagtacgttgacgtaaggggtcgggtacccagtccgaggtttcgaggttcggctaggtcgactntacggtcgggaactagtaattaccgaccttcgtactacttactacgacgtaccgacgtcctaggacctagtacccgtaaggtaatttcgttttaacgaacctttaagttttacttacgttacggtaacctaaacgttaacgtttaattaccgttaaccggtttaaccccgttgggttaccgttaccgggttcccggaacggtaacgggggtaaccctaaggggtaggtaaccttacggaacccgttaaggtggtacggtctacgtacccg

SEQ ID NO: 216767 - DNA, 638 bp, Homo sapiens
  misc_feature: GYAE6OF02H89NG.1.34.D01.1.454.CMB.1.raw
  modified_base (128)..(128): a, c, t, g, unknown or other
  misc_feature (128)..(128): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (331)..(331): a, c, t, g, unknown or other
  misc_feature (331)..(331): n is a, c, g, or t
  modified_base (374)..(374): a, c, t, g, unknown or other
  misc_feature (374)..(374): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctntggctcccaggtaccagctgtgacatccaattgacccagtctccatcctccctgtctgcatctattggagacagacgtcaaccatcctacgttcggcccggggcgagtccaggccatcgagcgtattcgtttagcccgttgggtttgccaggcaacggtaaaaccgngggccgacgccccctanaggatcggtatctagtggngcactccgagatgcgaagggtcggtaccctagtcgtacggttnaaggtggcgtagtgactagtcggagggacaagtacttaccacgttacactaactagtcgacgtaccagtccctgacgaaccgtcgtaagtaacgtgttttacgaacttaattttaataccttagaacttaacgtagtttaaactttacggtaacccgttacccgtagtacgggtacggtttacccggacggtaaccggggaacgttaacgggaccggtaaaggttaccaaaccggttagtccggtagggtacctccgtaacccg

SEQ ID NO: 216768 - DNA, 574 bp, Homo sapiens
  misc_feature: GYAE6OF02IG1OD.1.34.D01.1.454.CMB.1.raw
  modified_base (197)..(197): a, c, t, g, unknown or other
  misc_feature (197)..(197): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
  modified_base (430)..(430): a, c, t, g, unknown or other
  misc_feature (430)..(430): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctcctgtctgcatctattgganacagagtcaccatcacttggccggcgagtcaggccatcagcgattcttacgctggtgcagcaagaaaccgnggcacgccctnagatcgtagtctagtcggtnctactcgagtacttgacgtaaggtcgggtacccagtccgtaggttcaggtcggactaggtcacgtacgtcgtagggactaagtacttacacgtctacacttatcaagcacgctagctagcctagaacgttntttgaatttaatttactacgtcgtaacaactagttaacttaacgtacggttaaccctaggtcggtaccggttccggaaccggtaacgggacgtaaacgggtacgaaacgtccgaaaccggtacttgggtaccgcgttacgaacc

SEQ ID NO: 216769 - DNA, 628 bp, Homo sapiens
  misc_feature: GYAE6OF02FKX1D.1.34.D01.1.454.CMB.1.raw
  modified_base (373)..(373): a, c, t, g, unknown or other
  misc_feature (373)..(373): n is a, c, g, or t
  modified_base (465)..(465): a, c, t, g, unknown or other
  misc_feature (465)..(465): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacagatcaccatcacttggccgggcgagtcaggccatcagcgtattctttagccttggttcgcacgcaacgaaaccgaggggcacggcccctacgagactcgtagtctagtggtcgacacgtccagtattgacgaagggttcgggtaccccagtccgtaggttctacgttggacgngtcgacacgttcggtagggacaagttaacttaccacttcgtactacgtacctacgacgacgacgtcctagccgaccgtcgtagtaacgtttntttagtacttaagttttacttacgttactaacgtaattaagttaactttacgtaaccttaaccccgttaggtaccgggtacggttaccggaaccggtaacggggaaccgtaagggtacggtaacgtaaccgaaccggtaacgttggacgtcgtacgtaacccg

SEQ ID NO: 216770 - DNA, 610 bp, Homo sapiens
  misc_feature: GYAE6OF02J13NP.1.34.D01.1.454.CMB.1.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
  modified_base (365)..(365): a, c, t, g, unknown or other
  misc_feature (365)..(365): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagatcaccatcacttgccggnagtcaggccatcagcgtattcttagcctggttgcagcagaaccgagggcacgcccctnagtactcgtagtctagtggtcgcagtccagtattcggacgtaagggtcgggtccctaagtccgtaaggttccgagtcggactaggttncgtacgtcgtagggacaggtattacaccttctacgtaccttaatccgtaacgccgtagcccgttgaccgtacgtacccgttaggaacgtttactttcggtaacttaagttttaacgtaccgttcgtaacctaacgttagttactttacgacgttacccctaggtcggtacgttacccggcggtaacgggtacgtaagggtagaaaccggtccgtaaaccggagttcggacggtactcgtaacccg

SEQ ID NO: 216771 - DNA, 765 bp, Homo sapiens
  misc_feature: GYAE6OF02INOPG.1.34.D01.1.454.CMB.1.raw
  modified_base (223)..(223): a, c, t, g, unknown or other
  misc_feature (223)..(223): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagactcaccatcacttggccgggnacgtcaggccatcagcgtattctttacgccgttggttcgcgtagcgaaacgtaaccggagggccggaaccgcccccgtacaaggacgttacggtacgttacgttaacgttcggtcggtacctaacgtcccgaaggttacgttcgggaaccggtaaaggggttccggggtaccctaacgttacccggtaacgggttcgaacggttcggaccggttacggtacggtacccgtaacggttccgggtaaccggtaacgtaacgttaaccttaaccgttacctacgtaaccctacgttactaccggtacgaccgtaaccgtcgtaccgtacgaccgtaacggttaacgtaggttttaactcggttaaaccttttagtttaaccgttacgttccttaaagttaccgttaagtttaaccttaaccggtaaccgtttaccggttaacggtacgggttacccggtaccggaaccggggtaaccggtacggtaacgggtaagtaaccgtaccggtaaaccggcggtttcgggacgttccggacgttaacccg

SEQ ID NO: 216772 - DNA, 690 bp, Homo sapiens
  misc_feature: GYAE6OF02JCI8C.1.34.D01.1.454.CMB.1.raw
  modified_base (228)..(228): a, c, t, g, unknown or other
  misc_feature (228)..(228): n is a, c, g, or t
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctcctgtctgcattctattggacgacagacgtcaccatccacttcggccgggngagtcacggccatcagcgtactttctttagccttgggttcgacacggcaaggaaacccgnggggccgaccgtcccctcgagtactacggttagtcttagtgggtcgacctatcccgaagtattacggacgtaacgggggttcggggtaacccctaggttacccgtacgggtttaccaggggttcggacgtaacggttcgtactaggtcggtaacggggactaaggttaacttacgtacttccgtactaacgtacgtcgaacgcaccgcgtagccacggtaccgtagtaacgttagttttgaacgtttaaatttcgtaccgtagttaccaacgtttattaactttacggaaccgtttacccgttagggttacggtaaccggtttccgggaccggtaacggggttaaccgtacggggtcggttaaaaccgccgttaacggaccgttgggacgtcggtagtaccc

SEQ ID NO: 216773 - DNA, 708 bp, Homo sapiens
  misc_feature: GYAE6OF02JZD6M.1.34.D01.1.454.CMB.1.raw
  modified_base (268)..(268): a, c, t, g, unknown or other
  misc_feature (268)..(268): n is a, c, g, or t
  modified_base (329)..(329): a, c, t, g, unknown or other
  misc_feature (329)..(329): n is a, c, g, or t
  modified_base (574)..(574): a, c, t, g, unknown or other
  misc_feature (574)..(574): n is a, c, g, or t
  modified_base (629)..(629): a, c, t, g, unknown or other
  misc_feature (629)..(629): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctaccatcctccctgtctgcattcgtattggagacagagtcaccatcacgttgccgggcagtcgaggccatccgagcgtaatttctttacgcctggttancgagcaacggaaaccgagggcaccggcccctagacgtacgtgtaacggttcctagtgggtnactacgtccaaggtattcggacgttaaacggggtcgggttaaccccaggtttacccgagggtttaccagggttacggaccggtaaggttcgacgtaacgttcggtaccggggtacctaaaggtttacctaacccgtcctttaacttaccgtaaccgtacttaaccgacgaccggtaccgtcccgttaggaaccctcgtaaccgtagtaaaccgtttatttttaccgaatttaaaccgttttttancgttaaacgttcgaaaccgttaagttacttaacgtaacccgttacccgttaacgngggtaaccgtttcggaaccggtacgggtaagtaacggtagtaaacgccgttaaaccgagttcggtacggtccagtaccg

SEQ ID NO: 216774 - DNA, 715 bp, Homo sapiens
  misc_feature: GYAE6OF02GP6KL.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtgacatccaattgacccagtctccatcctccctgtctgcattctattggagacagacgtcaaccatccacgttcggccgggcgagtcgacggccagtcagcgtatttcttagccgttggttcgcagcaagaaaccgagggacgaccgccctacgagtacgtaccgtagtacgtagtggtgctactccgagtagtacggacgtaaggggtccgggtcccacgtacgtacggttcgaaggtcggacgtggtcgactagtcggtaggaacgtagtacgttaacaccgtcttactaaacgttatccgaagccaccgtccgtagaccacgttaccgaagttaacggtttctttaaggaacctttaagttttaactacggttactaacgtaaacgtttacggttaacttaaccggtttaaaccggtaccccggtttaagggttacgggttaaccccggtttacccggggtaaccggtaaaaccgggggttaaccgtaacgggggttaaacggttaacccggttaaacccgaacggggttaaccttcggggttacccggtacgtaccggtaacccg

SEQ ID NO: 216775 - DNA, 758 bp, Homo sapiens
  misc_feature: GYAE6OF02F6CQW.1.34.D01.1.454.CMB.1.raw
  modified_base (434)..(434): a, c, t, g, unknown or other
  misc_feature (434)..(434): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccactccctccctgtctgctatctagttggagacagacgtaccacctatcctacgttcggccgggacgacgtcgacggaccatcgagtcgtatttccgtttacgccgttaggttcgacacggaccgaacggaaaccgacgggaccgaaccgtcccccgtagaacggtacgttaccggtacgttaccgttagttcgggtacgtactagtacccgaggttgtacggtacggtacggggtccgggtacctacgtacgtacggtacgnggtacgcgtacgtcgtacgacgttggacgtactacgtacttacgtacctcgtaacctacgtactacgacgcgtacccgtaccgcgtaaccgtacggtacgttaagttaaccgtttatttaccgttaattttaacgttaacctttacgtaacgttaaacgtaacgttaacgtttaaccgttaaccgttaacccgttaccgggttacggttacccggttacgggtacccgggtaacgggttaaacccgggtacgggttaacggttaaccggtaaccggttaacccgtaacggttacgggtccgaccggtttccgaacggttacccg

SEQ ID NO: 216776 - DNA, 753 bp, Homo sapiens
  misc_feature: GYAE6OF02IC556.1.34.D01.1.454.CMB.1.raw
  modified_base (101)..(101): a, c, t, g, unknown or other
  misc_feature (101)..(101): n is a, c, g, or t
  modified_base (188)..(188): a, c, t, g, unknown or other
  misc_feature (188)..(188): n is a, c, g, or t
tcagacgagtgcgtcacgaccggtgctcgatttagatcgtctgtgttgggtttgggggagtcagaccctgtcaggacacagcatggacatgaggtccccgntcagctccgtgggctcctgctgctctggctcccgaggtaccagctgtgacatccaattcgaccctagtcctccattccctcctgtcngcatcctagtcggagacagtacgtccaccgtacttcgacgttcgggaccggtaccggtaataccgacggtaccacgttacgacggtcgttaacgttttcgtttaacggtccttggttcgccgacgtaacgaaacgtaaccggacgggccgaccgtcccccgtacgaaggtacgttacggtacgttctacggtaggtactaccgtacgtaccgtaagtacgtcggtaccggtaaggggtaccggtcctaacgtcccggtaaggtttccgaagggtacggtacccgtagttaaccgtccgtagttacccggtagggtacccttaaaggttacttaaccctacgttaccttaccgtaaacgttaacgttaccgaacggaaccgttaccgtcgtaaccgtacccgggtaactacccggtaaggttaacttacgttttaaccgtatttaacgtttaaacttcgtaacttaacgaacgttagttaactacgtaaccgttcccgtagtacgtacgtcggacgtacggtaacgtaggtacgacgtacgaacgtctaggtacgtaccagtaccg

SEQ ID NO: 216777 - DNA, 687 bp, Homo sapiens
  misc_feature: GYAE6OF02F3OYJ.1.34.D01.1.454.CMB.1.raw
  modified_base (101)..(101): a, c, t, g, unknown or other
  misc_feature (101)..(101): n is a, c, g, or t
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatgaggtccccgntcagctcctgggctcctgctgctctggctcccaggtaccagctgtgacatccaattgacccagtctccatcctcctgtctgcatctatgganacagagtcaccatcacttgccggngagtcaggccatcagcattacttagcctggttcgcagcagaaaccngggaccgagcccctnagactcgtagtctagtggtgcatccagtattcggacgtaagggtcgggtacccagttccggtaggttccgaggtcggactaggtcgaccgtacgtccggtaggaactaggtaactttaaccgaccgttaccttaccaaccttagtaccgtaacggacctacggtaccctttaggaccgtacgtacccgtaaggtaacgtttaattttaccggaactttaaagttttaacgttaccgtttagttaaccgtaaaccgttagtttaacctttaaacgttaacccggttaaccccgtacgggttacggaccggtttaccgggtaacccggtaacgggggtaaaccgtaaggggtaccgtaaacggttaaccgaacccggttaacgttcgggtacggttaccgtacgtaacccg

SEQ ID NO: 216778 - DNA, 702 bp, Homo sapiens
  misc_feature: GYAE6OF02GKSL2.1.34.D01.1.454.CMB.1.raw
  modified_base (143)..(143): a, c, t, g, unknown or other
  misc_feature (143)..(143): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccngctgtgacatccaattgacccagtcctccatcctcctgtctgcatctattggagacagagtcaaccatcacttcggccgggcgagtacaggaccaatccaaggcgtagtttaccttttagcccgttggttcggaccagacgaaggaaaacccgagggtaccgaacggtccccctacgaaggacttccggtacggttccgtaagttgggtcgactattacccgaaggtactttacgacgtaaaggggttcggggtacccctaagtaccgtaaggttccgaagggtcggactagggtcgtacgtacgttcgtacgggaactaggtacttaactaccttcgtactacttataccgtaagacgtaagtccgtagccgactcccgtaagacgtttaagttttcgaacttaaattttacgttaactcgtaaccaaacgttagttaacttaacgttacttaacccccgttaggtaccggttcggttaccggaccgggtaacgggaaccggtaaggtaggtaaacggtccgtaaaccgaccggtagttacggacgttactaacccgg

SEQ ID NO: 216779 - DNA, 816 bp, Homo sapiens
  misc_feature: GYAE6OF02IT258.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtgaccaaatgtgacatccaattcgacccagtctccatccctccctgtctgcatctagttggagacagacgtcaccatctacgttcggccgggcgagtcaggccaatcagcgtattcttacgccgtggttcgacgtacgacgaacggaaaaccgcgggaccgaccgtaccccctagaacgtacgttaccggttagtaccgtaagtcgggtcgacctacgtaccgagtagttaggaaccggtaacggggttcgggtacccctaaggttacccgtaggttacgtaggtcggtacgtaggtcgacgtacgttacggtagggaactacgtaacttacgtacctaccttacacttatcgtaacggctacgccgtagaccgtacgtacgtaacggtaagttacgttttacggaaccttttaaagtttaaccgtttaccgtaacgtttaaccgtaaaacggtttaacgtttaaaccttttaaccggttaaaccccggtttaaccccggtttaaccggggttaccggggttacccgggtttaacccgggggtaacccggggtaaaccgggggttaaaaccccggttaaacggggtttaaaccggggtaaaccgggttaaacccgttaaacccggggttaaacggttaccgggtttacccgggtaccgtacccgggttaaaccccgg

SEQ ID NO: 216780 - DNA, 713 bp, Homo sapiens
  misc_feature: GYAE6OF02IWWQ0.1.34.D01.1.454.CMB.1.raw
  modified_base (237)..(237): a, c, t, g, unknown or other
  misc_feature (237)..(237): n is a, c, g, or t
tcagacgagtgcgtcacgaccggtgctcgatttagatcgtctgtgttgggtttgggggagtcagaccctgtcaggacacagcatggacatggagggtccccgctcagctccgtggggctcctgctgctcgtggctcccaggtaccagctgtgacatccaattcgacccagtcctccatccctcctgtctgactatctattggagacagtacgtccacatcctacgttcggccggganacgtccacggccatccgacgtcgtacttcgttacgtccgttggttcgtcgacgacgaacggaaaccggacgggaccggtaccgaccccgtacgacgtacgtacggtacgtacgtagtcggtcgcctacgtaccgagtactcgggggggggggggggggactaacggggtacgggtaccgtacgtccggtacggttacgtacggtacggtacgtacggtacgtacgtacgtacggtacgggtacgtaagtaacgttacgtactctaccgtactactacgtacgtacgacgtacctcgtacgtacgacgtagtaagtattacgtacgttaactttacttacgttagtacgtaacgtacgttaacgttacgttaaccgtaccgttacgtacggtaccggttaccggtaccggaaccgggtacggtaacgggtacggtaacggtaccgtaacggtacgtacggtacggtacgtcgtaccg

SEQ ID NO: 216781 - DNA, 682 bp, Homo sapiens
  misc_feature: GYAE6OF02H9H2P.1.34.D01.1.454.CMB.1.raw
  modified_base (494)..(494): a, c, t, g, unknown or other
  misc_feature (494)..(494): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcattctaagttggagacagacgtcaacctatccacgttggtccgggcgaagtcaggccatcgagcgtatttcttttacgccgttggttcgctaaggcaaacggtaaaccgaggggccgtaacgcccccgttagacgtacgttcggttaagttccgttaagtcgggtcgacctaacgttccgaagtacgttcggacggaaggggttccgggtacccagtttccgaggtttacgaggtcggactagggtcacgtagtccggtaggggtaactaagtactttaaccgtccgttaacctaccgtaaccttaacncgaacgtacgaccgtacctcggacctaggtaccctagtaaagttcttttacgactttaatttacgtttactagtactaatacgttaattactaaccgttacccgaggttacgtccggttacggaccggtaacggacgtaagggtacgaacgtaccgtaaccggtaacgttcggtagccgttacgaccg

SEQ ID NO: 216782 - DNA, 726 bp, Homo sapiens
  misc_feature: GYAE6OF02II64T.1.34.D01.1.454.CMB.1.raw
  modified_base (545)..(545): a, c, t, g, unknown or other
  misc_feature (545)..(545): n is a, c, g, or t
tcagacgagtgcgtcacgaccggtgctcgatttagatcgtctgtgttgggtttgggggagtcagaccctgtcaggacacagcatggacatggagggtccccgctcagctccgtgggctcctgctgctcgtggctccaggtaccagctgtgacataccaattcgacccagtcctccatccctccctgtctgcatcgtatggagacagatcaccatctacgttgccgggacacgtcacggccatcgagtaccgatttcttacgtccgtggttcgacacgacgaacgaaaaccgagggaccgaaccgccccgtacagtacgtacgtaacgtcctaagtgggtacacctactccgtaagtacgttacggacgtaacggggttacggacccgtacgtaccgtaggttcgaacggttggaccgtagttacgacgtagttaccgtacgggaactaacggtactttaaccgtactaacccttactaaccgttaacttacgacggaaccttccgaccgtacgttaccgaccggtacctaagggtaaaccgtttnttttaacgtaccgtttaaagttttacgtaaccgtttaacgtaaccgaaccgttaagttaacgtttaaccgtaaccgttacccgtaacgggttacgttaaccggttaccggcgaaaccgggttacccgtaaaggtaccggtaaacgtaccgaaacccgtaggtaggtaccgtgtaccgaacg

SEQ ID NO: 216783 - DNA, 628 bp, Homo sapiens
  misc_feature: GYAE6OF02HJK6D.1.34.D01.1.454.CMB.1.raw
  modified_base (197)..(197): a, c, t, g, unknown or other
  misc_feature (197)..(197): n is a, c, g, or t
  modified_base (369)..(369): a, c, t, g, unknown or other
  misc_feature (369)..(369): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagtgganacagagtcaccatcacttgccgggcagtcaggccatccagcgtattctttagcctggttgcagcaagaaaccgagggcgacgcccctcagtactcgtagtctagtgggtgcatccgagtattgacgtaaggtcgggacccagtccgaggttcagtggcagtgcatcgagganaagtacttacactcgtacaacttactcgaacgtcaacgtccgtgacgaccgtaccgtaggtaaacgttattttacggtaaccttaaatttttacgttaaccgttaggttaaacctaaacgttaacgttttaaacgttaacgttaaacccggtttaaccccttaagggtacgggttaccgtttacccgggaccgtaacggggtaaccgtaaaggtaccggtaaacgtacaaaacggtcgtacggtggtaccgtagaaccg

SEQ ID NO: 216784 - DNA, 713 bp, Homo sapiens
  misc_feature: GYAE6OF02H57GN.1.34.D01.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
tcagacgagtgcgtcacgaccggtgctcgatttagatcgtctgtgttgggtttgggggagtcagaccctgtcaggacacagcatggacatgagggtccccgctcagcctccgtggggctcctgctgctctggctcccaggtaccagctgtgacatccaattgacccagtctccatccctcctgtctgcatctattgganacagagtcacatctacttggcgggtnacgtcaacggcatcgagcgtattcttacgcttggtncagacaacgaaccgngggccgcgaccccgtnaggtactacgtacgttctagtgggtnaccataccgtagtattcgggaactacgggggttcggaccctactaccggtaggttcaggttacggctagtcgctacgtggtacggaacagtacgtactacgtactactaacgtactacacgaccagtcccgacgtacgtaccgtaccgtaaggttaaacgtaattttaccgtacttaaacgtttttaactacgttacgtaaaccgtaacttaagtttaaacgttaacttaaccccggtttaaaccccggttcggttacccggggtttaaccggttaccccggggtaaccgggtaaaacccgggacggggttaaaacggttaaccggggtaacggttaaaccccgtaaaaccgggtaaccggttacggggtacggtacccgtttaaccggaacccg

SEQ ID NO: 216785 - DNA, 501 bp, Homo sapiens
  misc_feature: GYAE6OF02FU1E6.1.34.D01.1.454.CMB.1.raw
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgattcttagcctggttgcagcagaaaccagggcagcccctnagatcgtagtctatggtncatccagattgcgtaaggtcgggtacccatccgaggttcaggtggcagtcgcatcgtgggacagacttacactctacactatacagcagcctgcagcctagaatatttgacttaatttatactgtacaatataattatacgtaccctagtgacgttcggcgagggaccgaaggtagaacgtacaaccggaacgtgtcggctgacc

SEQ ID NO: 216786 - DNA, 811 bp, Homo sapiens
  misc_feature: GYAE6OF02IP8FD.1.34.D01.1.454.CMB.1.raw
  modified_base (337)..(337): a, c, t, g, unknown or other
  misc_feature (337)..(337): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacataccaattcgacccagtcctccactccctccctgtctgctattcgtattggacgtacagacgtcacctatccacgttcggccgggcagtcgacgcatacgagctacttcgttacgccgttggttcgcacgacaacggaaaccgagggccgaccgcccctagagtctcggtagtctagtggtacnctatccgagtagttagacgtacgggtcggtacccagtccgtaggttacgtacggtcggtacgacggtcacgtacgttcggtagggaactacggttaacttacgtaaccgttcctaactaacgttctaaacgtacggacctacggaccttcggaaccgtaaccggtaacccggttaaagttttacgtttacggtaaaccttttaaacgttttaacgttaaccgttaacgttaaccgtaaaacggtttaacgtttaaacgttttaaccggttaaaacccggttaccccggtttaaagggttccgggtttaacccgggtttacccgggggtaaacccggggttaaaccgggggttaaaccggtaaccgggggtttaaaaccgggtaaaccggtttaaaaccccggggtaaacccggtttaagggtttacccgggtaaacggggtttcccgtaacccggggttaccccttaaacccgg

SEQ ID NO: 216787 - DNA, 581 bp, Homo sapiens
  misc_feature: GYAE6OF02GCL7G.1.34.D01.1.454.CMB.1.raw
  modified_base (258)..(258): a, c, t, g, unknown or other
  misc_feature (258)..(258): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccttggttncagcagaaaaccgagggcacgccccctcagatcgtagtctagtggtgcatccagtattgacgaagggtcgggtcccagtcaggttcaggtggcagtgcntcgngggacagattacnctctacactatcagcacgtcctgcacgctaggtaagttnttttacgactttaattttacgttacttcgttaacaacgttaatttaattaacttaacgttaccccttagggttacggtaccggttacgggacccggtaacggggtaaccgtaaggggttaccggtaacggtaccgaaccgaacgttcggtacgggtaccttcggaccc

SEQ ID NO: 216788 - DNA, 769 bp, Homo sapiens
  misc_feature: GYAE6OF02H3QW9.1.34.D01.1.454.CMB.1.raw
  modified_base (376)..(376): a, c, t, g, unknown or other
  misc_feature (376)..(376): n is a, c, g, or t
  modified_base (455)..(455): a, c, t, g, unknown or other
  misc_feature (455)..(455): n is a, c, g, or t
  modified_base (542)..(542): a, c, t, g, unknown or other
  misc_feature (542)..(542): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctcgtggcctcccgaggtaccagctgtagacactcctaattcgacccagtcctccacttccctccgtgtcctcgatatctagttggaagacagtagtacacctatccgtacgttcgggccgggacgtaacgtccgaaggtcccaagtcacggactaacgtttcgttagtccgttgggttacaccgagaccgaaacgtaaacggcgggaccgtaacggcccctagagacgtacggtagtacgtagtcggacnccgtacttaccgagtacgttcgacggtaaggggtccggtaccaacgtacggtaaggtcctagggtcggtacgagtccgngtaacgttcggaacggactaaggtacctaactttccgtaaccgtactaaacccgttgtaaaccacggtaccaagggttccccgtaanaacggtaccgttaagttagttaaacggtttagtttaaccgtaactttaaaggtttaacgttacgtacgtaaacgttaactttaacgtttaaacgtaaacgttaacccgtttaacggtacggttaccggtaacggtaaccgggaaaccggaaccggttaacgggaacgggttaacgtaccggtaacctaaccgggttacgtacgggttacggtacccgtacgtaaccg

SEQ ID NO: 216789 - DNA, 662 bp, Homo sapiens
  misc_feature: GYAE6OF02GSJ1E.1.34.D01.1.454.CMB.1.raw
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
  modified_base (405)..(405): a, c, t, g, unknown or other
  misc_feature (405)..(405): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcggccgggcgagtcgaggccatcagcgtattcttagccttgggttncagcaagaaaccgagggcgacgcccctnagtacgtcgtagtctagtggtncatcagtatgacgacgggtcgggtacccagtccgtagttcgaggtggctagtcgaagtcgtaggactaagtacttactacttctactaactancgaacgcgtacgtccgtgtaccgacgtaccgttagtaaagtttacgtttacggtaactttacttttaacgttaaccgttacgtttaaacgaaacgttaagtttaactttaacgttaacccggttaaccccgttaacggttaaccggggttaccgttacccgggaccgggtaacgggggtaaacccgtaagggggttagtaaacccgtaccgaaacccgtttacggttcggtaacgggttcgtacgacccgtaaccgg

SEQ ID NO: 216790 - DNA, 871 bp, Homo sapiens
  misc_feature: GYAE6OF02JG0O2.1.34.D01.1.454.CMB.1.raw
tcagacgagtgcgtcacgaccggtgctcgatttagatcgtctgtgttgggtttgggggtaggtcgagacctgtcaggacacagcatggacatgaggtcccgctcagctcctgggctcctgctgctcgtggctcccaggtaccagctgtgacatccaattgacccagtctccatcctccctgtctagcatctattggacacagtagtcaacctatcaacgttcggcccgggtacgaacgtcacgggacccatccgagcgtagtttacttacgaccttggttcgcgtacgacgtaacgaaaccgagggaccggaaccgtacccccgtacgaacgtacgtaccggtaacgttaccgttaagttacgggtcgtacctaacgtacccgtaggtactttacggacgtaacggggttccggggtaacccctacgttaaccggtagggtttaccgtaacgggttacggggtaccgtaaacgggttcggtaaaccgtaacgtttaccgggtacgggggtaaaccgttaaggtaaacccgtttttaacccgaaccggttttaaccctaaccggtaaactttaaccgttacggaaacgtacccgtaaaccggtcccgtaacggtacctaaccggtaacccgttaaggtaaacgttttaacgtttcgtaaaccgtttaaatttttacttaaaccggtacttaacggtaaaacttcgtttaaaacttaacgtttaaacccggttaacccgtttaacgggtacgggtttaacccgttccggggtaaacccggtaaccggggtaaacgggttaaacggttaggggttaaaccaacccggttaaccggtaaaccggttacggtacgggtacccgtaccggtaacccg

SEQ ID NO: 216791 - DNA, 644 bp, Homo sapiens
  misc_feature: GYAE6OF02FEXGU.1.34.D01.1.454.CMB.1.raw
  modified_base (592)..(592): a, c, t, g, unknown or other
  misc_feature (592)..(592): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (605)..(606): a, c, t, g, unknown or other
  misc_feature (605)..(606): n is a, c, g, or t
  modified_base (608)..(610): a, c, t, g, unknown or other
  misc_feature (608)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(622): a, c, t, g, unknown or other
  misc_feature (620)..(622): n is a, c, g, or t
  modified_base (624)..(626): a, c, t, g, unknown or other
  misc_feature (624)..(626): n is a, c, g, or t
  modified_base (629)..(631): a, c, t, g, unknown or other
  misc_feature (629)..(631): n is a, c, g, or t
  modified_base (633)..(637): a, c, t, g, unknown or other
  misc_feature (633)..(637): n is a, c, g, or t
  modified_base (639)..(643): a, c, t, g, unknown or other
  misc_feature (639)..(643): n is a, c, g, or t
tcagacgagtgcgtcacgaccggtgctcgatttagatcgtctgtgttgggtttgggagtcaggccatcagcgattctttagcctggttgcagcagaaccagggcgagccctcagatcgtagtctatggtgcatccagtattgcgaaggtcgggtccatccgaggttcagtggcagtgctatcgtgggacagacttacactctcactatccagcacgtcctgacacgtcctaggaagttattttcgaacttaattttactacgtacgtactaacgtagtatttaactaccggttaaccccgtaggtacggtaccggttacggaccggtaacggggaaccgtaagggtaggtaaccgttcgaaccgggtaccgttaacggttcggtaccggtacttacggacccttaaccttagttcccggttacggttcccctacgttacccgtttcccgttaccccggtaccttaacttcccgggttaaacggaacccgttaccgttaccgggtttaccgtaaccgggttcgggaaccgggtcccgggggttacgtaacggggaacccttacgggacccgtaaagttaacgaggctaggacncgcncancncagnnannncnangngncnnncnnngcnnncnnnnncnnnnnc

SEQ ID NO: 216792 - DNA, 608 bp, Homo sapiens
  misc_feature: GYAE6OF02FRYNZ.1.34.D01.1.454.CMB.1.raw
  modified_base (568)..(569): a, c, t, g, unknown or other
  misc_feature (568)..(569): n is a, c, g, or t
  modified_base (571)..(572): a, c, t, g, unknown or other
  misc_feature (571)..(572): n is a, c, g, or t
  modified_base (574)..(608): a, c, t, g, unknown or other
  misc_feature (574)..(608): n is a, c, g, or t
tcagacgagtgcgtcacgaccggtgctcgatttagatcgtctgtgttgggtttgggagtcaggccatcagcgattcttttagcctgggtttgcagcaacgaaaaccgagggcgaccgccccctcagattcgtagtctagtggtgcatccagtattgacgtaaggggtcgggtcccatccgtaggttcgaggtggacaggtgactatcggtgggacagtacttacactctacactatcgacgcacgcctcgcacgtccgtagaagttattttcgactttaaattttacttacgtgtaccaaactagttaatttaacgtaccgttacccccttagggtacggtaccggttccggaccggaacgggggtaacccgtaaaggggtacgggtaaacgtacccgaaaacccggtaacgttgggtcgccgttcggaacccctaaccgtacgttccgtacgtttccttacctaacgtttccccttaccccgactacttcgaacgtaaccgtcctacgttccgtcggtagggaccgggccgggtacgtcgggaacgacgggcgtaacgacgtagcgnngnncnnnnnnnnnnnnnnnnnnnnnnnnnnnnnnnnnnn

SEQ ID NO: 216793 - DNA, 661 bp, Homo sapiens
  misc_feature: GYAE6OF02GAOFV.1.34.D01.1.454.CMB.1.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggcatggacatgagggtccccgctcagctcctggggctcctgctgctctggctcacaggtaccagctgtgacattccaattgacccagtctccatcctccctgtctgcatctattggagacagagtcaccatcacttgccgggngagtcaggccatcagcgattcttagcctggttncagcagaaaccagggcgacgccccctnagactcgtagtctagtggtncacgtccagattgacgtaagggtcgggtacccagtcccgaggttcaggttcggacaggtgactatcgtcgggaacaggtacttacaacttctaccatactcgagacgtacgcctgccgtagtcccgtagtaacgttatttacgactttaagttttacttaacgttgtaacctaaagtacgtttaattacgttacccgttaccccgttaggttaccgggttaccggttaccggaccggtaaacggggtaacccgtaaaggggttaccggtaaacggtaccgtaaacccggtaaccggtggttaccggtccgttaaccgacccgtaaccgtacgttttaccggttccgttacccgtttacgttacccgtttcccgttaaccccgg

SEQ ID NO: 216794 - DNA, 694 bp, Homo sapiens
  misc_feature: GYAE6OF02IDEV6.1.34.D01.1.454.CMB.1.raw
  modified_base (232)..(232): a, c, t, g, unknown or other
  misc_feature (232)..(232): n is a, c, g, or t
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctccagctccgtggggctcctgctgcctcgtggctcccaggtaccagctgtgacatccaattcgacccagtcctccatccctcctgtctgcactctattggagacagacgtcaccatcacgttggccgggntagtccacggccagtcgagcgtacttcgttagcgtggttcgcagtcaacggaaccgngggccgacgcccctanaacgtcgtacgtagtctagtcggtacgctagtccgagtagttcgacgtaacggggtcggtaccctagtcccgtaggttacgnggtacggctacggtanaccgtagttaccggaggaaccgtagtaacctttccgaacttccgtaacgtaacctacgtaccgaacggtcctaacggtccctaggaaccgtacgtaccgttaacggtaagtttcgtttaccgacttttaaacgttttcgtaaccttcgtaaacctaacgttagtttaactttaacgtacccggttacccttaagggtccgttaccggttaccggacggtaaccggtaaccggtaaggttaacccggaacggttacccgaaacggttcgtacggtaccgacgtacccgtacg

SEQ ID NO: 216795 - DNA, 677 bp, Homo sapiens
  misc_feature: GYAE6OF02FXEAO.1.34.D01.1.454.CMB.1.raw
  modified_base (322)..(322): a, c, t, g, unknown or other
  misc_feature (322)..(322): n is a, c, g, or t
  modified_base (342)..(342): a, c, t, g, unknown or other
  misc_feature (342)..(342): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatccaattcgacccagtcctccatcctccctgtctgcatctagttggagacagagtccaaccatcctacgttcggcccggggcgtacgtacgacggacccatcgacgccgtatttcctttaggccttgggttgcgtagaccaacggaaaccgagggaccgacgccccctanagatcgtacgtcgtagtggncatccgagtagttcgacgtaacggtcgggtccctagtccgtaggttcgagtcggcaggtgctagtcgtacgggacgagtacttaccactccgtacacttactcgtacgcgacgtccgtcgcgacgtaccgtagtaacgttacttttacgactttaaacgttttattacgtacggttaacaacgttaagtttaacttaaccgtttaaccgtaacccgttacggttacgggttacccggttaccgggtaaccgggtaacggggtaaaccgtaacggggttaacgtaacggttaacccgaacggtaaaccggttgggtaccggtcgtacgtaaccccg

SEQ ID NO: 216796 - DNA, 638 bp, Homo sapiens
  misc_feature: GYAE6OF02HZYB1.1.34.D01.1.454.CMB.1.raw
  modified_base (127)..(127): a, c, t, g, unknown or other
  misc_feature (127)..(127): n is a, c, g, or t
  modified_base (320)..(320): a, c, t, g, unknown or other
  misc_feature (320)..(320): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctntggctcccaggtaccagctgtgacatccaattgacccagtctccatcctccctgtctgcatctagttggagacagacgtacaccactcacttcggccgggcgagtcgacggccatcagcgtattcgttagccgtggttgacagacaagaaccgagggacgacgcccctagagactcgtacgtactagtggtcncactcgagtattggacgtagggtcggtacccacgtcgtaggttcaggtggactagtagctacgtcgagggacagtacttaacactctactactacncacgcncgtccgtagccgcgtacgtaagtaagttacttttacgaactttaaacgttttaacgttacgtacgttaacctaaagttacgtttaacgttaaactaccccgttaaccgttaccggttacgggtaccggttacggacccgggtaacgggtaaccggtaacggtacgggtaacctacggtaacccgtaccggttagggtaccgtacgtacgtaacccg

SEQ ID NO: 216797 - DNA, 799 bp, Homo sapiens
  misc_feature: GYAE6OF02H1L5H.1.34.D01.1.454.CMB.1.raw
  modified_base (198)..(198): a, c, t, g, unknown or other
  misc_feature (198)..(198): n is a, c, g, or t
tcagacgagtgcgtcacgaccggtgctcgatttagatcgtctgtgttgggtttgggggagtcagaccctgtcaggacacagcatggacatgagggtccccgctcagctctgggctctgctgctctggctcccaggtaccagctgtgacatcctaagttcgacccagtcctccatcctccctgtctgcatctattgganacagagtcaccatcacttggccgggcgagtcaggccaatcagcgtattcttagccgttggttcgacgagacgaaggaaaccgagggtaccgaccgcccctacgaacggtactacggttaacgtacgttagtggtacgctacgtaccaggtacgtttacggacgtaaacgggggttccgggtaccccgtacgttaccccggtaagggttttccaacgggttagggaccgtagggtaccgtacgtaacgttcggtaacggggaacgtaacggttactttaaaccgtaccttccttaaccgaacttaacgtacgtaaccgactaccggtaccgttacgaccggtacgtacccgttaagtaaaggtttacttttaccgtaacgttttaaacgttttaacgtttaccgttaacgtaccgttaaacgtttaaggtttaaacgtttaaaccgtttaaaccccgtaaccccggtttaggtaccggggttaaccgggtttacccggaacccgggttaaacgggggtaaacccgtaaaggggttaacggtaaacccggttaaccggtaaacccggttaaaccggttagggtaccggtcgtacccgtaaccg

SEQ ID NO: 216798 - DNA, 993 bp, Homo sapiens
  misc_feature: GYAE6OF02ITCSK.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctccgtggggcctcctgctgctctcggcctcccgaggtaccagctgtacgacatacctaagttcgaccctagtcctcctacttccctcccttgtctgactattacgtagtggaagacgagacgtaccaacctatcgtaccgttcgggacccggggtcgaacggttaccgacgggacctaagtccgaacggtccggttaatttccgtttacgtccggtttggttcgacgtacggtaccgaaacggaaaccggacggggtacccgtacccgtacccccgtacggtaacggttacgttaccggttaacggtttacgtttaaggttccggggtctaaccgttaccgtaaccgtaaggtttaccggttaacggggtaaccggttaaccggggggtttccggttaaacccccgtaaccggtttaacccgggtttacgggtttaccggacggggtttcggtaaccggttacggttacccggtacgttaccggtaccgggtttacgggaaacttaaccggttaacctttacccgtaacctaccgttaacctaacggttaccgttacgaaccggtccgtacccgtccgtacggtaacccgttacgtaaccgtttagttaacgttttacttttaacgggttaactttaaacggttttaaccttaacggttaaccgtttaaaccgttaacggtttaacctttaaacgtttaaacccggttttaacccggtaaacccgggtttacgggttacccgggttaaccggggtttaacccgggtacccgggggtaaaacgggtttaacccgggtaaacggggtttaaccggaaaccccgggtttaaacggtaaccggttacccggggttaggtaccccgggtttaccggaaccgttaaccccgg

SEQ ID NO: 216799 - DNA, 680 bp, Homo sapiens
  misc_feature: GYAE6OF02HXTS8.1.34.D01.1.454.CMB.1.raw
  modified_base (171)..(171): a, c, t, g, unknown or other
  misc_feature (171)..(171): n is a, c, g, or t
  modified_base (232)..(232): a, c, t, g, unknown or other
  misc_feature (232)..(232): n is a, c, g, or t
tcagacgagtgcgtcacgaccggtgctcgatttagatcgtctgtgttgggtttgggcatggacatgagggtccccgctcagctcctggggctcctgctgctctggctccaggtaccagctgtgacatccaattgacccagtctccatcctccctgtctgcatctattgganacagagtcacatcacttgccgggagagtcaggccatcagcgtatttcgttagccttggttncgtagcagaaaccgagggtacacgcccctgagtactcgtagtctagtggtgccatccagtattggacgaagggtcggggtaccctacgtacccgtagggtttccaggttcggacgtacggtcgactaacgttccggtaggggaacctaagtaactttaaccgaccttaccttaccaacctttacgtaccaacggtcctaacggtccctggaccacggtacctaggtaacgtttacgtttcgtaacttaaattttacttacgtcgtaactaaccgttaaagttctttaacgtaccggttaaccccgtaggttacggtaccggttcgggaccggtacgggtaaccgtaagggtacggtaacgtaccgaaccgtacgtacggtacggtcctacggtacctaaccggtcttaccgtaggttccctacgtacgttcccgtacccctaacccgg

SEQ ID NO: 216800 - DNA, 599 bp, Homo sapiens
  misc_feature: GYAE6OF02FWKCU.1.34.D01.1.454.CMB.1.raw
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcgccgggngagtcgagccatcagcgattctttagcctggttgcagcagaaacnggcgagcccctnagatcgtagtctagtggtgctatccagtattgacgaaggttcggggtacccagtccgaggttcaggttggacagttcgctagtcgtgggaacagtaactttaccgactctactactactcacgacacgccgtgcncgacctagagttattttgactttaaactttattaccgtagttactaacgttagttaatttacgttaccgttaacccgttacgttgggtaacccgttccgggtaacccggtaaggggtaacccaagggttaaggtaaccgttaccgaaacccggttacgtttacgggcggttactccgtaacccg

SEQ ID NO: 216801 - DNA, 719 bp, Homo sapiens
  misc_feature: GYAE6OF02F6F16.1.34.D01.1.454.CMB.1.raw
  modified_base (223)..(223): a, c, t, g, unknown or other
  misc_feature (223)..(223): n is a, c, g, or t
  modified_base (322)..(322): a, c, t, g, unknown or other
  misc_feature (322)..(322): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttcggccgggngagtcacggccatcgagcgatttcttagcctggttgtcagacaagaaaccgaggggcgaccgcccctacgacgtacgtacggtagtacgtagtgggtcncaactccagtaagttcgacggtaagggttccggggtaccctaacgtccggtaggttacgaggtcggtctaggtacgctaagtcggtgggactaggtacttactactctactactagctacgccacgtccgtacgcctacgtacccgtaagtaacgtttacgttttacgaaccttttaaagttttaactttaaccgttacggttaaaccttaacgtttaaagtttaaaccgtttacgttttaaacccccggttaacccgtttaacgggttaccgggttaacccgggtttaccgggaacccggggtaaacggggtaaccccgggtaaagggttaaccgggttaaaccgtaccggtaaaacccggttaacgttccgggtacggtaccgtacggtaccccg

SEQ ID NO: 216802 - DNA, 512 bp, Homo sapiens
  misc_feature: GYAE6OF02FXEAY.1.34.D01.1.454.CMB.1.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattctttagcctggttgcagcagaaaccagggcgagcccctnagatcgtagtctatggtncatccagattgacaaggtgggtcccagtccaggttcagtggcagtgcatcgtgggacagattacactctacactatcagcacgcctgcagctagaagtntttgacttaatttattactgtacaactagttaattactacgtacccctagtcggtacgtcggcaacggggacctaaggtacggaagtacaaccggaatggtacggacgtgtacc

SEQ ID NO: 216803 - DNA, 675 bp, Homo sapiens
  misc_feature: GYAE6OF02I1EGX.1.34.D01.1.454.CMB.1.raw
  modified_base (477)..(477): a, c, t, g, unknown or other
  misc_feature (477)..(477): n is a, c, g, or t
tcagacgagtgcgtcacgaccggtgctcgatttagatcgtctgtgttgggtttgggggagtcagaccctgtcaggacacagcatggacatgagggtccccgctcagctccgtggggcctcctgctgctctggctcccaggtaccagctgtgacatccaattcgacccagtctccatccctccctgtctgcatctattggagacagagtcaccatcacttggccgggcgagtcgaggccatcagcgtattcgttacgccgttggttgcacgcaagaaaccgagggaccgaccgcccctacgagactcgtagtctagtggtgcactcagtatgacgtaagggtcgggtaccctagtcccgtaggttcgaggtcggactaggtcgcacgttcgtacgggactaggtaacttaacccacgttacctaccgtaacttacgtcagtaccacgtccgtacgcgtacgtccgtaagtaacgtttntttacggtactttaaatttacgttacgtactaactaacgttaagtttaacttaagtttaacccgttaaccccgtacgggttacggttaacccgggtttaccgggaacccgggtaacggggtaaccggttaaagggtaccggtaaacgttaacccggtaaccggttaacgttccgggtacggttacccgtcgtaacccg

SEQ ID NO: 216804 - DNA, 418 bp, Homo sapiens
  misc_feature: GYAE6OF02FPIS8.1.34.D01.1.454.CMB.1.raw
  modified_base (323)..(323): a, c, t, g, unknown or other
  misc_feature (323)..(323): n is a, c, g, or t
  modified_base (345)..(345): a, c, t, g, unknown or other
  misc_feature (345)..(345): n is a, c, g, or t
  modified_base (378)..(418): a, c, t, g, unknown or other
  misc_feature (378)..(418): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttatactgtcaacagtattatacgtacccctagtgacgttcgccaggggaccaaggtgaagtcaacgaactgtggctgcacattctntcttcatctccgctatctgacncactcgctgcgcggctggacaaggccagatagnnnnnnnnnnnnnnnnnnnnnnnnnnnnnnnnnnnnnnnnn

SEQ ID NO: 216805 - DNA, 554 bp, Homo sapiens
  misc_feature: GYAE6OF02F4C6M.1.34.D01.1.454.CMB.1.raw
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (350)..(350): a, c, t, g, unknown or other
  misc_feature (350)..(350): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttncagcagaaccngggcagcccctnagatcgtagtctatggtgcatccagattgcgaagggtcgggtcccagtccaggttcagtggcagtgcatcgngggacagtacttacacttcacactatacagacacgcctagccagtcctaggaagtattttacgacgttaaatttattacgtgtaacaacgttagttaactttagtaacgttaccccgtagttacggtacgttaccgggaccgaaggggtaccgaagggtagtaacggttccgaaaccggtaaccgttggtacggcgtgtaaccc

SEQ ID NO: 216806 - DNA, 798 bp, Homo sapiens
  misc_feature: GYAE6OF02IY08R.1.34.D01.1.454.CMB.1.raw
  modified_base (223)..(223): a, c, t, g, unknown or other
  misc_feature (223)..(223): n is a, c, g, or t
  modified_base (331)..(331): a, c, t, g, unknown or other
  misc_feature (331)..(331): n is a, c, g, or t
tcagacgagtgcgtcacgaccggtgctcgatttagatcgtctgtgttggggtttgggggagtcagaccctgtcaggacacagcatggacatgagggtcccgctcagctcctggggctcctgctgctctggctcccaggtaccagctgtgacatccaattcgacccagtctccatcctcctgtctgcatctattggagacagagtcaccatcacgttgccgggngagtcaggccatcagcgtatttcttacgccgttggttcgacagtaccaaggaaaaccggcggggaccgaccgccccctagagtacgtcggtaagttctaagtgggtcnctactccgaagtagttggacgtaaggggtccgggtaccctaagtcccgtagggtttcgaggttacggcgtaggtgtactacgttcggtacggggactaacggtaactttaaccgaaccttacgttaacctaacgttactaccggaacgaccgtaaccggtcccgttcggaaccgaacccggttccgttaaacggttaaacggtttaacgttttttaaacggacccttttaaaaagttttttaccggtttaaacctttacggttaaaccgtttaaaacgttaaacgtttttaaacgttttaaaccggtaacccccggttttaaccccgttacggggttttacccgggtaaccgggttttacccgggggaacccgggtaacggggggtaaaccttaaaggggggtaaccggttaaacggtaccccgaaaccgggtttaacgttcgggtaccggtaacgtccgaaacccg

SEQ ID NO: 216807 - DNA, 875 bp, Homo sapiens
  misc_feature: GYAE6OF02G6A02.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtggggctcctgctgctcgtggcctcccaggtaccagctgtcgacatccaattcgaccctagtcctccactccctccctgtctgcattctagttggacgacaggtacgtccaacctattccgacgttcgggccggggcgaacggtcgacggtcctagtcgaggtccgttacttttacgttacggtccgttagggttcgacgaacggaccgaaaccggaaaaccggcgggggaccgtaacccggtccccccgtagaacggtacgttaccggttacgtaccgttaaggttcgggtacgtaccgtacttaccgaggttacttaccgggacggtaacgggggttccgggtaccctacggtcccggttaacgggttacgtagggtcggacgtacgggtctacgtacggttccggtaacggggaactaacgttacttacccgtaccttccgttaacctaaccttacgtacgtaacggtccgtaacggtcccggtagtaccgttacggtaaccgtttaacgggtaacttttaacggtttaacgttaaacctttaaagttttaccgttacgttaacccgtaacgtaaacgttaagtttaaaccgttaaccgttaaaccccgtttaacccgggtaagggttacccggttaaacccgggttccggggaaaacccgggttaaccgggggttaaaccctaaagggggttaaccggtaacccgtaaacccggtacccggttaaaggtccgggtttacgtaccgtaccggtaaccccg

SEQ ID NO: 216808 - DNA, 540 bp, Homo sapiens
  misc_feature: GYAE6OF02GEU76.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcacgcccctnagatcgtatctatggtgcatccagtacttgacaagggtcgggtacccagtccgaggttcagtggcagtgcatcgtagggacagtattacactctcactatcagtcagccctgcagcctagaagtattttgacttaatttactactgtacaactagttaattacgtaacgtacccttaggtcggtaccgttacggccggtaacggggaaccaagggtacggtaagtaccgaaaccggtcgtaggtcggtacctgtaacccg

SEQ ID NO: 216809 - DNA, 786 bp, Homo sapiens
  misc_feature: GYAE6OF02HTVOI.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacataccaattcgacccagtcctccactccctccctgtctgctattctagttggagacagacgtaccaccatccacgttcggccgggcgagtccgacggcctatcgacgcgttatttcgtttacgtccgttgggttcgacgtaacgacccgaaaacggaaaacccggacgggggacccgtaccggacccccccgttacgacggtaaccggttacggttaaccgttcgttaaggtcgggttcggacctaacgttaccgaagttacgttcggaccggtaaacgggggttcccggggtacccctacggttaccggttaacgggttcggtaagggttcggaccgtagtcgtacgtacgtacggtacgggactaacgtacttaaccacttctaactacgtactagacgacaccgtccgtgcgaccgttacgtacgtaagttacgttttagtaactttagtttacttacgttacgtaacgttaagtacttttaacgttaacgttacccgttaacccggttacgttacgggttaacccggttaccgggtaaccgggtaacggggtaacgggtaaccgggttaaccggtaaacggttaacccgtaaccggttaaccggttcgggtacgtccgttaacgaacccg

SEQ ID NO: 216810 - DNA, 450 bp, Homo sapiens
  misc_feature: GYAE6OF02HJOMW.1.34.D01.1.454.CMB.1.raw
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
  modified_base (319)..(320): a, c, t, g, unknown or other
  misc_feature (319)..(320): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (415)..(450): a, c, t, g, unknown or other
  misc_feature (415)..(450): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttatactgtacaaacagttattatacgtacccctagtggacgttcggccagggacgacgaggaganacgaacagtgngcnncacntctnttcctncttcctccccgatactcgtacgaaccnctaccgtcgtcgaggcggcggtncgggacgacggcactaagtgangtnacgagnnnnnnnnnnnnnnnnnnnnnnnnnnnnnnnnnnnn

SEQ ID NO: 216811 - DNA, 701 bp, Homo sapiens
  misc_feature: GYAE6OF02HC1NX.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatccctcctgtctgcatctattggagacagagtcaccatcacttgccggcagtcaggccatcgagcgattcttagccttggttgcagcagaaaccgagggcgacgcccctcagactcgtagtctagtaggtcgcactccagtagttcgacgtaagggtcggggtcccacgtaccgtaggttcgaggtcggacgtaggtcgtcacgttcgtcgggaactaaggtacttaacaaccttacgtacctaaccgttaactccgaacgtacgtaaccgtcccgtacgaccgaacggtccccgttaaggtaacgtttacgttttacggtaaccttaaaggtttttacttaaccgttaacggttacctaaacgttaacgtttaactttaacggttacccgttaaccccgttaacgggtcggttaacccggtttaccgggaccggtaacggggtaaaccgtaacgggtacgtaacggtaacccgtacgaacgttcggtacgtcgtacgccgtaccgtagttccgttacgttaccttacgtaccgtttaccctccccttaccccg

SEQ ID NO: 216812 - DNA, 621 bp, Homo sapiens
  misc_feature: GYAE6OF02FPUBL.1.34.D01.1.454.CMB.1.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcagaaccagggcgacgcccctnagatcggtagtctagtggtgcatccagattgcgaaggtcgggtacccagtccaggttacaggttggactagtgcatcgtagggacagtacttacacttctacgactagtcaagcacgtcctgacacggtccctaggaacgttagttttacggactttaaatttaacgtttaaccgttacgttaacctaaaccgttaaggttaacttttaaacgttaaccgttaacccccgttaggggttacggtacccggtttccgggaacccgggtaacggggtaacccgtaagggtacggtaacgtaccgtaaaccggtacgtacgggtacggtaccgtacggtacccg

SEQ ID NO: 216813 - DNA, 617 bp, Homo sapiens
  misc_feature: GYAE6OF02HQU3H.1.34.D01.1.454.CMB.1.raw
  modified_base (456)..(456): a, c, t, g, unknown or other
  misc_feature (456)..(456): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctattggagacagagtcaccatcacttcggccgggcgagtcacggccatcgagcgtactttctttacgtcctgggttgcagacaacggaaaaccgaggggacgaaccgccccctacgagtacgttacggtaagtctagtggtgactatccagtattgacgaaggtcgggtccctaagtccgtaggttcaggtcggagtagtcgactagtcggtaggactaagtacttacactctacactatcacgcagcctgcctagcctagatntttgacttaatttattacgtagtactaatagttacttaagtaacccgttaacccgtacggttacggaccggtttccggaaccggtaacgggtaaccggtaagggtaacggtaaccgttaaccgaaccgggtacgttacgggtaggtacccgtagtaacccg

SEQ ID NO: 216814 - DNA, 638 bp, Homo sapiens
  misc_feature: GYAE6OF02I6CI1.1.34.D01.1.454.CMB.1.raw
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacgttcggccgggcgagtcacggccatcaggcgattctttagccttggttcgcagcaagaaaaccggggcacgcccctnagatcgtaagtctagtggtncatccagattggcgtaaggggtcggtcccagtcctaggttcgaggtggactagtcgcacgtcgtagggaactagtacgttaacctaccttcgtacctaaacttatccgaacgtacccgacgtacccgtggacaaccgtccgtaaggtaaacgtttcgttttacgaacttttaaatttacgttacgtacgttaaccgtaacttaagtttaacttaaacgttaccgtaccccgttaggtcggtaccggttcgggaccggtaaggggtaaccgtaaagggtacggtaacgtacccgtaaacggtaacgtggtacggtacgtacgtacccg

SEQ ID NO: 216815 - DNA, 605 bp, Homo sapiens
  misc_feature: GYAE6OF02GPWZF.1.34.D01.1.454.CMB.1.raw
  modified_base (283)..(283): a, c, t, g, unknown or other
  misc_feature (283)..(283): n is a, c, g, or t
  modified_base (371)..(371): a, c, t, g, unknown or other
  misc_feature (371)..(371): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgtattcttagcctggttgcagcaagaaaccagggcgacgcccctanacgatcgtagtctagtggtcgcatccagattcgacgtaagggttcgggtacccagtccgaggttcaggtcggactagtgactagtcgngggacagacttacactctacactatcagcacgcctgacctagcctagaacgtattttcgaacttaaagtttacttacgtgttaacctaaacgtagtttaacgttaacgtaacgttaaccccgtaggttacgggtaccgtttaccggggaacccggtaaacgggggtaacccgtaaaggggttacggaaacgttaccggtaaccggtaacgttgggtacgggaccttaggacccg

SEQ ID NO: 216816 - DNA, 796 bp, Homo sapiens
  misc_feature: GYAE6OF02H8SDK.1.34.D01.1.454.CMB.1.raw
  modified_base (103)..(103): a, c, t, g, unknown or other
  misc_feature (103)..(103): n is a, c, g, or t
  modified_base (205)..(205): a, c, t, g, unknown or other
  misc_feature (205)..(205): n is a, c, g, or t
tcagacgagtgcgtcacgaccggtgctcgatttagatcgtctgtgttgggtttgggggagtcgagaccctgtcaggacacagcatggacatgagggtccccgntcagctcctggggctcctgctgctctggctcccaggtaccagctgtgacatccaattcgacccagtcctcatccctcctgtctgctatctagtggagacagngtcaccatccacgttcggccgggcgagtcacggccatcgagtcgtactttcgtttagtccgttggttcgcgtacgacaacggaaacccgaggggtaccgaacgtccccccgttaagaacggtacgttaccggtagttccgttaagtcgggtacgtctaactccgtaaggtactttaggaccggtaaggggtaccgggtacccctaaggtttcccggtaagggtttccggtaacgggtacgggtaccgtagggtcgaccgtaacgttccggttacggggtaaccgtaaggttaacgtttaaacccgtacctttaccgtaactaacccgttaacgttacgaaccgtaccgacgtcccttagggacctacggtaccgttaagtaacgtttagttttacggaacttttaaacttttacgttaccgtacgttacctaaacgttaagtttaaccgtacgttaaaccgttacccggttacgggttacggttacccggtttaccggggacggtaacccgggggtacgtaaacggggttaacggtaaccggttaccgaaaccgggttaacgttcgggaccggtacccttggtaacccccg

SEQ ID NO: 216817 - DNA, 576 bp, Homo sapiens
  misc_feature: GYAE6OF02ICN7Q.1.34.D01.1.454.CMB.1.raw
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (557)..(557): a, c, t, g, unknown or other
  misc_feature (557)..(557): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctcctgtctgcatctatggagacagacgtcacatcacttggccgggnagtcacggccatcagcgtattctttagcctggttncagcagaacgngggcacgcccctnagtctcgtagtctagtggtancatcagnttgacgtagggtcggtcccagtccgagggttcaggtggctagtcgactagtcgagggaactagtacttacaccttctacaatactacgagtacctacggtcctaggcgtacgtccgtaaggtaacttacttttggactttaaatttacgttactagttaaccaagtaacgtttattaacgttaccgtaccgtagttcgggaccgttcggacgggttaacggactagggtacggtaactccgtaaacgngttagggtcgtactagacc

SEQ ID NO: 216818 - DNA, 629 bp, Homo sapiens
  misc_feature: GYAE6OF02FQC7Y.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcggccgggcgagtcaggccatcagcgattcttagcctggttgcagacagaaaccgcgggcgacgccccgtcagactcgtagtctagtggtgcactccagtattggacgtaagggtcggggtacccacgtccgtaggttcaggtggacgtaggtcgctacgtcggtagggaactacgtacttaacaccgttctactacgttactccgaagcgaacgcccttacggaccacggtcccttaaggtaaacgttagttttttacggttaaattttacttaacgttacgttacaacgttaagtttacgttaacttaaccgttaacccgttacgttaccgggtaccgtttccgggacggtacggggtaacctaagggtacggaacgttaccgaaccgtacgtgtcggtactggcctaaccg

SEQ ID NO: 216819 - DNA, 669 bp, Homo sapiens
  misc_feature: GYAE6OF02JG6X5.1.34.D01.1.454.CMB.1.raw
  modified_base (196)..(196): a, c, t, g, unknown or other
  misc_feature (196)..(196): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (378)..(378): a, c, t, g, unknown or other
  misc_feature (378)..(378): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatccctccctgtctgcatctatgganacagagtcacctatcacgttgcccgggcgagtccacggccaatcgagccgtattcttagccttggtgcagcaagaaccgngggaccgacnccccagacgatcgtagtctagtggngcatccagtntggactaaggggtccggtacccagtccgagttcgagtcggatcgtgcctaagtcggnggaactagtaacttaccaccttctaaccgtacttaacgtccaacgtccaacgtccgtacgtcgtaccgtacgttagttaaacgttaccgtttacggtaactttaacgttttacgttacgtaaccgttacgtaaaaccttagtttaaatttacccgtaaacccgttacccgttaagggttcccgttaacgggtaccccggttacgggaaccgggttaacggtaacgggttaacgggtaacccgttaacggtaacccgtaaggtttcgtaccggggtatacccggtaacccgg

SEQ ID NO: 216820 - DNA, 739 bp, Homo sapiens
  misc_feature: GYAE6OF02HBVR6.1.34.D01.1.454.CMB.1.raw
  modified_base (292)..(292): a, c, t, g, unknown or other
  misc_feature (292)..(292): n is a, c, g, or t
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtaccagctgtgacatccaattgacccagtctccatccctcctgtctgctatctagttggagacagacgtcaccatccacgttcggccgggtcgagtccaggccagtcagtcgtactttacgttacgccgttggttcgcaacgacaacggaaaccgngggactaccgcccctagagtacgtcgtagtcgtagtggtctcgaacttccgaagttacgtcggtacggaaccggggttccggtacctacgtacggtacggtcgtaggtacggtcgtaacgtcggactaacgttcgggtaacgggtaactagttaacctaccgtctaacccttaacgtaacttacgacgtacgaaccgttcgtacccgtaggtccaaccgttcgttaaggttaaacgtttcgtttaacgtaacttttaaagtttaccgtacgttaacgtaaacgttaactttaagtttaacgttaacccggtaaccctttaacgggttaccgggtaacggttcccggttaaccggggtaaaccggtacggggttaaaccggtaagggttaaccggttaaccgtaacccggttaacgtaccggttggtaaccggttaccgactaacccg

SEQ ID NO: 216821 - DNA, 763 bp, Homo sapiens
  misc_feature: GYAE6OF02HL9L9.1.34.D01.1.454.CMB.1.raw
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacactccaattcgacccctagtcctccacttcctcccttgtctgcattctagttggagacagagtccaccatccacttcggcccgggcgtagtccgaggcctatacacgcgtactttctttacgccgttgggttncgagtcaacggaaaccgngggaccgacgtccccanacgtactcgtagtctacgtggacnctacgtacgagtcgttacgacggtacggtcgggtacctacgtccggtagtcgaggtcgacggagtcgaccgtaggtcggtagggactaggtaaccttaccgtaccttaccgtacaccgttaacgtcgtaacgaccgtacggtccctaggaccgttaaccgtaccggttaagtaacggttttacttttacggtttaaacctttaaagttttttacgttaaccgttacgttaaacccgtttaaagttaaccgttttaaccggttttaaactaaccccgggtttttaacccgtacggggttacgggtttacccggttaaccggggtccccggggaaacggggttaacccggtaaacgggggttaacgaacccgggtttaacgaacccggttaacgttggggtacccggtctaaccggttaccg

SEQ ID NO: 216822 - DNA, 695 bp, Homo sapiens
  misc_feature: GYAE6OF02GPS3D.1.34.D01.1.454.CMB.1.raw
  modified_base (237)..(237): a, c, t, g, unknown or other
  misc_feature (237)..(237): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatccctcctgtctgctatctagttggacgacagagtcaccatcacttggccggcagtcaggccancgagcgtatttcttagcctggttacgacgagaccaagaaaccgacgggacgaccgaccccgtnacgtactacgtacgtcgtaagttcggagacacgtccgaagtacgttagacggtaagggtccgggtacccagtaccgtaggttacacgggttcggcgtaagtcgactagtcggacggtaacgtaggtactttaacaccttaccgttactaacttacgtaccaagtaccgaaccgtcccgtaggaccctaacggttaccgttaaacgggtaactttaacgtttacggaactttaaatttaccgttacgtacgtaactaacgtagtttaaccttaaacggttacccgttaacccgttaggttaccggaccggttaccggtaacccggtaagggtaacccggtagggaacggtaacggtaaccgtaaacgggtcctagggtacggtccgtagtaacccg

SEQ ID NO: 216823 - DNA, 693 bp, Homo sapiens
  misc_feature: GYAE6OF02JMZVA.1.34.D01.1.454.CMB.1.raw
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
tcagacgagtgcgtcacgaccggtgctcgatttagatcgtctgtgttgggtttgggggtaggtcgagaccctgtcaggacacagcatggacatgagggtccccgctccagctcctggggctcctgctgctctggctcccaggtaccagctgtgacactccaattcgacccagtcctccatccctccctgtcngcatcgtattgganacagacgtcaccatccacttcggccgggctagtccaggcccaatccagcgtattacttagccgttggttcgctacgacgaacgtaaacccgagggaccgtaccgccccgtacacggtacgtacgtacgtcgtagtacgggtcgtactacgttacccgaagtacttacggtaccgtaaggggttccggggttaccccaacggtttcccgaagggtttaccgtagggtcggtacgtaggtacggacctaagtccggttacggggaacttacggtaacgtttaaccgtacccttccgttaccctaacgtaaccttacgaacggtaccgaacgtcccttggactaccgtcgtacggtaattacgtttagacgttaaattttacttacgttacgtaactattacgtttaatacttaccgtaccgtacgtggtacgttccgaacggtacggtacgaaggtcggaatccgtaacgaccgttggcgctacgaccg

SEQ ID NO: 216824 - DNA, 799 bp, Homo sapiens
  misc_feature: GYAE6OF02JEGQI.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctcctggggctcctgctgctctggctcccaggtaccagctgtgacatccaattgacccagtcctccactccctccctgtctgcatctatggagacagagtcaccatcacgttggccgggacgagtcagccatcgagcgtatttctttacgccgttggttgcacggcaacggaaaccgaggggtacccggaaccgtcccccgtacacggtaacgtccggttaagttaccgttaggtacgggtacgtaccgtaacttcccgtaaaggtaggtttcggaaccggttaaacgggggttccggggtacccctaacggttcccggtaacggtttacggaggtcggggaacgtacggtgggaacctaacggtttaccgggtacgggtaacgtaacgtaacgttttacccgtaaccttcttaaccctaacgttaactccgaaagtccgtaaacgtccgttacgactacgggtacccgttaggaacgtttaaagtttcgtaactttaaaacgtttttacgttaaccgttaagggtttaacctaaaagttaacgtttaaacgtttactttaaaccgggttaccccctaacgggtttacggttacccggttacgggtacccgggaaacgggttaaccggtaaagggttacggaaacccggttacgaaacccggtaggttaaccggcggttaccggtgaacccg

SEQ ID NO: 216825 - DNA, 839 bp, Homo sapiens
  misc_feature: GYAE6OF02IMWB3.1.34.D01.1.454.CMB.1.raw
tcagacgagtgcgtcacgaccggtgctcgatttagatcgtctgtgttgggtttgggggagtcagaccctgtcaggacacagcatggacatggagggtccccgctcagctccgtggggctcctgctgctcgtggcctcccgaggtaccagctgtgacatccaattcgacccagttcctccactccctcctgtctgcattcttagtggagacagacgtaccactactccgtacgttcggccgggtacgacggttccgaacggccaagtccgtacgtccgtttacttttaccgttccgtacgtttagggttcaccgagaccggtaaacggaaccggtacgggccccgtaccgccccgtacgacggttacgttaccggtattccgtaggttccggtacgacctacgtaccgttaaggtacgtttacggaccgggtaacgggttcccggtaacccaaccggttccggttaagggttccgaggtacggaacttggtacgaccgtacggtcgggtaacgggtaccttaagttaacgttacccctacgtttccgtaaaccgttcgttaaccgtaacgaccggtacgtacccggttacgtccggaccgttacgaacggtttaaggttaacgtttacgttcttaaccggtttaaatttttaccggtaaccgtagttaaaccgtaatttacgttaaaccgttttaaaccgtacccgggtttacccgtaccggttccgggttaacccgggtaccgggtaccgggttaaccgggtaaccgggttaaggtacccgggtaaaaccttacccggaacggttaacggttcggggtaccgtcgtaacccggttaacg

SEQ ID NO: 216826 - DNA, 671 bp, Homo sapiens
  misc_feature: GYAE6OF02GASN4.1.34.D01.1.454.CMB.1.raw
  modified_base (198)..(198): a, c, t, g, unknown or other
  misc_feature (198)..(198): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattgganacagacgtccacatcacttcggccgggcgagtcgacggccagtcagcgtatttcttacgccgtggttcgcagcaacgaaaccgagggccgacgcccctgaagacgttcggtacgtacgtagtcggtcactactccgagtattgacggtaggtcgggtacccagtccgaggttccgaggtcggcgtagtcgtactacgtcgtacgggaactagtactaccactcgtactacgtactacgtacgctacgccgttgaccgtacgtaccgtaggtaactttacgtttagacgtttaaatttacgttacgtacgtaacctaacgttaagttaacttaaccgttaaaccggttaccccgtttaagggttccggtaaccggtttacccgggaaccgggtaaccggggtaaccggtaacggggttaacgtaaccggtaacccgtaaccggtacgtaccgggttacggcccgtacgtacccg

SEQ ID NO: 216827 - DNA, 753 bp, Homo sapiens
  misc_feature: GYAE6OF02HBH7V.1.34.D01.1.454.CMB.1.raw
  modified_base (104)..(104): a, c, t, g, unknown or other
  misc_feature (104)..(104): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (505)..(505): a, c, t, g, unknown or other
  misc_feature (505)..(505): n is a, c, g, or t
tcagacgagtgcgtcacgaccggtgctcgatttagatcgtctgtggttggggtttgggggagtcagaccctgtcaggacacagcatggacatgagggtccccgntcagctcctggggctcctgctgctctggctcccaggtaccagctgtgacatccaattcgacccagtcctccactcctcctntcngcatctatgganacagagtcactatcacgttggccgggacgagtcgacggccatccgagacgttatttccgtttacggccgttaggttcgacgacgtaccgaagggaaacccgacgggggtaccgaccgggaccccctacggaacggttacggttaccggttaagttaccgttaaggttcggtacgtaccgtactaccgaaggtacgttcgggacggtaaggggttccggtaacctactccggtaaggttcgaggtacgcgtaagtcgacgtacgttacggtagggaacgtagtacttaaccgtctcttacgacttntaccaggtcgtaaccgtccgtacggacccggtacttaccgaacgggttaacgttacgttttacgaacttttaacgtttaccgttaacgtcgttaacctaaacgttacgtttaaacgttaaccgttaacccgttacccgtaaggtaccggggttaccgttaccggggaccggtaacggggtaaaccggtacgggtaacggtaaaccggttaacgaaccggtacggttcggtaccgaggtaccgtacccg

SEQ ID NO: 216828 - DNA, 1198 bp, Homo sapiens
  misc_feature: GYAE6OF02IXA0G.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctcctggggcctcctgctgcttctggcctcccaggtaccagctgtgacatacctaattcgaaccccagttcctacccacttcccttccctgtctacggctattccttagttgggacgaactaggtacgtaccaaccacttaccgtaaccgtttcgggccccggggaccgtaacggttacccgaacgggtacccctaagttccgaacggtacccgttaacgtttttacccgttttaacgggtccccgtttagggggttttaccaccggtaaacggtacccgtaaacgggaaaaaaacccggccgggggggtaccccgaaccggtaccccccccgttaggtaaacccggttacgtttaacccgggtttaacggttaccgtttaaacggggtttcgggtttaccgaccgttaacccggttaccgtaaggttaacccggttttaggaaaccggggttaaaccggggggtttacccggggttaccccctaaagtttaacccccggttacgggggttttaacccggtagggtttaaaccggggtaaccgtttaccggggttacggacccgttaaacggggtttacccggggttaacccgggggtaaaacccgttaacggttttaaaacccgttttaaccccgggttaaaccccgtttccccgtttaaaacccgtaaacccctttttaaacccggtacggggtaaaaccgttaaccccggtttaaacccggggtcccccgttaaccggggttaaacccgggtaaacccgggtttaacccccggttaaaggggtttaaaaacggggttttaaaccccttttttttacggggaaaaccccgttttttaaaatttttttaaccgtttttaaaccgggtaccgttaaacccggtttaaaaaccggtttagttttttaaaaaaccccggttacccggtttttaaaaaaccccggtcccccccgtttttaaaaggggggtttaccccggggttttaaacccggtttttcccccgggggggaaaaaccccgttaaacccggggggggtttaaaaacccccgggttaaacgggggttaaaccgggtttaaaccggtttaacccccc

SEQ ID NO: 216829 - DNA, 563 bp, Homo sapiens
  misc_feature: GYAE6OF02F8Q2U.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctccccaggtaccagctgtgacatccaattgacccagtctccatcctccctgtctgcatctattggagacagagtcaccatcacttggccgggcgagtcaggccatcagcgattcttagcctggttgcagcagaaaccagggcgagcccctcagatcgtagtctatggtgcatccagattgcgaaggtggggtcccagtcctaggttcaggtgcgagtgcaatcgtgggacagtattacactctacactatcagcagcctgacagcctagaagtatttcgactaaattttattactgtacaaacgtattaacttactaacgttaacccctaggttaggtaccgttacgggacccgaaggggtaaccaaaggggtcgtaaacgtacccgaaccgtaacgtggtggacctagtcctaccctaattccgttcgttaccttctacgttccttaccccggacc

SEQ ID NO: 216830 - DNA, 456 bp, Homo sapiens
  misc_feature: GYAE6OF02JCAJH.1.34.D01.1.454.CMB.1.raw
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (418)..(456): a, c, t, g, unknown or other
  misc_feature (418)..(456): n is a, c, g, or t
tcagacgagtgcgtcacgaccggtgctcgatttagatcgtctgtgttggggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtacctaacagttattatacggtacccctagtggtacttcggaccagggggaccaagggtggaaacgtcgaaaccgactgtggcctgcaccatctgtcttcactcctttcccgctatctcgaacgtcaacctcgtactgacgcgggctggacaaggcacatagntnatcnnnnnnnnnnnnnnnnnnnnnnnnnnnnnnnnnnnnnnn

SEQ ID NO: 216831 - DNA, 623 bp, Homo sapiens
  misc_feature: GYAE6OF02GBRAM.1.34.D01.1.454.CMB.1.raw
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (432)..(432): a, c, t, g, unknown or other
  misc_feature (432)..(432): n is a, c, g, or t
tcagacgagtgcgtcacgaccggtgctcgatttagatcgtctgtgttgggtttgggggagtcagaccctgtcaggacacagcatggacatgacgggtccccgctcagctcctggggctcctgctgctctggctcccaggtaccagctgtnacatccaaattcgaccccagtcctccatccctccctgtctgcatctatgganacagagtccaccactctacgttcggccgggcgagtcaggaccatcgagcgtattcttagccttggttcncacgacaaggaaaccgacgggccaccgcccctnagacgttcgtagtcgtagttggcgcactccagtatgacgtagggtcggtcccagtcgtacggttcgaggtcggacgagtcgacacgttcgacgggaactagtaacttacgacctcgtacctaacttanaccaggtaccacgtcctggtaccaacggttccgtaagtaacgttatttttacgaactttaaattttactttacctttaacgaaactagttaacttacttaaaccggttaccctaggtacggttaccgtacggaccggtacggaaccgtaaggacgtaacgtaccgaacggtactggtcgtctagacctacg

SEQ ID NO: 216832 - DNA, 734 bp, Homo sapiens
  misc_feature: GYAE6OF02IADTS.1.34.D01.1.454.CMB.1.raw
  modified_base (224)..(224): a, c, t, g, unknown or other
  misc_feature (224)..(224): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctagtggagacagagtcaccatcacttggccgggngagtcaggccatcagcgtattctttagctggttgcagcagaaccnggggccgacgcccctanacgagtcgtagtctagtgggtncatccctagtattacggacgtaacggggtcgggttaccccaagttccgtacgggttacgacggtggactagggtcgccgtagttcggtacggggtaacctaggtaactttaccgtacctttaccttaccgtaacttaaccgtcaccgggacctaccggtaccctttccggacctacggttacccgttagggtaaagttttacgttttacggaacttttaagttttttaacgttaccgttacggtaacttaaacggtttacgtttaaagttaaccgttaacccgtttaaccccgtacggtttacccgggttaacccggggtttacccgggtcccggtaaccgggggtaacccggtaaggggtttaaccgggtaaacggtaccgttaaaccggacggtttaccggtacggttacccgtacgtaccccg

SEQ ID NO: 216833 - DNA, 542 bp, Homo sapiens
  misc_feature: GYAE6OF02F0S97.1.34.D01.1.454.CMB.1.raw
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggcccgggnagtcaggccatcagcgattcttagcctggttgcagcagaaaccagggcgagcccctnagactcgtagtctatggtgcatccagattgcaaaggtcggggtcccagtccgtacggttacagtggcagtagcaatcgagggtacaggtacttaaccactactactaactaacttcagcacgcctgacacgtcctagtaataattttcgataatttattactgtactactaagtacttaatacgttacccgttagtcggtactcggccgaagggtacctagggtaggtaacgtaccgacggtaaactgtcggctgtaaccg

SEQ ID NO: 216834 - DNA, 709 bp, Homo sapiens
  misc_feature: GYAE6OF02F9D87.1.34.D01.1.454.CMB.1.raw
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcattctattggaagacagatcaccatcacttggccgggcagtcaggccatcagcgtattcttagcctggttncagacaagaaacgngggacgacgcccctagagatacgtatctagtggtnacactcagtnttagacgtagggtccggtaccacgtccgaggttcaggttcggctagtgctagtacggtacggaacgagtaacttaaccgtacttaaccgtactaactacgtaacgacggtactaaccgggccctaggaccgtaacgtcccgtttaaaggtaaacgttttaatttttacggaacttttaaaattttaccgttaaacgtttacggttaaccaaaacgggtttaactttaaactttaaccgtaaaccccgttaaacccgttaggttaccgggttaccgggtttaacccggggtaaccgggtaaaccgggggtaaaccgttaaacgggggttaacggtaaccggttaaacccgaacggggtttaaacgttcgggtaacggtaccgtaccgtaacccg

SEQ ID NO: 216835 - DNA, 798 bp, Homo sapiens
  misc_feature: GYAE6OF02IFR9F.1.34.D01.1.454.CMB.1.raw
  modified_base (148)..(148): a, c, t, g, unknown or other
  misc_feature (148)..(148): n is a, c, g, or t
  modified_base (211)..(211): a, c, t, g, unknown or other
  misc_feature (211)..(211): n is a, c, g, or t
tcagacgagtgcgtcacgaccggtgctcgatttagatcgtctgtgttgggtttgggggagtcagacctgtcaggacacagcatggacatgacgggtccccgctcacgctccgtggggcctccgtgctgctctggctcccgaggtaccnggctagtcgacatccaattcgacccagtcctccacttccctcccgtgtctcgactacgtctancggagacagtacgtccaactactcgacttgggccgggcgaagtccgacggtcacgtacgacggctacgtttcttacggtcgttcggttgctacgcgaaacggtaaaccgcggggactaccggccccttaacgacggtacgtaccgttacgttacgttaacgtcgggtaccgtacgtacgtaccgtaggttactttacgggaacggtaacggggtccgggtacccgtactacccggtaggttacgacgggtttcggaaccggttgaccgtgtaccgttcggtacgggactacggttaacgtactacgtcgttacgaacttacgaccgtacgacgacctccgacgtacgtaacgtccgttaagtaacgtttatttaccggttaactttaaacgtttttacggtaacctttacgtaaacgttaacgtttaaacgttaagttttaaaccgtacccgttttaacccgtacgggttaccgggtttaaccggttcccgggttaaccgggtaaccggggtaacggttaacgggtaacggttaaccgggttacgaaaacccggttcgggttaacggtcggttacgtaccgttaacg

SEQ ID NO: 216836 - DNA, 592 bp, Homo sapiens
  misc_feature: GYAE6OF02G6V8B.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (427)..(427): a, c, t, g, unknown or other
  misc_feature (427)..(427): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctnagatcgtagtctagtggtgcatccagtattgacgtaaggggtcggggtacccagtccgtaggtttcaaggtcgggactaggtgcagtcgtagggaacaggtacttacacttctacactatcagcagcctgacagcctagaacgttnttttacggacttaaattttacttactgttaactaactaagttaatttaactaaccgttaccccttagggtcggttaccggttccgggaccggtaagggggtaaccctaaggggtcggtaaacgtacccgaaaccggtacgttgggtacggtaccgtcgtaacccg

SEQ ID NO: 216837 - DNA, 762 bp, Homo sapiens
  misc_feature: GYAE6OF02H4NI5.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgctatctatggagacagagtccaccatcacgttcggccgggcagtcaaggccagtcagcgtatttcgttacgcgttggttgcagacgaacgaaaccggagggaccgacgccccccgtagaacgtacgttacgttagttccgtaagtcgggtacgtacgtaactaccgtaagtacttacgggaacggtaacggggttccgggtaccccgtaagtcccgtaaggttaccgtaggtcggtacgtaggttcgacgtacgttcggtagggactaagtacttaaccgaccttaccgactaactataccgactccgtaacgtcctaggcgtaccgtccgtaaagttaacgttagtttacgtaacgtttaaattttaaccgtttaacgtacgttaaacttaaccgtttaaagtttaacgtttaaacccgttaacccggtttaaccccgttaacgggttaccgggttaacccggtttacccggaaccggggtaaccgggtaaaccggtaaaggggttaaccggaaaccggttaacccggtaaacccggtacgggttaccggtcggtaccgtacccggtaaccccg

SEQ ID NO: 216838 - DNA, 804 bp, Homo sapiens
  misc_feature: GYAE6OF02JH05C.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccatcctccctgtctgctatctagttggaacgacagagtaccacctatccgtacttcggccgggacgtaagtccaggccagtcacgcttaattcttacggccttgggtacacgtacgacgtaaacggaaaccgacggggccaaccggtccccttagaacgtcgtacggttagtacctaaggttcggtgacctaacgtccgaaggttacgttacgaaccggttacggggtcccggtacccacgttacccgtagggttacgtacgggttacggtactaacgggtccgttaaccgtacgttacccggggttaaccgggaaacgttacggtaaacctttaacccgtacccgttaccttaacccgtaccgttaaagtcccgtaagaccgtaaccgtccgttacgaccgtaccgtaccgttaaaggtaactttaggttaccctaaagtttactttaccgttaacgttcgtaacgttaacgtaagttttaacctaaccgtttaacccggttaacccttaagggttaccggtttaccgggtacccggtaaaccggggttaaccgggtaaaccggtaacggggtaacggttaaccggacccgtaaaaccggttccgttaagggtccgtacgtacgtaaccccg

SEQ ID NO: 216839 - DNA, 462 bp, Homo sapiens
  misc_feature: GYAE6OF02JI06M.1.34.D01.1.454.CMB.1.raw
  modified_base (361)..(361): a, c, t, g, unknown or other
  misc_feature (361)..(361): n is a, c, g, or t
  modified_base (424)..(430): a, c, t, g, unknown or other
  misc_feature (424)..(430): n is a, c, g, or t
  modified_base (432)..(462): a, c, t, g, unknown or other
  misc_feature (432)..(462): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaagggtggggtcccatccaggttcagtggcagtgcatctgggacagattacactctcactatcagcagcctgccagcctagaagtattttgactaatttattactgtacaactagtattatacgtacccctagtggacgttcggacgacggggaccaaggtcggaacgtcaaccgaatgtgactcgcaccgtatcgtgttctctatcccttacccnccctctccacgtccactcgtcctgacggcgggctcgggacaacggcgtacgaatacgtcatcnnnnnnncnnnnnnnnnnnnnnnnnnnnnnnnnnnnnnn

SEQ ID NO: 216840 - DNA, 777 bp, Homo sapiens
  misc_feature: GYAE6OF02G83IM.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctatggagacagacgtcaccatctacgttcggccgggcagtcgacggtccatcgagcgtattcgtttacgtccgtggttcgccgagcgaacggaaaaccgacgggtacgaccgtacccctcgaacggtacttaccggttaacgttcgttaagttcggtacggtacctacttacccgtaaggtaacgtttcggacggtaacgggggttccggggttaccccctaacgttaccggtacggggtttaccgaaggttcggggaccgtagggttacgaccgtaacggtttccgggtaacggggtaacgtaacggttaaaccgtttaaccctaccgtttaaccttacccgtaacgttaaccgtccgtaacgtaccgaaccgtcccggtagaccgtaacggtccgttaaaggtaacgttagttttacgtactttaaacgttttacttacgtttagtaccttaacgttaagttaactttacgtaaccgttacccgttacgggtccgtaccggttcccgggtacggaacgggttaacggtaagggtacgtaacggtccgtaaaccgggacgttaggtaccggtacgtagtaacccg

SEQ ID NO: 216841 - DNA, 697 bp, Homo sapiens
  misc_feature: GYAE6OF02HJFPD.1.34.D01.1.454.CMB.1.raw
  modified_base (197)..(197): a, c, t, g, unknown or other
  misc_feature (197)..(197): n is a, c, g, or t
  modified_base (259)..(259): a, c, t, g, unknown or other
  misc_feature (259)..(259): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatccacttgccgggcgagtcaggccatcagtgatttctttagccttggttnccagcaaggaaaccgagggccgacgccccctcgagacttcggtacgtctacgtggtcgctactcctagtactttggacgtaaaggggtccggggtacccaacgttccgaggtttaccgaggttcggtactaagttcgctacgttcgtagggacctagtaacttaccgtacctacctacgtaacttacttaccaacgccgtaaccgcccggttgacccgtacggtacccgttacgggaaatttactttttcggaaactttaaacgttttaacgtttaacgtacgttaccaaaacgtttaacgttaaattttacgtaacgttacctttaccccgttagggttacggtacccgggtttaacggcccgggtaacggggaacccgtaaagggttccgtaaacggttaccggtaaaccggttacggtagggttcggaccgtcgg

SEQ ID NO: 216842 - DNA, 655 bp, Homo sapiens
  misc_feature: GYAE6OF02FQCWA.1.34.D01.1.454.CMB.1.raw
  modified_base (102)..(102): a, c, t, g, unknown or other
  misc_feature (102)..(102): n is a, c, g, or t
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtgacatccaattcgacccagtctccatccctcctgtctgcatctattggagacagagtccaaccatcacttcggccgggcgagtcaggccatccagcgtattcttagccttggttgcacgcaacggaaaccngggacgacgccccacgagactcgtagtctagtggtcgcactccagtattgacgtaggtcggtacccatccgtaggttcagtcggctagtgactagtcgtagggactagtactttaaccgacttccgtactacgttagtcgacgtcacgtccctaggactaccgtccttaggaaagtttcgttttacgaactttaattttacttaccgttacgttaacaaaccgtttaagttatttaaaccgttacccgttaaccccgttacgggttacggttaccgggtttaaccccgggaaccgggtaacggggtaacccgtaaacggggttggaaacccgttccgttaaacggaccggtttaggccggttaccgttacgaacccg

SEQ ID NO: 216843 - DNA, 663 bp, Homo sapiens
  misc_feature: GYAE6OF02FORHM.1.34.D01.1.454.CMB.1.raw
  modified_base (277)..(277): a, c, t, g, unknown or other
  misc_feature (277)..(277): n is a, c, g, or t
  modified_base (318)..(318): a, c, t, g, unknown or other
  misc_feature (318)..(318): n is a, c, g, or t
  modified_base (454)..(454): a, c, t, g, unknown or other
  misc_feature (454)..(454): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacagagtcaccatcacgttcgccgggcagtcaggccatcgagcgtattctttagccgttggttgcagacaacgaaaccgngggccgacgccccctagacgactcggtagtctagtgggtcncactccgagtattcgacggtaacgggtcgggtacctagtcccgtaggttcgaggtcggctagtcgctagtcgtagggacagtacttaccgaccttcgtacctacgttataccgacgtaccgaccgccgtacgaccncgtaccgtaagtaacgtttacgtttttcgaacttttaaacgttttactttaaccgtgtaacccgttaaacgttaagtttaactttaacccgttaaccggtaaccccgttagggtaccggttaccgggttaccgggtaccggaaccggggtaccgtaaaggggttacgtaacggtaccgaaccgtacggttggccggtacgtgtaacccg

SEQ ID NO: 216844 - DNA, 541 bp, Homo sapiens
  misc_feature: GYAE6OF02G9OB6.1.34.D01.1.454.CMB.1.raw
  modified_base (207)..(207): a, c, t, g, unknown or other
  misc_feature (207)..(207): n is a, c, g, or t
  modified_base (378)..(378): a, c, t, g, unknown or other
  misc_feature (378)..(378): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
  modified_base (509)..(541): a, c, t, g, unknown or other
  misc_feature (509)..(541): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagtattacactctcactancagcagcctgcagcctgaagtattttgacttaatttattacctgtaccaaatagttatttaatacgtacccccttaggtgggtaccgtttcgggaccgtaaggggggacccaaaggggtggaaacggttccgaaacccggtaacgttggtacgggcctcgccgtaaccctnttcctgttccgtttacactttcccttaccccgaccactttcgtacgaaccgtctaccgttccgtcgtacgacgggtcccgggtcgtagggccgaacggccgaccgtaattcggactgactngacagcgncnnnnnnnnnnnnnnnnnnnnnnnnnnnnnnnnn

SEQ ID NO: 216845 - DNA, 719 bp, Homo sapiens
  misc_feature: GYAE6OF02GQHS7.1.34.D01.1.454.CMB.1.raw
  modified_base (123)..(123): a, c, t, g, unknown or other
  misc_feature (123)..(123): n is a, c, g, or t
  modified_base (130)..(130): a, c, t, g, unknown or other
  misc_feature (130)..(130): n is a, c, g, or t
  modified_base (180)..(180): a, c, t, g, unknown or other
  misc_feature (180)..(180): n is a, c, g, or t
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (385)..(385): a, c, t, g, unknown or other
  misc_feature (385)..(385): n is a, c, g, or t
  modified_base (550)..(550): a, c, t, g, unknown or other
  misc_feature (550)..(550): n is a, c, g, or t
tcagacgagtgcgtcacgaccggtgctcgatttagatcgtctgtgttgggtttggggagtcagaccctgtcagacacagcatggacatgaggtccccgctcagctcctgggctcctgctgctntgctccnggtaccagctgtgacatccaattgaccctagtctccattccgtcctgtcngtctatactattgganactagagtccacgactacgtacttcggacccggntaacggtnaacggtccaataccgagtacgtattacttaagccgttggttgccgaagcgtaaacgtaaacccgaggaccgtaaccgcccctagaacgacgttcgtaagttcgactaggtcactagtccagtacttcgaccgtaaggtcggtaaccngttaccgtaggtaccgaggttcgagtaccggttcgaactacgttacggtcggacttaaagtccgtttaacacgtcgtaactacttaaggcctaagtcaacgtcccgtagactaccggttacaacggttaacgttctttaagcggttaaactttcgtttaacccgngtaacttaaaacgtcgtttaaacgttacgttaaccgtaacccgtttacggtaggttaacccccgttgggttaaacccggacgggttaaaacccggttaagggtaacgttaccgggttaaactaaccccgggtttaatcccgggtttaggaaccttcccggttaacccgg

SEQ ID NO: 216846 - DNA, 620 bp, Homo sapiens
  misc_feature: GYAE6OF02ICSPO.1.34.D01.1.454.CMB.1.raw
  modified_base (102)..(102): a, c, t, g, unknown or other
  misc_feature (102)..(102): n is a, c, g, or t
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (613)..(613): a, c, t, g, unknown or other
  misc_feature (613)..(613): n is a, c, g, or t
tcagacgagtgcgtcacgaccggtgctcgatttagatcgtctgtgttgggtttgggggagtcagaccctgtcaggacacagcatggacatgagggtccccgntcagctctgggctcctgctgctctggctccaggtaccagctgtgacatccaattgaccctagtctccatccctcctgtctgcatctatgganacagtatcacnttcacgttggccgggcaagtcgacggtccagttcgagtcgtatttcgtttacgcgtggttgctagacaacgaaacgngggcgaccgccctnacgtagtcgtaagtcttagngtcgcacgtccagtagtagacgtagggtccggtccagtcgaggttacgagtaggctacgtcgacctatcggtaggagattaacgttacacgttctaacgaccttagtcgtaacgcctaacggccgtcgaccggactcgtaaggtaacgttagtttcgtaataagttttactacgtacgtactaacgttataagttaacgtaccgttaaccgtacggtcgttaaaccgttccggacgggtaacgtacccggtaagggtaaccgttaacgccgaaacggtcgtacggttcggacccgtntaaccgg

SEQ ID NO: 216847 - DNA, 670 bp, Homo sapiens
  misc_feature: GYAE6OF02J2VLQ.1.34.D01.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (490)..(490): a, c, t, g, unknown or other
  misc_feature (490)..(490): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccactccctccctgtctgcatctatgganacagatcaccatcacgttcggacccgggngtacgtcaggcccatccagtcgtacttcttacggcctggttgcgagaccaacggaaacccgagggtaccgaccgccccctagacgtacgttacggtagttaccgtagtgggttacgcctacgtaccgagttagttacgacggtaacggggtccggtccctacgttccgaggtttacgaggttggcgtagtcgacgttacgtaccggtaggacgtactacgttaccacgttaccgtacacttacgtacgcgacgactccgtnaccacggtcctaggtaactttcgtttcgaactttaatttacgtacttacgtaacgtaacttaacggttacttaaacaacccgttcccgttaacgggtcgtaccgggttaccgggaccggtaacggggtaacctaagggtaccgtaacgtaccgaaccgtaggtcggtacgtcgaccgtac

SEQ ID NO: 216848 - DNA, 583 bp, Homo sapiens
  misc_feature: GYAE6OF02GZLGG.1.34.D01.1.454.CMB.1.raw
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
  modified_base (457)..(457): a, c, t, g, unknown or other
  misc_feature (457)..(457): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcattctagttggagacagagtccaccatcctacttggccgggcagtcaggccatcgagcgtattcttagccttggttncagcagaaaccngggcacgcccctnagtactcgtagtctagtcggtnacactccagtacttggacgtaaggggtcgggtcccaagtcccgtagggttcaggtggactggtcgctacgtcggtagggaacctaggtaccttacgacttcctactacgtactcgacgccacgtccgtgccagtccgtgaacgtttntttgaaccttaagtttaactcgtacgtaacgtaacgtagttacttagtaaccgttacccgtaggtcggtacgtcggaccgagggaccgtaaggtacgaagttcgaacgtacgtggactcgcgtacc

SEQ ID NO: 216849 - DNA, 539 bp, Homo sapiens
  misc_feature: GYAE6OF02IRQMF.1.34.D01.1.454.CMB.1.raw
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
  modified_base (362)..(362): a, c, t, g, unknown or other
  misc_feature (362)..(362): n is a, c, g, or t
  modified_base (394)..(394): a, c, t, g, unknown or other
  misc_feature (394)..(394): n is a, c, g, or t
  modified_base (423)..(423): a, c, t, g, unknown or other
  misc_feature (423)..(423): n is a, c, g, or t
  modified_base (444)..(444): a, c, t, g, unknown or other
  misc_feature (444)..(444): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatccacttgccgggcagtcaggccatcagcgattctttagcctggttgcagcagaaaccgngggcgacgcccctcagactcggtagtctagtggtcgcatccagtattgacgtaaggggtcgggtcccagtcccgaggttcaggtggctagtgntactcgtgggacagtattacgactctacactntacagcagcctgccagcctagtaacgttntttgacttaatttattacgtntacaattattacttaatccgttaccctaggtcgtacggttccggacgacgggactaagggtagacggtaccaacggtactggtacgctcgtaccg

SEQ ID NO: 216850 - DNA, 504 bp, Homo sapiens
  misc_feature: GYAE6OF02FQKYH.1.34.D01.1.454.CMB.1.raw
  modified_base (224)..(224): a, c, t, g, unknown or other
  misc_feature (224)..(224): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (373)..(373): a, c, t, g, unknown or other
  misc_feature (373)..(373): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggngagtcaggccatcagcgattctttagcctggttncagcagaaaccngggcagcccctnagatcgtagtctatggtgcatccagattgcaagggtgggtcccatccaggttcagtggcagtgcatctgggacagattacactctcactancagcagcctgcagctgaatatttcgataattattactgtacaactagtacttatacgtaccctagtcgacgtcggaccgagggaccgtaaggtcgaacgtacgaaccgtaacgtcgtacggacgtgtaccg

SEQ ID NO: 216851 - DNA, 674 bp, Homo sapiens
  misc_feature: GYAE6OF02I4VGI.1.34.D01.1.454.CMB.1.raw
  modified_base (151)..(151): a, c, t, g, unknown or other
  misc_feature (151)..(151): n is a, c, g, or t
  modified_base (198)..(198): a, c, t, g, unknown or other
  misc_feature (198)..(198): n is a, c, g, or t
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (662)..(662): a, c, t, g, unknown or other
  misc_feature (662)..(662): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacntaccaattgacccagtctccatcctccctgtctgcatctagttgganacgagagtcaccatcaacgttggcccgggagtacgtcgaggccagtccaggcgtatttcgtttagccttggttcncgtagcgaacgaaaccgngggccgaccgccccgtnagtactcgtagtctagtcgggtcnctacnccgagtacgtcgacggtaacggtccgggtaccaacgttccgtacgggtttcagggttcggactacggttcgacctacgttccggacgggtacaggttaacttacccgccttacgtacaacgttactcgacgtcaccggtctacggactacggtacgtaggtaacgtttacgtttcgtaactttaagttttacctaccgttagtaacctaacgttagtttaacgttaaccgtaccgttacccgggtagttacgggtacccggttaccggaacgggtaccgggtaacgtaaggtacggtaacgttaccgaaccggtgtaaccggtcncggtacctaccg

SEQ ID NO: 216852 - DNA, 449 bp, Homo sapiens
  misc_feature: GYAE6OF02GLV6E.1.34.D01.1.454.CMB.1.raw
  modified_base (351)..(351): a, c, t, g, unknown or other
  misc_feature (351)..(351): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (412)..(413): a, c, t, g, unknown or other
  misc_feature (412)..(413): n is a, c, g, or t
  modified_base (417)..(417): a, c, t, g, unknown or other
  misc_feature (417)..(417): n is a, c, g, or t
  modified_base (421)..(449): a, c, t, g, unknown or other
  misc_feature (421)..(449): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagattttgctaatttattactgtacaacagttatttatacgtaccccctagtggacgtttcggaccaggggacccaaggtggaacgtcaaaccgaactggtacggctcgacaccatctggtccttcntccttcccgcattctagacgcacttcgtctgacgcggctggaccaaggcgcagtagnancnngacngctnnnnnnnnnnnnnnnnnnnnnnnnnnnnn

SEQ ID NO: 216853 - DNA, 754 bp, Homo sapiens
  misc_feature: GYAE6OF02J1VAY.1.34.D01.1.454.CMB.1.raw
  modified_base (143)..(143): a, c, t, g, unknown or other
  misc_feature (143)..(143): n is a, c, g, or t
  modified_base (722)..(722): a, c, t, g, unknown or other
  misc_feature (722)..(722): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccngctgtgaccatccaattgacccagtcctaccactccctccctgtctgcattctagttggacgacagactcaccatcctacgttcggccgggcaagtcacggccatccgagcgtacttcgttacgccgttggttcgcacgacaacggaaaccggtacgggaccgaccgtccccgcagacgttcgtacggtacttaggtcggtctacgactacccgaggttacgttacgacggtaaggggttccgggtaccctaacgtcccggtaggttacgtacggtcggtacgtacgtcgtacgtaacggttacgttcgggaacctacggttacgtttaaccaccgttttcaaccgtacgtttacgaccgtaccggactacccggtccttcggaacctccgggttaacctagggtaaaccgtttagttttacgtactttaaacgttttacttaccgtacgtaactaaacggttatttaacgttaaccgttaaccggttacccttacggtaccggttacggttcccccggaacgtaaaccgggggtaataaccggggttaacggtaacgggttaacccctaaaccgggtntttaaccggggtcggttaccgaggtaaccccc

SEQ ID NO: 216854 - DNA, 408 bp, Homo sapiens
  misc_feature: GYAE6OF02FH21R.1.34.D01.1.454.CMB.1.raw
  modified_base (358)..(358): a, c, t, g, unknown or other
  misc_feature (358)..(358): n is a, c, g, or t
  modified_base (386)..(386): a, c, t, g, unknown or other
  misc_feature (386)..(386): n is a, c, g, or t
  modified_base (391)..(408): a, c, t, g, unknown or other
  misc_feature (391)..(408): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttatactgtcaacagtattatacgtacccctagtggaccgttcggcctaggggaccaaggtggaagtcaaaccgactggtacggctgacaccatctgtcttcatcctcccgcatctgaacncactcgtctgacgtcggctggcaaggcnatagnnnnnnnnnnnnnnnnnn

SEQ ID NO: 216855 - DNA, 608 bp, Homo sapiens
  misc_feature: GYAE6OF02GB2TD.1.34.D01.1.454.CMB.1.raw
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcagaaaccgngggcgacgcccctnagatcgtagtctatggtgacatccagtattggacgaacggggttcgggtacccctatccgtagggttcaggtggactaggtcgcagtcgtaggacagtacttacactctctaactatcgagcacgcctagccgacgcctaggaattatttcgaactttaatttacttactacgtaacaacgtagtttaactacgtaaccgttaccccgtagggttaggtaccggttccggaccgaacggggtaactagggtacgaaccgttaccgaaccgggtacgttcggtcggtacctggaaccctaaccgtatttcccgtagttacccgtttcccacgtttccccctacccggtac

SEQ ID NO: 216856 - DNA, 816 bp, Homo sapiens
  misc_feature: GYAE6OF02HRSNC.1.34.D01.1.454.CMB.1.raw
  modified_base (266)..(266): a, c, t, g, unknown or other
  misc_feature (266)..(266): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatcctccctgtctgcatctattggagacagagtcaccactctacttggccgggcgagtcacggccatcaagcgtatttcttagccgtggttcncagacaaacggaaaccgaggggtaccaccgcccctgaacgagtcgttagtcttaagtcggtcgctaacgtccgtagtatttacggacgtaaggggttccgggtacccaacgttcccgtaagggtttctaacgggttcggacctaagggttccgtaacgtacggttaccggtaagggggtaaccctaacgggtaaacctttaaacccgtacccgtttaacccgttaactaaccctaagttaccgaacgtaccgtaacccggtccttacggaacccgtacgtaacccgttaaagtaaacggtttcgtttttaacaagtttttaaactttttacgttaaaccttcggtaaaccttaaacgttaaagtttaactttaaacgttaaacccgttttaacccggttaaccggtttacggggtttaacccgggttaacccgggttaaccgggtaaccgggggtaaaccggttaaaggggttaaccggttaaacggttaaccccgggtaaaaccgtacgggttttaaccgggtacggttcccggttaacgtaaccccgg

SEQ ID NO: 216857 - DNA, 386 bp, Homo sapiens
  misc_feature: GYAE6OF02FVGVP.1.34.D01.1.454.CMB.1.raw
  modified_base (323)..(323): a, c, t, g, unknown or other
  misc_feature (323)..(323): n is a, c, g, or t
  modified_base (328)..(329): a, c, t, g, unknown or other
  misc_feature (328)..(329): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (375)..(386): a, c, t, g, unknown or other
  misc_feature (375)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaattttattactgtcaacagtattatagtaccccctagtggacgttcggccaggggaccaaggtgaagtcaacgatgtgctgcacatcngtctnntctccgcntctgacncactctntgagcggctggcaaggcncatagnnnnnnnnnnnn

SEQ ID NO: 216858 - DNA, 568 bp, Homo sapiens
  misc_feature: GYAE6OF02I6419.1.34.D01.1.454.CMB.1.raw
  modified_base (102)..(102): a, c, t, g, unknown or other
  misc_feature (102)..(102): n is a, c, g, or t
  modified_base (196)..(196): a, c, t, g, unknown or other
  misc_feature (196)..(196): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
  modified_base (468)..(468): a, c, t, g, unknown or other
  misc_feature (468)..(468): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctcctgtctgcatctattgganacagacgtcaaccatcacgttgccgggcagtccaggccatcagcgatttcttagccgtggttacgcagacaagaaaccgngggcacgcccctanagactacgtagtctagtcggtnacactccagtacttgacgaagggttcgggtcccagtcctaaggttcaggtggacagtcgctaagtcgtaggaacagtactacactctacatatcacgcacgcctagacgagtcctagaacgttatttacgattaaagtttacttacgtacgttaanaactagttaactacgtaacgttaccgtcgttagtacggttccggacgaacgggtaccaaggtacggaagtaccgtaacgtaacgtggtacgtctaggacc

SEQ ID NO: 216859 - DNA, 741 bp, Homo sapiens
  misc_feature: GYAE6OF02I471K.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttggcccgggcagtcaggccagtcagcgtattccgtttagccgttggttcgctaggccaacggaaaaccgagggggaccaccggccccctgaagagtacgtagttctaagtcgggtcgctaactccgaagtacttcgacgtaacgggtccgggtacccagttccgtaggttcgaaggtcggacgtaggtacgaccgtagtccggtaggaaccgtaggttaactttaacctacttccgtaactaacgttacgtccgaacgtaccaggcccgttaggaccgtaaccggttcgtaacgttaaacgtttcgttttaggaacctttaaaagtttttaccttaaccgttagttaaaccctaacgtttaagtttaactttaaaccgtttaacccggttaacccgttcgggttaccgggttaccgggttacccggaaccggggtttaacgggaacccgttaagggtttaacccgggtaaaccggttaacccggaaccgtttaccggtcggttaaccgggtacctaccggtaacccgg

SEQ ID NO: 216860 - DNA, 746 bp, Homo sapiens
  misc_feature: GYAE6OF02JCKMG.1.34.D01.1.454.CMB.1.raw
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatgagggtcccgctcagctcctggggctcctgctgctctggctcccaggtaccagctcgtgacatccaattgacccagtctccatcctcctgtctgcatctattggagacagagtcaccatcacttgccgggcagtcaggccatcagcgattcttagcctggttgcagcagaaaccngggcacgcccctnagatcgtagtctagtggtcgcactccgaagtacttggacgtaaggggttcgggtaccccaagtcccgtaggtttcaggttcggacaggtcgactagttcgtacgggaactaggtaacttaccgacctacgtcctaacttactacgacgaccgacgtacccttaggacctacggtacccttagggtaaacgtttacgttttacggtaccctttaaagtttttacgtttaaccgttacgttaaccgtaaacgtaacgtttttaaacgtttaaaccggtttaacccggttaacccccgtttaacgggtttaccggggttaaacccgggtttttacccggggaaccccgggtttaaaacggggggtaaccccggtttaaaacggggttacggggtaaaacccggttaacccggtaaaccccgggttaacggtttaccggggttaccgggttacccggttcggtaaaccccgg

SEQ ID NO: 216861 - DNA, 471 bp, Homo sapiens
  misc_feature: GYAE6OF02HRFJ1.1.34.D01.1.454.CMB.1.raw
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
  modified_base (440)..(471): a, c, t, g, unknown or other
  misc_feature (440)..(471): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcacgcctgccacgcctagaagtattttgacttaattttacttatgtacaacagttaattatacgtacccctacggtggtaccgttcggccgagggaccaaggtggaagtaccaaccgaactgngctcgcacntctgtcttcactccttcccgcccttcctacnccgaccacttccgtcgtaggtacggcgggtccgtacgggacgaaacgggcggactaacgtagctagcgnnnnnnnnnnnnnnnnnnnnnnnnnnnnnnnn

SEQ ID NO: 216862 - DNA, 651 bp, Homo sapiens
  misc_feature: GYAE6OF02HMPMG.1.34.D01.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (331)..(331): a, c, t, g, unknown or other
  misc_feature (331)..(331): n is a, c, g, or t
  modified_base (386)..(386): a, c, t, g, unknown or other
  misc_feature (386)..(386): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctagttgganacagcgtcaccatccacttcggcccggggcacgtcgaggcccatcaggcctagtttctttagccgttggttcgctagcaacgaaaccgnggggacgaccgcccctacgagactcgtagtctagtcgggtcncactccgagtgttgacgtacgggtccggtcccagtccgacggttgacggtggtcngtcgactagtcggtacgggaactacggtacttaccacttcctacgactatccagacacggtccctgacacgtacgttagaacgtttcgtttactaacgttaattttactacgtcgttaacaaagttgttaaacgttactaacccgtttaccgttacggtacggttaccgggttccgggaacccggtaaggggaaccggttaaaggaccggtttaaacgtacccggtaaaccggtaggttacgggttacggtcccgtacgtacccg

SEQ ID NO: 216863 - DNA, 704 bp, Homo sapiens
  misc_feature: GYAE6OF02JDDTU.1.34.D01.1.454.CMB.1.raw
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgaattctttagcctggttgcagcaagaaaccagggcagcccctanagactcgagtctagtcggtnacgatcccgaagtattcggacgtaagggttccggggtaccctaagttccccggtaaggggttttaccgagggtttacggggcaagggttcgacctaagttcccgtaggggaactaaggtactttaccgactcgtaccgtaactactcgacgtacacgtccgtacgcacgtctaggtagttatttagacttaactttattacgtcgtacgaaatagtttaacgtacgttaaccgttaccccgttaggttacccgggtacgttacccggggaaccggaacgggggtaaccctaaaggggttcggtaaacggttaaccgtaccgtaaacggttcgggttaaccggacgttaccgaaccgttaccgtaccgtttccgtttacggtttacccttcccgttacctttaccccgttacccccggttaccccc

SEQ ID NO: 216864 - DNA, 696 bp, Homo sapiens
  misc_feature: GYAE6OF02FKUF5.1.34.D01.1.454.CMB.1.raw
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
  modified_base (435)..(435): a, c, t, g, unknown or other
  misc_feature (435)..(435): n is a, c, g, or t
  modified_base (467)..(467): a, c, t, g, unknown or other
  misc_feature (467)..(467): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctagttggagacagacgtccacatcacttggccgggnagtcnggccatcagcgtattctttagccgttggtcgcagcaacggtaaaccnggggctacggcccctgacgatccgtagtcctagtggtcgtactataccgagtatttcgacggtaaaggtccgggtacccagtcccgtagttccgaaggttcggaccgtggtacgctactcgtaggggactaggtacttacacgttcgtacacttaanctagccacgtccgtacgcgacgtccggttaanaagttcgtttacggacttaattttaacggttacttacggttaactaacgttaagttaacgttttaacaacccggtttaaaccccgttcgggtttacgggaacccggttttacgggtaaccccggaacggggggtaacccgttaaacgggtaaccggggttaacgtttaaaccccggaacccgggtaaaccggttttgggaaccggggttttaccaaggggttaaccccc

SEQ ID NO: 216865 - DNA, 635 bp, Homo sapiens
  misc_feature: GYAE6OF02GC2NG.1.34.D01.1.454.CMB.1.raw
  modified_base (186)..(186): a, c, t, g, unknown or other
  misc_feature (186)..(186): n is a, c, g, or t
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (476)..(476): a, c, t, g, unknown or other
  misc_feature (476)..(476): n is a, c, g, or t
tcagacgagtgcgtcacgaccggtgctcgatttagatcgtctgtgttggggtttgggggagtcagaccctgtcaggacacagcatggacatgagggtccccgctcagctcctgggctcctgctgctctggctcccaggtaccagctgtagacataccaattcgacccatctccatcctcctgtctncatctattggagacanagtcaccatcattgccgggnagtcaggccatacagcgattcttagcctggttnacacgacaaaggaaaccgagggaccgaccgcccctacgaacgagttaccgtagtctagtgggtacacagtccagtattacgacgtaacgggttcgggtaccctaagtacccgtaggttccgaaggttcggacgtaagtgactactacgggtacggaacaacgtacttaaccgtactacttaaccaccgttaatacgaacgcgtacgacccttacggaaccncgtaccgtaagaacgttattttacggaacttaaacttttacgttaacttacgtaactaacgttagttaactaacttaccggtaaccctcggtacgtacggtacggacggtacgggaacgtaaggtacggaagtaccgaacgtacgtagtcgatcgaccg

SEQ ID NO: 216866 - DNA, 704 bp, Homo sapiens
  misc_feature: GYAE6OF02JHT7E.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctggtgacactaccaattgaccctagtcctccactcctccctgtctgcatctattggagacagacgtcaccatccacttggcccggggagacgtccaggcccatcgagcgtatttcctttacgccgttggttcgcgagacgaacggaaaccgacggggccgaccgcccccttacgacgtacgtccgttaggtacttagtcgggtcgacctataccgagtacgttcgacggtaagggttcgggtcccaagttccgtaggttccaggtcgggctagggtcgaccgtgtacggtcggacgtaggtacttacacctactactaacttacgtacgactccggacgtccgtacgactacgtccgttagtaaacgtttactttaccggttaacttaaattttaccgttaaccgtacgttaaccgtaattaacgtttaatttaaaccgttaccgttaaccccgttacgggttaccggttaccggtccgggtacccgggtaaaggggtaccgtaagggtacggtaaaccgttccgaaaccggtacggtcggtcgggtcctacggacccg

SEQ ID NO: 216867 - DNA, 475 bp, Homo sapiens
  misc_feature: GYAE6OF02I4W2H.1.34.D01.1.454.CMB.1.raw
  modified_base (380)..(380): a, c, t, g, unknown or other
  misc_feature (380)..(380): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (437)..(475): a, c, t, g, unknown or other
  misc_feature (437)..(475): n is a, c, g, or t
tcagacgagtgcgtcacgaccggtgctcgatttagatcgtctgtgttgggtttgggagtcagtccatcagcgattcttttagcctggttgcagcagaaaccagggcgagcccctcagatcgtagtctatggtgcatccagattgcaaggtggggtcccatccaggttcagtggcagtgcatctggggacagattacactctcactatcagcagcctgcacgcctgaaagtattttgactaaattttacttactgtacaaacagttattaatacgtacccctagtggacgtttcggaccagggggaccaaaggtggaacgtacaaaccgaactgtggactgacaccatctgtcttcatccgtttcccgcctatctagaacncctaactcgtactggacgtcggggctacgggacaacgggcacgtaagtagnangatnnnnnnnnnnnnnnnnnnnnnnnnnnnnnnnnnnnnnnn

SEQ ID NO: 216868 - DNA, 811 bp, Homo sapiens
  misc_feature: GYAE6OF02IIA5H.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccactccctccctgtctgcctactctagttcggagacaggacgtcacctatcctacgttcggccgggcgtaacgtcgacggcctaagtcacgcgtatttctttacgccgttggttcgcaggacgaacgaaaccggtacgggccaacggtcccccgtagaacgtacgttaccgtaagttctaggtcggtaggacctaactcccgtaagtacttacggaccggtaacgggggttaccgggtaccctaacgttacccgtacgggtttaccgaacggttcggacgtaacggtggtaccctaacggttaccggtggggtaaacctacggttaaaccgttaacccgtaacccttccgttaaacctaaccgttactaaccggaacgtacccgttaaacggtcccttacgggaaccgtaccggtaacccgttaaggttaaacgtttacgttttaacgtaacttttaacgtttaaacgtttaccgttaaagtaacccggttaaattaaacggttttaaacttaaccgggttaaccgttaaccccgttagggtcggttaccggttaccgggaccggttaaccgggaaccggtacgggtacggtaactacccggtaacggtaaccgtcggttacggtacctcggtaacccg

SEQ ID NO: 216869 - DNA, 620 bp, Homo sapiens
  misc_feature: GYAE6OF02GTYV5.1.34.D01.1.454.CMB.1.raw
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
  modified_base (420)..(420): a, c, t, g, unknown or other
  misc_feature (420)..(420): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattgganacagagtcaaccatccacgttcggccgggtcgagtccaggccatccgagcgtattctttagcctggttncagcaagaaaccgngggcacgcccctgagatcgtagtctagtcggtncgatccaagtatcgacgaagggttcggtacccagtccgtaggtacgagtggactaggtcgctaagtcggtacgggaactagtaactacgtacttcgtcaacgttancgacgcgacgctaggcacgtcgtagtattatttacgacttaatttacttacgtattaactaacgtagtttaacttaacgttaacccgttacccgttaaggttccggtacgtttccgggaaccggtaacggggtacgtaaacgggttacgggtaaactaccggtaaaccggttacgttaggtaacgggtcctacggtaccc

SEQ ID NO: 216870 - DNA, 682 bp, Homo sapiens
  misc_feature: GYAE6OF02HM5KO.1.34.D01.1.454.CMB.1.raw
  modified_base (102)..(102): a, c, t, g, unknown or other
  misc_feature (102)..(102): n is a, c, g, or t
  modified_base (553)..(553): a, c, t, g, unknown or other
  misc_feature (553)..(553): n is a, c, g, or t
tcagacgagtgcgtcacgaccggtgctcgatttagatcgtctgtgttgggtttgggggtagtcagacctgtcaggacacagcatggacatgagggtccccgntcagctcctggggctcctgctgctcgtggctcccaggtaccagctgtgactactccaaattcgaccctagtcctccactccctcctgtacctgcattctagtggagacagacgtcacctataccacggttcggccgggacgatccggaacggccattccgaagacgtactttactttacgccttgggttctcgagaccaacgaaaaccgagggtaccgaaccggtaccccgtacacggtaacttacggtacgttcttaacgtaggttcggacagtacctaggtatcggacggtaaacggggtcgggtacccgtaactaccggacgggtttacgtaggcggtaacgtacggtgtactagttaccggtagggaacctaagtaacgttaactaacggtctacgaattacgttacgacgactacgactcggttacgaagcccgtagtaaacgttnttccgtaaattaagttacttactgtaacctaattagttaacttaaataccggtaacctcgtacgtacgttcggacggacggtaacggtcggaaacgtcgaacgtaaccgattaacgggctacgcgtaac

SEQ ID NO: 216871 - DNA, 814 bp, Homo sapiens
  misc_feature: GYAE6OF02FS3P1.1.34.D01.1.454.CMB.1.raw
tcagacgagtgcgtcacgaccggtgctcgatttagatcgtctgtgttggggtttgggggagtcagaccctgtcaggacacagcatggacatgacgggtccccgctcagctccgtggggctcctgctgctctggctccgaggtaccagctgtgacatcctaattcgacccagtcctccatcctcctgtctgcatctagtcggagacagagtccaccatctacttcggaccgggcgacgtcgacggtaccagtcagtcgtactttctttacgccgttggttcgacgtacggacaaacggtaaaaccggcggggtaccgaccgtacccccgtacgaacggtacgttcggttaacgtcgtttaaggtcgggtcaacctacgtccgagtaacgtttcggaacgtaagggggtccgggtaccctacgtaccggtaggttcgaagggtcggtacacgtgacgtacgttacggtacggggaactaacggttacttaaccggtcttaccgtaactacgttaacacgtacgaccgtacgtcccgtagccgtaaccgtacgttacggtaaagttttacctttacggtaaactttttaaagtttaccgtttaacggtacgttaacccttaaagttaaacgtttacgtttaaaaccgttttaccccggtaacccggtttaacggggtttaccggtaccgggttttaacccggggaaccgggtaacggggggtttaaacccggtaaagggggttacccggtaaacggttaacccggttaaacggttaaccggggttgggttaacccgttccggaaccgtttacccggg

SEQ ID NO: 216872 - DNA, 508 bp, Homo sapiens
  misc_feature: GYAE6OF02FJXMT.1.34.D01.1.454.CMB.1.raw
  modified_base (470)..(471): a, c, t, g, unknown or other
  misc_feature (470)..(471): n is a, c, g, or t
  modified_base (473)..(508): a, c, t, g, unknown or other
  misc_feature (473)..(508): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaattttattactgtacaactagtattactacgtaccccctagtacggtacgttccggaccgtagggggaccctaaggggtggaaacgtccaaaccggaacttggtaggccttggccaaccattcctagttccttacacttcccttaccccaccccttccctacacccgtcctaccgttccgtccgtacggaccggtccggggtacgtcgggaccaaacgggcctagtacgtagcanncnnnnnnnnnnnnnnnnnnnnnnnnnnnnnnnnnnnn

SEQ ID NO: 216873 - DNA, 783 bp, Homo sapiens
  misc_feature: GYAE6OF02JT3IT.1.34.D01.1.454.CMB.1.raw
  modified_base (173)..(173): a, c, t, g, unknown or other
  misc_feature (173)..(173): n is a, c, g, or t
  modified_base (271)..(271): a, c, t, g, unknown or other
  misc_feature (271)..(271): n is a, c, g, or t
  modified_base (313)..(313): a, c, t, g, unknown or other
  misc_feature (313)..(313): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtctccatcctccctgtctgcatctattgganacagtacgtcaccatctacgttcggccgggacgtagtcacggcctagtccgaagtcgtattttcgttacgtccgttggttagctaagacaagaaccgngggcaaccggcccctgagtactcgtacgttctagtgggtacncacgtccaagtacgttggaccggtaaggggttcccgggtccaacgttccgtaggttccgaagggttcggacgtaaggtcgaccgtacgttacggtacggggtaactaacggttacttaccgtaccgttactacccgtaagttaccgtacaacggttcaaccggtcgtttacgacggttaaccgtaccgttaagttaacgtttttacgtttccgaaactttttaacgtttactttaccggtactaacccgttaattaagtttaaactttacggttaacccgttaccccggttaaggttacggtaccgggttacccggtaacggggtaacgggtaaacccgttaagggtaaaccgaccggttaaaccggttaccgtacgttagggttaaccggttacgtccgggtaaccttacgtaccgtttacgtttccggttacctttaccgtacccgtttcccgttaacccccttcccg

SEQ ID NO: 216874 - DNA, 646 bp, Homo sapiens
  misc_feature: GYAE6OF02JOY4B.1.34.D01.1.454.CMB.1.raw
  modified_base (101)..(101): a, c, t, g, unknown or other
  misc_feature (101)..(101): n is a, c, g, or t
  modified_base (193)..(193): a, c, t, g, unknown or other
  misc_feature (193)..(193): n is a, c, g, or t
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtcccgntcagctctgggctcctgctgctctggctcccaggtaccagctgtgacatccaattgacccagtctccatcctccctgtctgcatctatgganacagagtcaccatcaacgttcggccgggcacgtcgacggccaagtccagcgtatttcttagccttggttcncgtagcgaagtaaaccgagggccaacgccccgtanagagttaccgtagttctaacgtcgggtgacctatccgtaaggtatttcgggaccgtaaagggggttccgggtaccccagttcccgtaacggtttcgaacggttcgggcaagggtttccgacgtaaccgttcggtagggactaagtaactttaccgacttcctacgaacttacgcaacggtccacgtcctgaacctgtaccgtagaacgtttgttacgtacttaagttttaactcgtacttaacacgttattaacgtacttaaccgtaccgttacgtcgggtaccgtcggacggtaaccggagtaaacggtcgaacgtacgtaacggtattcgggactcgtacgtacg

SEQ ID NO: 216875 - DNA, 689 bp, Homo sapiens
  misc_feature: GYAE6OF02I5MCX.1.34.D01.1.454.CMB.1.raw
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagacgtcaccatcacgttcgccgggcgagtcaggccatcagcgtatttcttacgccgtggttgcagcagaaaccgngggcgacgcccctgagacgtcgtagtctagtcggtncactccagtagtcgacgtaaggtccgggtaccatccgtaggttcgtaggcggtacaggtcgactacgtcggtacgggaactacgtaacgttaccaccttacttaccgtaacttacgtacgacgtaccgtacggacccttcggaacgtaccggtacccgttaaggttaacgttacgttttaccgaacttttaaacttttacttaccgttagttaaacctaaacgtttagtttaaacgtttaacttaacccgttaaccccgttagggtaccggtttaccggtaccgggtaacccgggtacgggtaaaccggttaaacgggtacggtaaaccgttaccggtaaacccgtacggttcggaccggttacgtacgtaaccccg

SEQ ID NO: 216876 - DNA, 641 bp, Homo sapiens
  misc_feature: GYAE6OF02FYTU3.1.34.D01.1.454.CMB.1.raw
  modified_base (243)..(243): a, c, t, g, unknown or other
  misc_feature (243)..(243): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgacgcccctacagactcggtacgtctagtggtcgcaacgtccaagtattcggacgtaaaggggttcggggtacccagtccgtaagggttcaggtcggctagtgctatcgtagggactagtaattacaacttccacgtacttacgtaccacgccgtacgtccgtaggcctaacgccgttagaagttacgtttacgacttaaattttactacgtgtactaagtattaattactaccgttaacccgtagggtacggtacccgttacggaccggtaacggggaactaacggggtacgtaacggtaccgaacccggtagttcgggtacggtacgtccgtacccgtaaccgtagttaccgttcgttaccgttacgtacccgtttcccgtccccgtaaccg

SEQ ID NO: 216877 - DNA, 681 bp, Homo sapiens
  misc_feature: GYAE6OF02HIQ2I.1.34.D01.1.454.CMB.1.raw
  modified_base (309)..(309): a, c, t, g, unknown or other
  misc_feature (309)..(309): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagttggagacagagtcaccatcacgttcggccgggcgagtcaggccatcagcgtatttctttagccttggttgcagcaagaaaccagggccagcccctgagtatcgtagtctagtggtncatccgagtattcgacgtaagggtcgggtaccctacgtccgtaggttcaaggtcggactaaggtcgactacgttcggtacgggtaactacggtaacttaaccgtaccttaccgttaacaaccttagtaccgtaacggtccaacgtcccgtgacccgacggtacccgttaggtaaacgtttacgtttttacgaactttaaagttttacgttaaccgttagtaacctaaacgttaagtttaacttaaacgttaaaccgttaccccgttaacgggttagggttaaccggttaccgggaaccggtaacggggtacctaaggggtacgtaaccggtaacctaaccggtaacggttcggacggttaccgtagtacccg

SEQ ID NO: 216878 - DNA, 568 bp, Homo sapiens
  misc_feature: GYAE6OF02F4CLA.1.34.D01.1.454.CMB.1.raw
  modified_base (102)..(102): a, c, t, g, unknown or other
  misc_feature (102)..(102): n is a, c, g, or t
  modified_base (421)..(421): a, c, t, g, unknown or other
  misc_feature (421)..(421): n is a, c, g, or t
  modified_base (440)..(440): a, c, t, g, unknown or other
  misc_feature (440)..(440): n is a, c, g, or t
  modified_base (562)..(562): a, c, t, g, unknown or other
  misc_feature (562)..(562): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctcctgtctgcatctattggagacagagtcaccatccacttggccggcgagtcaggccatcagcgtattcttagccttggtgacagcaagaaaccgagggacacgccccctacgagtatcgtagtctagtggtcgctaatccaagtattagacgtaagggttcgggtaccctacgtaccgtaggttacaggtgacgtgtagcatcggtacgggactagtacttacacttcactactatcagcagccngacacgtactagtaagttntttcgatttaattattacctagtactaactagttacttagtaaccgtaccctaggtcggtacgttccgggacgtaacgggacgaagggttacgaaggtaccgaacgtagttacggcgtactntaaccg

SEQ ID NO: 216879 - DNA, 532 bp, Homo sapiens
  misc_feature: GYAE6OF02ITDT3.1.34.D01.1.454.CMB.1.raw
  modified_base (133)..(133): a, c, t, g, unknown or other
  misc_feature (133)..(133): n is a, c, g, or t
  modified_base (239)..(239): a, c, t, g, unknown or other
  misc_feature (239)..(239): n is a, c, g, or t
  modified_base (467)..(467): a, c, t, g, unknown or other
  misc_feature (467)..(467): n is a, c, g, or t
  modified_base (494)..(495): a, c, t, g, unknown or other
  misc_feature (494)..(495): n is a, c, g, or t
  modified_base (497)..(532): a, c, t, g, unknown or other
  misc_feature (497)..(532): n is a, c, g, or t
tcagacgagtgcgtcacgaccggtgctcgatttagatcgtctgtgttgggtttggtagtcaggccatcagcgattctttagcctggttgcagcagaaaccagggcgacgcccctcagatcgtagtctatggtncatccagattgcaagggtggggtcccatccaggttcagtggcaggtgcatcgtgggacagtattacactctcactatcagcagtccctggcagcctaggaaacgtnttttagacttaaatttacttacctagtaccaaatagtttaattaacgttaaccgttacccctaaggtgggtaaccggttccgggacccgaggggggtaacccaaaggggttcggaaacgtaccgaaaccgtaacgtcgttggcctaggccaacctatccgttgtacttactctcccgttacccgctaactcgtaacgacgaccgtcttcggtccagacgggtccgggntcgaccggtaagggccgagtaactgtnngnnnnnnnnnnnnnnnnnnnnnnnnnnnnnnnnnnnn

SEQ ID NO: 216880 - DNA, 858 bp, Homo sapiens
  misc_feature: GYAE6OF02JGD0S.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggcctcccgaggtaccagctgtgacatccaattgaccctagtcctccactcccttccgtgtctgctacttcttagttggaacgacaggtacgtccaacctattcctacggttcgggacccggggacgtacgtccgaacggccatcgacgacgtactttaccgtttacgccgttgggttcgcctagaccgaaacggaaaaccgacggggaccgaaccggtccccctacggacgtaccgttaccgtacgttacgttacgttcgggtacgtaccgtactaccgtaacggtacgttcggaccggtaacgggggttccggtaccccgtaaccgttaccgggttacggttaccggtacggtcggtacggtacgggtcgtaaccgtcggtaccgggttacggggaaccttaaacggtttacctttaacccgtacccgttaccccttaaaccggttaaacccttaccttaacggtaccgaaccgtaccgggtacccgttacgggaccctaaccgggtacccgttaaaggtaacgttttacgttttaaccggttagttttaaaccgttttaccgttaccgttacgttaaccggttaaacgttacgtttaacctttaaccgttaaccgtttaacccgttacccgggtaggttaacccggtttccggaaccgggtaaccgggtaacgtaacggtacgtaaccgtacgtaaccggtaacgttggaccgtacgtgtaacccg

SEQ ID NO: 216881 - DNA, 755 bp, Homo sapiens
  misc_feature: GYAE6OF02HQGUK.1.34.D01.1.454.CMB.1.raw
  modified_base (200)..(200): a, c, t, g, unknown or other
  misc_feature (200)..(200): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccgaggtaccagctgtgacatccaattcgacccagtcctccatcctcctgtctgcatctattgganacagagtcacatcacgtcggccgggcgagtcgagccatcgacgctattcgtttacgtccgtgggttgcagacgaacggaaaccgtacggggccgaccgccccctacgaacgtacgtcggttaaggtcttaaggtggtgacctacttccgaagtacgttgaacgtaacggttcgggtaccggggtaccctacgttccggtaggtttacggaggtcgggactggttagaccgtagtcggtagggactaagtaacttaccgtaaccttctacctaactactaccgacgaccgacgtcccgttagaccgtacgtaccggtaaagttacgttagttttaacgacttttaaaacgttttacctttaacttacggtaacttaaaccggttaagtttaaacttaaaccgtttaaacccttaccccggtttaacgggtaccgggtttaccggggttaacccggtaaccggggtaaacggggtaaccggttaaaacggggtaccggttaaaaccggtacccgttaaaaccgggtaaccgtttgggttaccgtccggttaacccgg

SEQ ID NO: 216882 - DNA, 527 bp, Homo sapiens
  misc_feature: GYAE6OF02FHR0F.1.34.D01.1.454.CMB.1.raw
  modified_base (278)..(278): a, c, t, g, unknown or other
  misc_feature (278)..(278): n is a, c, g, or t
  modified_base (407)..(407): a, c, t, g, unknown or other
  misc_feature (407)..(407): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtccaccatcacttgccgggcaatcaggccatcagcgatctttagcctggtgcagcagaaccagggcacgcccctnagatcgtagtctagtggtgcatccgagattgacgaagggtcgggaccctagtccaggttcagtggcagtgcatcgtagggacagtagttacactctacgactatccgagcacgcctgcacgctgaagtnttttacgacttaattattacgtgtaccaatagttattactacgtaccctaggtcggaccgttcggaccggagggaccgtaaggtggaacgtaccgaacgtacgtaggcgtctagtacccg

SEQ ID NO: 216883 - DNA, 762 bp, Homo sapiens
  misc_feature: GYAE6OF02JRWBT.1.34.D01.1.454.CMB.1.raw
  modified_base (265)..(265): a, c, t, g, unknown or other
  misc_feature (265)..(265): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatcctccctgtctgcattctatggatacagagtcaccatcacttgccgggacagtcaggccatcgagcgtattccgtttagccttgggttcncgtagacctaaggaaaacccgtaggggccgtaacgcccccttacgacggtacgttccggttaagttcctaagttcggggtacgtcctaacgttcccgtaacgttaacgtttaccggaccggttaaacgggggttccgggggttaccccctaacggttcccggtaaacggggttttacccgaagggttacgggtaccgtaagggtccgtacgttaacggtccggtaacggggtaactacggttaaacgttacccgtaaaccgttccgttacccgtaaacgttacgtaccgaaccgggtacctaaccggtcccgttaacggaccctacggtacccgttaaggtaaaccggtttcttttaacgggactttaaacttttacttacgtacgtaaccttaaacgtagttattaccgtaaccgttacccgtaggtacgtcgttaccggaccgtacgggtaacgaggttacggaacttacgaacgtagtacgtcggactggtacc

SEQ ID NO: 216884 - DNA, 423 bp, Homo sapiens
  misc_feature: GYAE6OF02JDVUO.1.34.D01.1.454.CMB.1.raw
  modified_base (397)..(423): a, c, t, g, unknown or other
  misc_feature (397)..(423): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttattactgtcaacagtattatagtacccctacgtggacgttcggccaggggaccaaggtgaatcaaccgaactggtgctgcaccatctgtcttcactcttcccgcatcctgaacgcacttcgtctgacgcgggcttcggacaaagggtcacagttacgnnnnnnnnnnnnnnnnnnnnnnnnnnn

SEQ ID NO: 216885 - DNA, 659 bp, Homo sapiens
  misc_feature: GYAE6OF02GH210.1.34.D01.1.454.CMB.1.raw
  modified_base (202)..(202): a, c, t, g, unknown or other
  misc_feature (202)..(202): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttggggtttgggggagtcagaccctgtcaggacacagcatggacatgagggtccccgctcagctccgtggggctcctgctgctctggctcccaggtaccagctgtgacatccaattcgacccagtctccactccctcctgtctgcatcttagtgganacagactccaccatcacttcggccgggcgagtcagccatcagctattcttagcctggtcgcagacaagaaaccgngggccgacnccccgtcaacggtactacggttagtcgtagtggcacactcgagtatgacgtagggtcgggtcctacgtacgtaggtacaggtcggacgtaggtcgactacggttacggacgggtaactacggtaactttaaccgacctttaccgtacctaaacttacctacgacgtaccacggtccctacggaccgtaagtccgtaaggtaactttagtttacgtaactttaaattttacggtacctttacgtaaacgtaaacttaacgtttaattaaaccgttaccgttaacccggtttaggtacggtaccggtaccggacgggtaacgggaaccgtaaggtacggaacgtacctaccggtagtcggacgtcctagtacccg

SEQ ID NO: 216886 - DNA, 656 bp, Homo sapiens
  misc_feature: GYAE6OF02F6PMD.1.34.D01.1.454.CMB.1.raw
  modified_base (285)..(285): a, c, t, g, unknown or other
  misc_feature (285)..(285): n is a, c, g, or t
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
  modified_base (462)..(462): a, c, t, g, unknown or other
  misc_feature (462)..(462): n is a, c, g, or t
  modified_base (646)..(646): a, c, t, g, unknown or other
  misc_feature (646)..(646): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaaattcgaccccagtcctccatccctccctgtctgcatctattggagacagagtcaccatctacgtcggccgggcgagtcgaggccatacgagtcgtatttcgtttacgcctggttgcagcagaaaccgngggcgaccgccccngagacgtcgtagtctagtggtgacataccgagtagtgcgtaagggtcggtcccactcgtaggttnaggtggcagtgctagtcgtgggacagtacttacgtactcgactacttacgtacgacgtccgacgtcccgttagcgtacggtccttaaggtaacgtttnttttaaggaaccttttaaagttttaacctttacgttacgtacctaaagttaagtttaaacttaccggttaaaccgttacccgttacggttacggttacggtacccggtacgggtaaaccgggtaccggtaagggtaccggttaaacgtaccggaaacccgttacggggttacgtcgggttaccncctaacccgg

SEQ ID NO: 216887 - DNA, 717 bp, Homo sapiens
  misc_feature: GYAE6OF02HBK5P.1.34.D01.1.454.CMB.1.raw
  modified_base (208)..(208): a, c, t, g, unknown or other
  misc_feature (208)..(208): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgaccctagtcctccactccctccctgtctgcatctagttggagacagngtacaccatcacgttcggcccggggcacgtcacggccatcgagcgtattcttacgccttggttcncagcaaggaaaccgngggccgacgcccctanagactcggtatctagtgtgacactcaagtgttgacgtacgggtcggtcccagtccgagttacgaggtcggcgtaggtcgacgtacgtcggtacggaacaggtaacttaccgacgtttcactactactcgacgtcacgtccgtgaccgtacgtccgttacgttaaagttcgtttttaccgaacgttttaaagtttttaccttaacggttaacgttaaccgtaaaccgtttaagttttaaaccgttaaaccggtttaaacccgttaacccccgggtttaacggtttacggggttaacccgttttaccgggggaaccggttaaaccggggtaaccgggttaagggttacgtaaaaccgggttaacccggaaaccggtttacggtaccgggtaacggttacccgtacggtaaccccc

SEQ ID NO: 216888 - DNA, 819 bp, Homo sapiens
  misc_feature: GYAE6OF02F1X7V.1.34.D01.1.454.CMB.1.raw
  modified_base (293)..(293): a, c, t, g, unknown or other
  misc_feature (293)..(293): n is a, c, g, or t
tcagacgagtgcgtcacgaccggtgctcgatttagatcgtctgtgttggggtttgggggagtcagaccctgtcaggacacagcatggacatgagggtcccgctcagctccgtgggctcctgctgctctggctcccaggtaccagctgtgacatccaattcgacccagtctccatccctcctgtctgcatctagttggagacagacgtccaccatcacgttcggccgggcgacgtcgaggcccatcgagcgtatttcgtttacgccgttggtcgacgacgacaacggaaaccgnggggccgaccgtccccgtgacgtacgttaccggtacgttactaggtgggtacgacctacgtaccgtagtagttcggacggtaacgggttccgggtaccctacgttacccggtaaggtttaccgaagggtacggacgtacggtacgtacctaacggttaccggtaacggggaacctaacggttaacgtttaacccgtaaccgtttacccgttaacgttaaccgtttaacgtcccggtaaacggtacccgtaacgtccccgttagggaccctaacgggtaccgtttaaggtaaacgttttacgtttttacggaactttttaacggttttaaccttaccggttacgttaaacgtaacgtttacggttaaactttaaccggttaacccgttaacccgttacgggttaccgggttaaccggttaccgggaacccgggttaaacggggttaaccgtaaacgggggttacggtaaacccggttaccggtaaacccggttaaggttccggtacccggttacgtaccgtaaccgg

SEQ ID NO: 216889 - DNA, 707 bp, Homo sapiens
  misc_feature: GYAE6OF02HXLQ1.1.34.D01.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccatccctcctgtctgcatctatgganacagatcacatcactggccggganagtcgacggccagtcagcgtattcttacgcctggttcgctagacaacgaaaccgacgggcgaaccggccccctacgacgtacgtaccgtagttaccttagtcgggtcgactactaccgaagtacgtttggacgtaaacgggggttcgggtccccgtaagtcccgtaggtttccgaaggttcggacgtacggtacgacctacggttcggacgggtaacgtaacggtaactaaccgtaccgtttacctacctaaccgttaaagttccgaacgtaccgaacgtcccgtggtaccgaccgtcccggttaagtaaccggtttattttacgggaacctttaaagttttacttaaccgttacgtaacgtaaaccgttagttaacctttaaggtaacccttacccgttaggtacggttaccggtttccggaacggtaccgggtaacgtagggtaacgtacgtaccgaacgtacgttaggtcggtctagtaaccc

SEQ ID NO: 216890 - DNA, 664 bp, Homo sapiens
  misc_feature: GYAE6OF02HB6U0.1.34.D01.1.454.CMB.1.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (434)..(434): a, c, t, g, unknown or other
  misc_feature (434)..(434): n is a, c, g, or t
  modified_base (475)..(475): a, c, t, g, unknown or other
  misc_feature (475)..(475): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccactccctccctgtcctgcatctagttgganacagactcacctatcacttggccgggcgagtcgaggccatcagctatttcttacgccttggttncagcaagaaccgnggcgacgccctnagtntcgtagtactagtggtcactactccgagtagttcggacgtaacggggtcgggtaccctaagtcccggtaggttccgaaggttcggactaggtcgactacgtcgagggtaactacggtacttactacgtctactaactntacgacgcacgtccgtagacctagtacctaggtaacgtttntttacgtaactttaaagttttacttacgtacggaacttaaacgtacgtttaattaacccgtaaccgtttacccgtacggttacggggtaccgtttaccgggccgtaaacggggtacccgtaaaaggggtaccgttaaacggtaccccgtaaacgggtccgttaaggggtacgtacccgtacggtaaccc

SEQ ID NO: 216891 - DNA, 778 bp, Homo sapiens
  misc_feature: GYAE6OF02GI19G.1.34.D01.1.454.CMB.1.raw
  modified_base (296)..(296): a, c, t, g, unknown or other
  misc_feature (296)..(296): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctcctgtctgcatctagttggagacagacgtcacctatcacttcggccgggacgagtcacggcctagtaccgagacgtactttcgtttacgccgttgggttcgacacgacaacgaaaccgngggaccgaccgcccctagaggacttcggtattcgtagtcggtcacgactaccgagtacttcggaccggtaacggggttcgggtacccctaagttcccggtacgggtttacgagggttcgggactacggtcgacgttataccggtaggggaacctaaggtactttaaccacgttaccgtaccgtaaccttaacgtcgaccggtacgtaccgggtacctacgggtaccgtaaccggttaccttaaaggttaaacgggttttacttttaacggttaaaccgtttaaaactttttacggttttaacccgttaaccggttaacttaaaacggttacgttttaaaacttacgttaaccccggttaacccgttagggtaccggttacccgggttaccgggtaaccggggtaaccgggggtaaacccgtaagggggttaccggtaaccgttaccggaaccgtacgggtcggttacggctacggtaacccg

SEQ ID NO: 216892 - DNA, 468 bp, Homo sapiens
  misc_feature: GYAE6OF02JATD9.1.34.D01.1.454.CMB.1.raw
  modified_base (427)..(428): a, c, t, g, unknown or other
  misc_feature (427)..(428): n is a, c, g, or t
  modified_base (430)..(468): a, c, t, g, unknown or other
  misc_feature (430)..(468): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagtattttgactaattttattactgtacaacagtattatacgtacccctagtggacgttcggccaggggaccaaggtggaatcaaccgaatggtggctgacacctatctcgtcttcacttcttccccgactatcctagaaccgctactccgttctaggacggccgggacgttgggaccgaaagggtccgacgtaacgttacgnnannnnnnnnnnnnnnnnnnnnnnnnnnnnnnnnnnnnnnn

SEQ ID NO: 216893 - DNA, 974 bp, Homo sapiens
  misc_feature: GYAE6OF02IZPUZ.1.34.D01.1.454.CMB.1.raw
tcagacgagtgcgtcacgaccggtgctcgatttagatcgtctgtgttgggtttgggcatggacatgagggtcccgctcagctcctggggctcctgctgctctggctcccaggtaccagctgtcgacactacctaattcgaccctagtcctccactccctccgtgtctcgactatctagttgagacagagtcacctatctacgtcggccgggacgtagtcgacggccacgtacgagtacgtatttccgttacgtccgttggttcgacacggtaccgaaacgaaacccggagggaccgaccgcccccgtacgaacggtacgttacggttacgttacgtaacgtcgggtacgtacctacgtaccgtagtacgttcgaaccggtaacggggttccggggttaccctacgtaccgttagggttaccgtaaggtcggtacgtaacggtcgtacgtacgttccgggtacggggtaacctacggttaaacgtttaacccgtacgtttacccgttaccgttaaacccgttaacgttaccggaaaccgtacccgtacccggttacccggttaccggaaccggtaccggtaccccgtttaaggtaaaaccgggttttactttacggttaaaccgttttaaaccgtttttaactttaaccggtttaccgttaaacccgttaaagttaaaccgggttttaacttaaaccggtttaaccccggtttaaccccgtttaaccggggttaaccggttaccccgggggttttaacccgaccccgggggttaaaacgggggtaacccggtaaaacggggtttaaccggggtaaaaccgtttacccgggtaaaaacccggtacgggtttaaccggggtacgggggtttaacccaccgggttaaacccccgaacgtttaacccgtttccgggtttaaccgtttaccccgtttacgttaaccccgttttccccgggttaacccccgtttaacccgg

SEQ ID NO: 216894 - DNA, 625 bp, Homo sapiens
  misc_feature: GYAE6OF02FXY6A.1.34.D01.1.454.CMB.1.raw
  modified_base (383)..(383): a, c, t, g, unknown or other
  misc_feature (383)..(383): n is a, c, g, or t
tcagacgagtgcgtcacgaccggtgctcgatttagatcgtctgtgttgggtttgggcatggacatgagggtccccgctcagctcctgggggctcctgctgctctggctcccaggtaccagctgtgacatccaattgacccagtctccatcctccctgtctgcatctattggagacagagtcaccatcacttcggccgggcgagtcaggccatcagcgtatttctttagccttgggttcgcagcaagaaacccgaggggccgacgcccctgaacgacgttcggtagttctagtgggtcgactactccgaaggtattcggacggtaaggggttccggggtaccctacgttcccgtaaggttcgaaggtcggacctaggtcgactntcggtgggaacaggtacttacactctacactagtcagcacgcctgcacgtctagtaacgttatttcgacttaatttactacgtagttacaacgtattaacttactaccgttacccgtaggttcgtacgtccggacgagggtacctagggtacgaacgtccgaacgtacgttcgggtcggacctcgaaccacgttagttccttacggttaccttactaccgtttcccctaccccgtaaccccg

SEQ ID NO: 216895 - DNA, 826 bp, Homo sapiens
  misc_feature: GYAE6OF02GY14V.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagttggagacagagtcaccatcacttcggccgggcgagtcgaggccatcagcgtatttcttagccttggttgcagacgtaagaaacccgagggaccgaccgtaccccctacgaagtaacttaccggtacgtccttaagttcgggtacgacctacgtccgtaagtagtttcggaacggtaacggggttccggggttaccccaacgttacccggtaacgggtttactacgggtacggtactaaggttccgaccgtaagttcccggtaaggggaaccgtaacggttaacgtttaaccggtaaccctttaccgtaaccgtaaccgttaaactaccggtaaacggtccgtaaaccgtcccgttaaggaacctaaccgggttacccgttaaggtaacggtttacttttaacggtaaccttttaaaattttactttaaaccgttagtaaccttaaacggttaattttaacgttaaaccgttaaaccggttacccccgttaacggggttacgggttaacccggtttacccggggaacccgggttaaccggggggtaaacccgtaagggggttaaacccgggttaacgtaaaccccgggtaaccggttaaccggttcgggtacggttacccgtacggtaaccccg

SEQ ID NO: 216896 - DNA, 686 bp, Homo sapiens
  misc_feature: GYAE6OF02JRMY8.1.34.D01.1.454.CMB.1.raw
  modified_base (201)..(201): a, c, t, g, unknown or other
  misc_feature (201)..(201): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccatccctcccgtgtctgctatctattgganacagagtcaaccatcctacgttcggccgggacgagtcgaggccatcgagcgtatttcgttagccttggttgacctagacaacgaaacgcgggacgaccgcccctagagtacgtacggttacgtactaggtcgggtgactacgtaccgaggtacgttaggacggtaacggggtccgggtacccacgttacccggtacgggttacgtaggttcgggactaggtccgacgtacgtcggtacgggacgtaagtaacgttacctaccgttctaacctagtaacgtcgacgtaccgtacgtcctcggaccgtacttaccggtaaagttaacgttatttacgaattttaacgtttacttacgttacgttaactaagttaacgtttaactaacgttaccgtaacccgttaggttcgggtaccgttaccggaccggttaacggtacgaggttaacgaccgttaacgacgtaccgtaggtcgtaccgtcgtaacc

SEQ ID NO: 216897 - DNA, 767 bp, Homo sapiens
  misc_feature: GYAE6OF02JBXLC.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctcctgtctgcatctattggagacagagtcaccatcacttcggccgggcgacgtcgacggccatcagcgtaatttctttagccgttgggtttcgcacgtacgaacgaaaaccgacggggaccgaacggccccccttacgacggtacgtaccggttacggttaccgttagtcgggtcgtacgtaacctccgtaagtacgtttcggacggtaacggggtcgggttacccctacgttacccggtagggttaccgtaggtcggacgtaggtcgactacgttcgtacgggtactaagtacgtttaacgtaccgttactaccgacttacgactacggaccgacgtccgtacgaccgtacgtacgttacgtaacggtttacttttacgtaaccgtttaaatttttaaccgttaacgttcgttaaaccgttaagttaacgtttaaactttacggtaaaccccgtttaccccggttaccggttacgggttaaccgggttaccgggtaacgggtaaccggggtaaaccgtaacggggtaacggtaaccggttaacccggtaaccggtaacggtttcgggaccgggttacgtacccggtaacccg

SEQ ID NO: 216898 - DNA, 397 bp, Homo sapiens
  misc_feature: GYAE6OF02HUZHV.1.34.D01.1.454.CMB.1.raw
  modified_base (343)..(343): a, c, t, g, unknown or other
  misc_feature (343)..(343): n is a, c, g, or t
  modified_base (384)..(397): a, c, t, g, unknown or other
  misc_feature (384)..(397): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatacgtacccctagtggacgttcggccaggggaccaaggtggaagtcaaccgactgtggctgcaccatctgtcttcatcttcccgcntctgaacgcactcgtctgagcgggctggcaaggcgcagtgnnnnnnnnnnnnnn

SEQ ID NO: 216899 - DNA, 602 bp, Homo sapiens
  misc_feature: GYAE6OF02F0DYF.1.34.D01.1.454.CMB.1.raw
  modified_base (284)..(284): a, c, t, g, unknown or other
  misc_feature (284)..(284): n is a, c, g, or t
  modified_base (380)..(380): a, c, t, g, unknown or other
  misc_feature (380)..(380): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgctatctattggagacagagtcaccatcacttggccgggcgagtcgaggccatcagtcgtattcgtttacgccgttggttcgacaggacaacggaaaccncggggacgacgccccctagacgtacgtacgtacgtctaagtcggtgctactccagtatgacgaagggtcgggtaccagtccgaggttcgagtcggnacggtgctagtcgtaggaactagtacttacgctactctaacgtncagcacgctgcacgtctagagttnttgacttaattacttcgtatactactagttaacttactaaccgttacccgtaggttaccggtacggttaccggaccgggttaacgggtaaacctaggggtaccgtaaacggtcccgtaaaccggtcggttaggtaccggtacgtaccgtaaccg

SEQ ID NO: 216900 - DNA, 923 bp, Homo sapiens
  misc_feature: GYAE6OF02H4BNT.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccacttccctccctgtctgcatctagttggagacagagtcaccattacgacttcggcccgggcgaggtccgacggccatcagtcgtatttctttacgccgttggttcgcgtagaccgaaacgaaaccggaggggtaccgaccgcccccgtacgaagtacgttaccgttacgttccttaaggtcgggtcgtaccgtacttaccgtaaggtacgtttacggaccgggtaacgggggttcccgggttacccccaccggtttaccccggttaacgggttacccgtttaaggggtaccgggtaccgtaggttacggtaaccgttaaccggtttaccggtaccgggggtaacctaaacggtttacctttaaacccgttaacccgtttccccttaaaccgttaccctaaagttccgaaccggtacccgtaccggtacccgtacgaccggtaaccggttacccgtaaagttaaaggttttacctttaacggttaaacgtttttaaacggttttaactttaacccggttaacgttaaaccggtaaacgttttaaacgggtttaactttaaaaccggttttaaaccccggtttaccccggttaaccgggtttaccggggttacccggggtttaccgggtaaacccggggtaaaccggggggtaaacccgttaaaggggggttaacccggaaaccggtttaacccgggaaacccgggtttaaccggtacggggttaaccgggttaccctaccgggtaaaccccc

SEQ ID NO: 216901 - DNA, 756 bp, Homo sapiens
  misc_feature: GYAE6OF02GANJZ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccgaggtaccagctgtgacatccaattcgacccagtctccatccctcctgtcctgctactctagttggagacgagacgtaccacctagtcctacgttcggcccgggagacggtcgacggccctatcgagcgtactttcgtttagcccgttggttgcctagcctaaagaaacccgaggggaccgaccggtccccctagtaacggtactccggttaagtccgtaagttgggtcggacctaacgtcccgaagtacgtttggacggtaaacggggttccggggtacccctagttacccggtaacgggtttcgtaagggtcggacgtaggtcgaccgttagttccgggtagggaacgtacggtaacctttaccgtacgtaccgtacctaacgttacgaccgtaacgacgtaaccggcctacggacgtaccgtaccgttaaggtaactttagttttaccgaaacgttttaagttttaaccttacgttacgttaactaaacgtttaacgttaatttaaccgtaacccgtttaaccccgtagggttccgggtaacgtcgggaaccggaaccggggtaacgtagggtaacgtacgaaccggtaacgtacgttggacggttcgacgtaaccg

SEQ ID NO: 216902 - DNA, 618 bp, Homo sapiens
  misc_feature: GYAE6OF02G5OEZ.1.34.D01.1.454.CMB.1.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (373)..(373): a, c, t, g, unknown or other
  misc_feature (373)..(373): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagngtccacatcacgttcgccgggngagtcgaggccatcagcgtattcttacgcctggttgcagcaacgaaaccgngggcaccgccctnagactcgtagtctatggtgctactccagtattgacggtaacgggtcgggtacccacgtaccgtagggttcaggtcggtctaggtnactagtcggtacgggaacagtacttacactctactaactactcgacggccgtacgccctgcacgacgtagtaacgttattttacgacttaagttttactacgttagtactaacgttagttactttactaaccgttacccttaggtacggttaccggttaccggaaccggtaacggggtaacccaaggggtaccggtaacggttaacccgaaccggtaacgttcgggacggttccgtacggtaacc

SEQ ID NO: 216903 - DNA, 740 bp, Homo sapiens
  misc_feature: GYAE6OF02FGEQ7.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctcctgtctgcatctagttggagacagagtccactatcacttggcccgggcagtcagggcccatcagcgtattctttagccgttgttgacagacaacgaaaccgngggccgacgcccctcgagtactcggtacgtctaggttgggtacactataccgacgtagttgacggtaaacggggtcgggttcccctaacgttccgtaagggtttaccgaagggtcgggtacgagggttcgtacctaacgttccgggttacggggaaacctaaggtaacgtttaaccaccgttactaccgtaaccgttactacggaacgtccaacggtcccgtggaccctaggtcccgttaagaacgtttagtttacgtaaacgtttaatttacgttacttaacgtacgtaaaccgttagttaaactttaaaccgtaaccgttaccccgttacgggttacggtaccggttacccgggtaaaccggtaacgggggtaaacccttaacggggggtaccgtaaaagggttaacccgaaaccgggttaacccgggtacggtaccgggacccgttacggtaacccg

SEQ ID NO: 216904 - DNA, 784 bp, Homo sapiens
  misc_feature: GYAE6OF02JVM88.1.34.D01.1.454.CMB.1.raw
  modified_base (112)..(112): a, c, t, g, unknown or other
  misc_feature (112)..(112): n is a, c, g, or t
  modified_base (137)..(137): a, c, t, g, unknown or other
  misc_feature (137)..(137): n is a, c, g, or t
  modified_base (618)..(618): a, c, t, g, unknown or other
  misc_feature (618)..(618): n is a, c, g, or t
tcagacgagtgcgtcacgaccggtgctcgatttagatcgtctgtgttgggtttgggggagtcagaccctgtcaggacacagcatggacatgagggtccccgctccagctccnggggctcctgctgctctggctcccnggtaccagctgtgacatccaattgacccagtctccatccctcctgtctgcactctattggagacagagtaccacatccattcggaccgggcgagtccgaggccactcgacgcgtacgtttccttagtccgttcggtttcgccgagtaccaacggaaaacccgagggggaccgtaaccggccccccgttacggaaccgtaacgttacccgttacggttacgtttaaccgttgggggtacgtacctaacgtaccccgtaaaggtaacgtttcggtaaccggtaaaacgggggttccgggggttacccctaacgtacccggttacgggtttaccgacggttacggggacccgaggtttacggcgttaacgttcgggtacgggaacgtacggtaacttacgtaacccttacgtacaaccttacgtaacgtaaccgtacgtaccgttacccgaggtaccccgtacgtacgtaccgtaaagggtttntttaacggttacttaaagtttttacctaaggttccttaactaagttaccttaattaccgtaaccgttaacccggttaccgtagttacggtaccgggcggttaaccggggaacgtaaacgggtcgtaaacggaccgtaacccgtagttaccggcgttacgtgaaccc

SEQ ID NO: 216905 - DNA, 654 bp, Homo sapiens
  misc_feature: GYAE6OF02I1OR9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcattctattggagacagagtcaccatcacttggccgggcagtcaggccatcagcgtatttctttagccttggttgcagccaaggaaaccgagggcgacgtcccctacaggtagttacggttacgtctacgtggtcgaccactccgaagtagttacgacggtaacggggtcgggtaccctagtacccgtaggttcaggtcggctaggtcgtcagtacggtcgggaacgagtaacttaacgtaccttactacgtacttacgtacgacgtacgacgtcccgtcgtacgacgtccgtaagtaagtttattttacgacttaacgttttacttacgtgtaactaacgttaacttaactttacggttaaccgttacccgttacggttacggtaccggtacgggcggtaacggggtaacgtaacgggtacgtaaccggtaacgaaccggtacgttaggtcggtacgtacgtaccg

SEQ ID NO: 216906 - DNA, 559 bp, Homo sapiens
  misc_feature: GYAE6OF02ITQ05.1.34.D01.1.454.CMB.1.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (324)..(324): a, c, t, g, unknown or other
  misc_feature (324)..(324): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (409)..(409): a, c, t, g, unknown or other
  misc_feature (409)..(409): n is a, c, g, or t
  modified_base (553)..(553): a, c, t, g, unknown or other
  misc_feature (553)..(553): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtcctccactcctccctgtctgcatctattcgganacagatcacatcacttcggccgggcgtagtcgacggcatacagtcgtatttcttagccgttggtncgagcaaaggaaaccgnggaccgaccgccccagagtacgtcgtagttctagtggtcncatccgagtattgacgtaagggcggtaccatccgaggttcgagtcgcagtcncngttcggaggtcagtactacgactctctactntcacgcacgctgactacgtctagtattagtttcatttacttattacgattacaacgtattacgttaacacgtacccgtgtacgtacgttccggaacggccgggtaacgaacggtagtaacgacgtaacgtacgtgtacgtcgtntacccg

SEQ ID NO: 216907 - DNA, 784 bp, Homo sapiens
  misc_feature: GYAE6OF02HWA2X.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctcctgtctgcatctatggagacagagtccaccatccgtacgttggccggggcgtagtccgacggccagtcgagcgtaactttacgtttacgccgttggttacgcgaggacaacggaaacccgaggggaccggaaccgcccccgtacgaacggtacgttaccggtaacgttaccgttaggttcggtagtacctaacgttacccgtaaggtacgtttacgggaccggttaaagggggttacccggggttacccctaaccgtttacccggggtaacgggtttaccggaagggttcggacgtaaggttcgtacgtaacgttacccgggtaggtaaccaacggttaacttaaccgtaaccttccgtaactaacgttacacgtacgacgccgtacctacgccgtacgtacgtaggtaacttagtttagaactttaagttttacttacccggtagttaacctaagttaacgtttaacgttaaacggtaacccgttaaccccgtaggttaccgggtaccggttaccgggaaccgggaacgggtaaccgtaacgggttaagggtaacccgtaccggtaaaccgtaacgttacgggtacgtagtacccggtaaccg

SEQ ID NO: 216908 - DNA, 725 bp, Homo sapiens
  misc_feature: GYAE6OF02GM9FZ.1.34.D01.1.454.CMB.1.raw
  modified_base (266)..(266): a, c, t, g, unknown or other
  misc_feature (266)..(266): n is a, c, g, or t
  modified_base (334)..(334): a, c, t, g, unknown or other
  misc_feature (334)..(334): n is a, c, g, or t
  modified_base (701)..(701): a, c, t, g, unknown or other
  misc_feature (701)..(701): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctccaggtaccagctgtgacatccaattgacccagtctccacttcctccctgtctgcatctagttggagacagagtcacatacacgttggccgggacgagtcgacggccatcgagcgtattcttacgcgtggttcncgacgctaacggaaaccgacggggacgaccgcccctagacggactacggttagtacgtagtcggtacnctaactccgtagtagttcggacggtaagggtcgggtaccctagtaccggtacggttacgaggtacggcgtaagtcgactagtcggtacgggaatacgactttaacacttctactacttacgtacgagacacgtccgtaggctacgttaccgtaggttaaacgttgttttacgtacgtttaaacttttacgtttacgtacgttaacttaaaccgtttaagtttaaccttaaaccgttaacccgggtttacccgttacggggttacgggttaccgggttacccgggtaacgggtaaaccgggggtaaacggttaaacggggttacggttaaaacccgttaaccggaaaccgggttacggttacccgggngggtttacccggaccgttaacccg

SEQ ID NO: 216909 - DNA, 549 bp, Homo sapiens
  misc_feature: GYAE6OF02FGL79.1.34.D01.1.454.CMB.1.raw
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtccaccatcacttgccgggcgagtcaggccatcagcgatctttagcctggtncagcagaaaccagggcaggcccctnagatcgtagtctagtggtgcatccgagtattcgcgaaagggtcggggtaccccagtccgtaggtttcaaggtggacaggtgcatctagggacagtattacactctcatactcagcacgctgcacgcctagaagtattttgactaatttacgttactagtactaacagttactttaagtacgtacccctacggtcgaacggttccggaacgacggggaaccgtaaggtaggaacgtaccgaaccggtaaccgtggtacggctacggacc

SEQ ID NO: 216910 - DNA, 721 bp, Homo sapiens
  misc_feature: GYAE6OF02F8O81.1.34.D01.1.454.CMB.1.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (315)..(315): a, c, t, g, unknown or other
  misc_feature (315)..(315): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccactcctcctgtctgcatctattggagacagacgtccaccatcaccttggccgggacgagtcgaggccatcagctatttcttagccgttggttcncagcgaagaaaccgngggcgacgcccctgagatcggtagtctagtggtnactacgtccgagtatcggacggacggggttccggtaccctagtccgtaggttacgaggtcgcgtaggtcgactacgttacggtagggaactaggtaacttaccgtacctttactacgtaaccttataccgacgtacgaccggtacccgttaggccctaacggtaccgttaaggttaagtttaccgtttttacgtaaaccttttaacgttttaacttaccggtttacgtaaaccgttaagttaaaccgtttaactttaaaccgttaacccgtttaaccccgtagggttaccgggtccggtttaaccggggaccgggtaacggggttaaacccggttaagggtaacccggttaaacggttacccgtaaacggtaaccggttcgggtaccggtaccgttcgtaacccgg

SEQ ID NO: 216911 - DNA, 745 bp, Homo sapiens
  misc_feature: GYAE6OF02GPW3G.1.34.D01.1.454.CMB.1.raw
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctcctgtctgcatctattggagacagacgtccaccataccacgttcggccgggacgaggtcgacggtccatcgaaaaagcgtaatttccgtttacgccttggttgcacgacaacgaaaccgngggcgacgcccctagagactcggtagtctagtcggtgactactccgagtagttcgacggtaacggggttcgggtacccctagttacccggtaggttacgtacggtcggtaccgaaggttacggacttaggttaccggtacggggtaaacctaaggttaacgttaaccgtacgtttaccgtaaccgtaacttacgtactaacggaccgtaaccggccgttcgaccgtacggtacccgttaaggtaacgtttacgttttaacgtacttttaaagtttacctttaacggtacgttaacgtaagttaacgtttaacttaaacgtaaccgttacccgtacggttacgggtaccggttaccggaaccggtaaccgggtaacgtaacggggtaaccggtaacgttaaccggtaaacggttaccggttacgggtacgttacgacccgtaaccgg

SEQ ID NO: 216912 - DNA, 581 bp, Homo sapiens
  misc_feature: GYAE6OF02HLLGA.1.34.D01.1.454.CMB.1.raw
  modified_base (102)..(102): a, c, t, g, unknown or other
  misc_feature (102)..(102): n is a, c, g, or t
  modified_base (279)..(279): a, c, t, g, unknown or other
  misc_feature (279)..(279): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctcctgtctgcatctattggagacagagtcaccatcacttgccgggcagtcaggccatcagcgattctttagcctggttgcagcagaaccgagggcgagcccctnagatcgtagtctaatggtgcattccagtattggacgtaaggtcgggtacccagtccagggttccaggtggcagtgctagtcgtagggacaggtatttaccgacttacgtcaactatcagtcagtcctggacncgcctagtaacgttntttcgacttaattttacttacgtagtacctaaacgtgttaactttacgtaaccgttacccgttacgtagggtaccgtttccgggaccgtaggggtaaccaaggttacgggtaacgtaccgaaccggtacgttacggtacggtcgtacgtaacccg

SEQ ID NO: 216913 - DNA, 656 bp, Homo sapiens
  misc_feature: GYAE6OF02HXMZP.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagttggagacagagtacaccatcacttcggccgggcgagtcaggccatcgagcgtactttcgttagccgtggttcgcagacaacgaaaccgagggccgaccgcccctagaggtacgtcgtagttactagtggtcgactactaccagtactggacgaggggtcggtcccattccgaggttcgagtggacaggtcgacacgttcggtgggaactaggtacttaccgacttacctactaacttactacgacggtacaccggtactcggaccgtacgaccgtagtaaacgttgtttacgaacttaagttttactacgtacgtaactaaccgtagtttaacgttaaataccccggttaaccgtaccggttaggttacccggttaccgggaccgggtaacggggtaacgtaacgggtacgggaacgtaaccgtaacccggtacggttacgggtcggtaccgtccggtaaccg

SEQ ID NO: 216914 - DNA, 806 bp, Homo sapiens
  misc_feature: GYAE6OF02IW1OL.1.34.D01.1.454.CMB.1.raw
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttggggtttgggggagtcagaccctgtcaggacacagcatggacatgagggtcccgctcagctcctggggctcctgctgctctggctccaggtaccagctgtgacatccaattcgacccagtctccatcctccctgtctgctatctagttggagacagagtcaccatccacttcggccgggcgagtcaggccatcgagctattcttagcctggttncagcagaaccgngggcgacgcccnagtatcgtagtctagtggtacgctactccgagtactggacgaggggttcgggtacccacgttaccgtacggtttccgaaggttcgggaccgtagggtcgacgtacggttaccggtacgggggtaacaacgggtttaactttaaccccgtactttacccgtaacgttaaaccttacgtaccgaacgggtcccgaaccggtcccgttacggaacctacccgggtaccgttaagggttaaaaccggttttggttttaccaaaccgttttaaaacgtttttttacctttaaccggtcggtttaaaacctaaaccggtttaacggttttaaactttaaacccgggtttaaaccccggttaacccccgttttacggggttacccggggttaacccgggttttccggggaaaccccggttagggggggttaaaacccctaaggggggttaacccggttaaacccggtaaacccggtaaacccgggtttaacgtacggggtttaccgggttaaccgtcgggtaaacccc

SEQ ID NO: 216915 - DNA, 916 bp, Homo sapiens
  misc_feature: GYAE6OF02G2DF5.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctccgtggggcctccgtgctgctcgtggctcccgaggtaccagctgtgacatccaattcgacccagtcctccatccctcctgtctgacatctagttaggagacagacgtccaactatcacgttcggccgggacgagtaccgaggccatacgaacggtcgttaactttcgttaacggtccgttgggttacgacgacgaaccgaaacggaaaacccggaggggacccggtaaccgtacccccgtagtaacggaacgtttacggttacgttacgtaacgggttacgggttacgtaactaaccgtacgtaacggtaagttacggaccggttaacggggttaccgggtacccaacggttaccggtacgggttaacgtaacgggtcggtaacggtaaggtcgtaactaggttacgggtacgggaactaagggtaacccttaactaaccggttacctaacgtaaccttaagtaccacgaccgtaaacgttccgaacggtcctaaacgggtacctaaggttaaacggttttaaacggttttaccgttaaacgttttaaaccgtttttaaaccgttacggtttaaacgtaaaacccgtttaaaacgttaacgggttttaaacccttttaaaccgggtaaacccccttaaccccggggtttaaacgggttacccgggttacccgggttaacccgggttaacggggggaaaaacccggggtttaccggtaaaaccggggggtaactttaaacccggggtaaaacccgtaaaccgggttaacggggttaccttaaagggggtaccccgacggttaaccccg

SEQ ID NO: 216916 - DNA, 467 bp, Homo sapiens
  misc_feature: GYAE6OF02JHC9F.1.34.D01.1.454.CMB.1.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (415)..(416): a, c, t, g, unknown or other
  misc_feature (415)..(416): n is a, c, g, or t
  modified_base (419)..(419): a, c, t, g, unknown or other
  misc_feature (419)..(419): n is a, c, g, or t
  modified_base (422)..(423): a, c, t, g, unknown or other
  misc_feature (422)..(423): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (436)..(467): a, c, t, g, unknown or other
  misc_feature (436)..(467): n is a, c, g, or t
tcagacgagtgcgtcacgaccggtgctcgatttagatcgtctgtgttgggtttggtagtcaggccatcagcgattctttagcctggtttgcagcagaaaccagggcgagccccctcagatcgtagtctatgggtgcatccagattgcaaggtggggtcccatccaggttcagtggcagtgcatctgggacagattacatctnaactntaagcagcctgacacggcctagaagtattttgactaattttatactgtacaaactagttattatactaccccgtagtggaaccgttcggaccgaggggtaccgaaggtggaacgtacaaaccggtacttggtggcctgaccactancttgtctcatcctccncaatctaagacgtcacttcgntgacgcggtcnggcagcanagtnannacncgnnanctnacgtngtnnnnnnnnnnnnnnnnnnnnnnnnnnnnnnnn

SEQ ID NO: 216917 - DNA, 788 bp, Homo sapiens
  misc_feature: GYAE6OF02IOKT9.1.34.D01.1.454.CMB.1.raw
tcagacgagtgcgtcacgaccggtgctcgatttagatcgtctgtgttggggtttggggggagtcagaccctgtcaggacacagcatggacatgagggtccccgctcagctcctggggctcctgctgctctggctcccaggtaccagctgtgacatccaattcgacccagtcctccactccctccctgtctgcatctattggagacagacgtcaccatctacgttggccgggcgagtcgacggccatcagcgtatttcttacgccgtggttcgcagacagaaaccgcgggcaccgccctacacggtacgtacgtagtcgtagtggtacgctactccgaagtagttacgacggtaacggggtccggggtaccctacgttaccggtacggttacgagggtcgggtactaggtacgacgtaacgttaccgggttagggaacctaaggtaactttaccgtacttaccgtaacctaaccgttaacgtaccgtaacggaccgtaccggttcctaccggtacctaacgggtccgttaaacggttaaacggtttattttaccggttaacctttaaacgtttttaacgttaacgttaccttaaaccgttaacgttaaacgtttaacgtttaaaccgttaaccccgttaacccgttaacgggtttacccgggttaaccggttaccccggggtaaaccgggtaaccggggttaaccggtaaacgggggtttaaccggtaaaccggttaacccggtaaaccgtaccggtttacggtaccggttacccgtaacgtaaccccg

SEQ ID NO: 216918 - DNA, 666 bp, Homo sapiens
  misc_feature: GYAE6OF02I2CBJ.1.34.D01.1.454.CMB.1.raw
  modified_base (142)..(142): a, c, t, g, unknown or other
  misc_feature (142)..(142): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccngctgtgacataccaattcgacccagtcctccatccctcctgtcctgctatctagttggagacaggatccaactactcacttcggccgggcgtacgtccgacggacccatcgacgtacgtatttaccgttacggccgttggttcgcgtacgaccgtaacggaaaccgacgggcccgtaacgccccctagacgtacgtacggtaacgttctaagtggttcacgtacttaccgagtacgttacgaacggtaacgggtccggtaccacttccggtagtacggtacgaggactagtcggactacgtcggtaggactagtactacgtactgtacctacggtactcggactacgacgtcncgacgtanccgttagaagttactttacgtactaagtttattaacgtcttaactaacgttaatttacgtaaacctttacgtaacccgtttcggacggttaaccgttcgggaaccggtaacgggttaaccagggttaacgaacgtacgaacgtactgggtagtccgcgtaacg

SEQ ID NO: 216919 - DNA, 508 bp, Homo sapiens
  misc_feature: GYAE6OF02GCUHO.1.34.D01.1.454.CMB.1.raw
  modified_base (346)..(346): a, c, t, g, unknown or other
  misc_feature (346)..(346): n is a, c, g, or t
  modified_base (463)..(463): a, c, t, g, unknown or other
  misc_feature (463)..(463): n is a, c, g, or t
  modified_base (474)..(508): a, c, t, g, unknown or other
  misc_feature (474)..(508): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccgaggttcagtggcagtgcatcgtgggacagagttacactctacactatcagcagcctgcagcctagaagtattttgacttaatttcttactgtacaatatattatacgtaccccgtgtggtaccgtttcggaccgaggggaccaagggtaggaacgtccgaaacccgagtggtcggctcgcacgnttctgttcttaccattccttccccgactacgtttccgaacgaacccgtcctaaccttcgtacgtacggacgggtccgggtacgtacgggaccgtaaacggggtccacgtacgtaggnacggtcagctnnnnnnnnnnnnnnnnnnnnnnnnnnnnnnnnnnn

SEQ ID NO: 216920 - DNA, 660 bp, Homo sapiens
  misc_feature: GYAE6OF02FTZEJ.1.34.D01.1.454.CMB.1.raw
  modified_base (197)..(197): a, c, t, g, unknown or other
  misc_feature (197)..(197): n is a, c, g, or t
  modified_base (441)..(441): a, c, t, g, unknown or other
  misc_feature (441)..(441): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacgttgccggcgagtcaggccatcagcgtattcgtttagccgttggttgcagcgaagaaaccgagggcacgcccctgagatcggtatctagtggtgcatccgagtattgacgtagggtcgggtcccagtccgaggttacgaggtcggctaggtcgacgtagtcgtacgggaactagtactttaccgacttcactacgtatcagcacgtccagccacgtacctagaagttnttttacggatttaaactttacttaaccgtttacgtacttaaaacgttagtttaaactttaacgttaacccgttaccccgttaaccgggttacggggttaacccggtttacccgggacccgggtaaagggggtaaccccgtaaaagggggttaccggtaaaccggttaacccgtaaacccggtaacggttacgggtcggtaccggttaccggtaaccccg

SEQ ID NO: 216921 - DNA, 577 bp, Homo sapiens
  misc_feature: GYAE6OF02FLV7U.1.34.D01.1.454.CMB.1.raw
  modified_base (198)..(198): a, c, t, g, unknown or other
  misc_feature (198)..(198): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
tcagacgagtgcgtcacgaccggtgctcgatttagatcgtctgtgttgggtttgggggagtcagaccctgtcacggacacagcatggacatgagggtccccgctcagctcctggggctcctgctgctctggctcccaggtaccagctgtgacatccaattgacccagtctccatcctccctgtctgcatctattgganacagagtccaccatcacttcgccgggcgagtcaggccatcagcgtattctttagcctggtgcagcagaaaccgngggcgacgcccctcagntcgtagtctagtgngcancctagattcgacgaacggtcggggtacccagtcctaggttcagtggctagtcgctagtcgtgggacacggtattacctatcctactacgttaactcgagcacgcctgacgtaccgtctagtaacgttatttgactttaactttattacgtgtaacaacttattaattaactaacgttacccgttagtacggttacgttcgggaaccggtacggggtaaccgtaagggtacgtaacgtaccgtaacgtacgtcgtacggtcgtacgtaccg

SEQ ID NO: 216922 - DNA, 686 bp, Homo sapiens
  misc_feature: GYAE6OF02HMBVT.1.34.D01.1.454.CMB.1.raw
  modified_base (149)..(149): a, c, t, g, unknown or other
  misc_feature (149)..(149): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctccaggtaccagctgtanacatccaattcgacccagtcctaccatccctccctgtctgctactctagtggaagacagacgtacaccagtcacttcggccgggacgagtcacggtccaatcacgctaactttcttacgtccgttggttcgcacgtacaacggtaaaccgagggccaccgcccctagagtactacgttagtactagtggtanacactcgagtnttcggacggtagggtccggacctacgtacgtacggttcgaaggtggacgtaacggtcgatacggttacgtacggggactaagttaccttaacgaccttacgtactactacgtacgagcctagtccagtacgtaccgtacgtagtaagtttacgttacgttaacttaagttttacgttacctaacgttaccttaaagttagtttaaaccttaccgtaacccggttacccgtacgggtttaccggaacggtttacccggggaaacgaccggggtaacttaaacgggtcgttaaacgacccggttaacgaccggttggtacgtcgtaccgtaacccg

SEQ ID NO: 216923 - DNA, 780 bp, Homo sapiens
  misc_feature: GYAE6OF02HEF3V.1.34.D01.1.454.CMB.1.raw
  modified_base (190)..(190): a, c, t, g, unknown or other
  misc_feature (190)..(190): n is a, c, g, or t
tcagacgagtgcgtcacgaccggtgctcgatttagatcgtctgtgttgggtttgggggagtcagaccctgtcaggacacagcatggacatgagggtcccgctcagctcctggggctcctgctgctctggctcccgaggtaccagctgtgacactccaattcgacccagtctccatcctcccgtgtctgcntcttagtggagacagcgtaccacctatccgacttcggccgggcacgtcgacggcctagtcgaaggtcttaactttcgttacgccgttggttcgcaaggaccgtaaacggaaaacccgcgggggacctacccggtacccctacgaagtacgttacggtacgttccgtagtcgggtcgacctaacgttacccgaagtacgttacggacggttaacggggttccgggtacccctagttaccgtacgggtttacgacggtggacgtgggtacgtacgtacgttaccgggtaacgggtaacgtaacgttacgttaaccgtacctttaccgtaacctacgttaacgcaacgggtcctaacggtcccgttcggactaccggttaccgttaaagggttacgtttaagtttaccgtaagtttaaacgttttaccgttaccgtagtttaaaccgtaacgtttaacgtttaacgtttaaccgtaacccgttaacccggtttagggaccggtttaccggtaccggaaccggggtaacgggtaaaccgtaagggtacccgtaagtacccggaaacgttcgttacggtcggtacctgtaccccg

SEQ ID NO: 216924 - DNA, 653 bp, Homo sapiens
  misc_feature: GYAE6OF02HRW3G.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtcctccatccctccctgtctgcatctagttggagacagagtcaccatctacgttcggccgggcgagtcacggccatcgagtcgtatttctttacgccgttggtcgcgagacaacggaaaccgagggccgaccgcccctagaagtacgttcgtagtactagtcggtacgtcactaccgtagtacttggacggtaacggggttcggtacccagtaccgtaggttcgaggtcggtacgtagtagactacgtcggtagggaactaagtactaccgtactcgtacctaactacgtacgacgctacgtccgtagacctacggtccgtagtaaagtttcgtttacgaaactttaagttttaaccgttacgtacgtaacgtaacgttaatttaacttaaccgtaccgttacccgtaggtacggtacccggtacggaccggtaacgggtactaagggtacgacgtacgaaccggtgtcggtcgtacgacgtccg

SEQ ID NO: 216925 - DNA, 575 bp, Homo sapiens
  misc_feature: GYAE6OF02HUZZE.1.34.D01.1.454.CMB.1.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (314)..(314): a, c, t, g, unknown or other
  misc_feature (314)..(314): n is a, c, g, or t
  modified_base (568)..(568): a, c, t, g, unknown or other
  misc_feature (568)..(568): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccaggtcctccatccctccctgtctgcatctagtggagacagagtcaccatcacttgccgggnagtcaggccatcagcgtattcttagccgtgggttancctaggcaagaaccgagggccgacgcccctgagtactcggtagtctagtggnctactccgagtatggacgaagggtcgggtcccagtccgaggttcagtggctagtgcatcgagggactagtatacactctctaatactcagctacgcctgctagcctgaagtattttcgattatttagttactagtaactaacagtttacgtataccgttaccctacggttacggtaccggttaccggtaacggacggggtaaccgtaaggggttaaccggaacgttaccgtaaccggtacgtcggtcggtacgngtaaccg

SEQ ID NO: 216926 - DNA, 783 bp, Homo sapiens
  misc_feature: GYAE6OF02IL11R.1.34.D01.1.454.CMB.1.raw
  modified_base (209)..(209): a, c, t, g, unknown or other
  misc_feature (209)..(209): n is a, c, g, or t
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
tcagacgagtgcgtcacgaccggtgctcgatttagatcgtctgtgttggggtttgggggagtcagaccctgtcaggacacagcatggacatggagggtccccgctcagctccgtggggctcctgctgctctggctcccaggtaccagctgtgacattccaattcgaccctagtcctccattcccttccctgtctgcattctagttgganacagcgtcaccatcacgttcggccgggtcgagtcgaggcatcgaggctattctttagccgttggtcncgaacgcaacgaaacggagggccgaccgcccctanaacggtacgttcgtagttcgtaagttggtcanactccgtaagtacttggacgtaacggggtccggtaccctagttccgtacgggttcaagggttcggactaggtcgtactacgtacggagggaactaggtaactttaccgtacctttaccgtactaacttaacgtacgtaacgtacgaaccgtcccgttaagcccgttaacggtaccgttaacgttaaacggtttacttttacggttaaaccttaagttttttaaccgtttaacgttaccgttaaaccgttaacgtttaaagggttttaaccctttaaacggtttaaaccccgttacccgggtttacgggttacccgggttaaccggttccggggtaaccgggttaaacggggtaaccgggttaaaccgggtaagggttaaaccgtttaacccgggaaaccggttacggttaaccggggtcggtacccgttacggaaccccg

SEQ ID NO: 216927 - DNA, 599 bp, Homo sapiens
  misc_feature: GYAE6OF02FR74C.1.34.D01.1.454.CMB.1.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttggccggcgagtcaggcccaccagcgattcttagccttggttgcagcaagaaaccgagggcgacgcccctacgagatcgtagtctagtggtnctatccagtattggacgtaaggggtcggggtacccagtccgtagggttccaggtggctagtgcatcgtagggacagtactacactctactaactatcgaacgccacggccctgcacgtcctagaagttcttttacgactttaaatttacttacttcgtaactaacgtaagtttaattaacgttacccgtaccccgttaaggtccggtacgttccgggaccggtaacggggtaaccgtaaggggtacgtaacggtaccgaaaccggtacgttaggcggttcacggtacctaacg

SEQ ID NO: 216928 - DNA, 657 bp, Homo sapiens
  misc_feature: GYAE6OF02HCM90.1.34.D01.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtctccatccctccctgtctgcatctatggagacagatcaccatcacttggccgggcgagtcaggccatcagcgtattcttagcctggtncagcaagaaaccgnggcgaagcccctnagatcgtatctagtggtncatccagtacttgcgtaagggtcggtacccatccgaggttcgaggtggactagtcgacgtaatcggtacggggaactacggtaactttaaccgacttccgtactaaaccttaaatcccgaaggacccaacggttccctacgaccgtacgtaaccggtaaggtaaaggttactttacggtaaccttaaaattttcgtaaacttggtaacctaagttaacgttaattaacgttaccggttaaccccgtaggttaaccggtcgttaaccggtacggtacgggtaaacgtaaggtaacgtacgtaccgaacgtacgttaggtccgtactacggtaccaccgttatcgtttacggcctttaccgtcttaccccgtcccgtaccccg

SEQ ID NO: 216929 - DNA, 691 bp, Homo sapiens
  misc_feature: GYAE6OF02GFDWH.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccatccctccctgtctgctatctattggagacagagtccaaccatccacgttcggcccggggacgagtcacggccatcagcgtatttctttacgcctgggttcgcagcaacgaaaccgaggggaccgaaccggtccccctacgaggtactcggttacggtctagtcgggttgaccgtatccgtagtaattcggacgtaacgggtcggggtacccctagtacccgtaggttcgaagggttcggcaaggtcgacgtacgtaccggtagggtaaccaaggttaacttaaccacgttacctactaacttaactccgaagacctacgacctgccgacgtccgtagtaacgttattttacgacttaacttttagttacgtagtaacctaagttaagtttaacttaacgtaacgttacccgttaacggtacggttaaccggttaccgggaaccggtaacgggaaccggtaacggggttaacggtaacgtaccgaaaccggtacggtagtaccgggtactcgtaacccg

SEQ ID NO: 216930 - DNA, 685 bp, Homo sapiens
  misc_feature: GYAE6OF02G396P.1.34.D01.1.454.CMB.1.raw
  modified_base (246)..(246): a, c, t, g, unknown or other
  misc_feature (246)..(246): n is a, c, g, or t
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtagacatccaattcgacccagtctccatccctccctgtctagctatctatggagacagacgtcaccattccacgttcggccgggctagtcgaggcccatcagcgtactttcttagccgttggtncagaccaagaaccgaggcgacgtccctacgagtactcggtagtactagtggtacncacgtaccaggtactggcgaacgggttcgggtccccagtacccggtagttccgtaggtcggacgtacgtcgtactacgtcggtacgggaactaaggttacttaacctactactaccgtaatacctacgaacgtacacgtaccgtcgacgtacgtccgttaagtaaccgtttaagtttcgaaacttttaagtttaacttcgtagttaacaacgtttagttaacttaacgacccgtttaacccgtaggtaccgttaaccggtccggaaccgttacgggaacgtaacgggttaacgtacgaccgtttaacgcggtttacgggtatccgtactaccgaccgtttagtaccgttcttaccggtactttaccgtcccgtttaccccgaag

SEQ ID NO: 216931 - DNA, 766 bp, Homo sapiens
  misc_feature: GYAE6OF02IAFET.1.34.D01.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (308)..(308): a, c, t, g, unknown or other
  misc_feature (308)..(308): n is a, c, g, or t
tcagacgagtgcgtcacgaccggtgctcgatttagatcgtctgtgttgggtttgggggagtcagaccctgtcaggacacagcatggacatgagggtccccgctcagctctgggctcctgctgctctggctcccaggtaccagctgtgacatccgtaattcgacccagtcctccactcctcctgtctgctattctagttgganacagagtacaccnctacctcgttcggccggggacgagtccgaacggccagtcgaacgtcggattttcctttacgccgttgggttcgcacgacaaacggaaaccggngggaccgaccgaccccttacgagtacgtacgtacgttctagtggtcgctactccagtactttggacgtaaggggttccggtaccacgtccgtagtccgtaggtcggactggtcacctaagttcccgtaggggactaagtacgtttaccacgtactacgtactagtacgaacgtcgtaacgtccgtacgactaccgtacgttacggtaaacgtttcgtttaaccggttatttaaaccgttttaacgtttaccgttaccgttaacctaaacgtttaaacgttttaacgtaaacgtttcccgttaaaaccccggtttgggttaaccgttaccggggtttaccccgggtaaccgggttaaacccggggtaacccggttaaagggttaaccggtaaacccggttaacccggaaaaaccgttcccgggttacgggtttacggtacccgttaccggttaacccgg

SEQ ID NO: 216932 - DNA, 662 bp, Homo sapiens
  misc_feature: GYAE6OF02F6Q19.1.34.D01.1.454.CMB.1.raw
  modified_base (201)..(201): a, c, t, g, unknown or other
  misc_feature (201)..(201): n is a, c, g, or t
tcagacgagtgcgtcacgaccggtgctcgatttagatcgtctgtgttgggtttggaggagtcagaccctgtcaggacacagcatggacatgacgggtccccgctcagctccgtgggctcctgctgctctggcctcccaggtaccagctgtgacatccaattcgaacccagtcctccatccctcctgtctgcatctatgganacagacgtacaccatcacgttcggccggacgacgtacgacggccagtcgagtcgtatttccgtttaacggccgttggttacgaccgtaagccgaaacggaaacccgacggggaccgacggtccccctgaacgtcgttacgtacgtactagtggacactactccgagtattcggacgtaagggtccgggtaccagtccgtaggtcgaggtggactggtcacgtagttcgacgggactaggtacttaacgcttaccgtactaaccctagtaccgaaccgacgtacgccttaggccgtaacgtaccgtagtaacgtttactttcgaatttacgttttactacgttataaccgttaatacgtttaacttacgtaacccgttaccgtacggtccggttacgtaccgggacggtaacgggtaacacgggttacgaacgtccgtaaccggtatcgggtcgacgtaccg

SEQ ID NO: 216933 - DNA, 523 bp, Homo sapiens
  misc_feature: GYAE6OF02F5Y1T.1.34.D01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgacgcccctnagatcgtagtctagtggtgcatccagattgctaagggtcgggtcccagtccgaggttcagtggcagtcgcatcgtgggacagtacttacactctcactatcagcagcctgcacgcctagatntttgacttaatttattactgtacaactagtacttacgtacgttaccctagtcgacgttcggccgaagggaccctaagggtacggaagtaccgaaccggtagtggtacggtctcgaaccg

SEQ ID NO: 216934 - DNA, 614 bp, Homo sapiens
  misc_feature: GYAE6OF02IF6FT.1.34.D01.1.454.CMB.1.raw
  modified_base (465)..(465): a, c, t, g, unknown or other
  misc_feature (465)..(465): n is a, c, g, or t
  modified_base (506)..(506): a, c, t, g, unknown or other
  misc_feature (506)..(506): n is a, c, g, or t
  modified_base (568)..(568): a, c, t, g, unknown or other
  misc_feature (568)..(568): n is a, c, g, or t
  modified_base (575)..(614): a, c, t, g, unknown or other
  misc_feature (575)..(614): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcgaagggtcggggtcccatccaggttcagtggcagtgcatcgtagggacagattacactctcactatcagcagcctgacacgacctaggaagtattttcgacttaaaatttttacttacgttaggttaccaaaacgtagtttaacctttaaagtaaccgttaacccccgttaacggttggggtaacccggtttaccgggacccggtaacggggggaaaacccgtaaagggggttaccgggtaaaacgtacccgtaaacccggtaaacttgggtcgggaccttacggaccctaacccgtaattaccggttcttacctttaccnctttaccctttaccccccgaaccccttcccgtacgaacccncttacccgtctcgtacgggacggtccgggtactagggaccgaaagggccgaccgaatacggntagcgannnnnnnnnnnnnnnnnnnnnnnnnnnnnnnnnnnnnnnn

SEQ ID NO: 216935 - DNA, 689 bp, Homo sapiens
  misc_feature: GYAE6OF02HZAKP.1.34.D01.1.454.CMB.1.raw
  modified_base (232)..(232): a, c, t, g, unknown or other
  misc_feature (232)..(232): n is a, c, g, or t
  modified_base (290)..(290): a, c, t, g, unknown or other
  misc_feature (290)..(290): n is a, c, g, or t
tcagacgagtgcgtcacgaccggtgctcgatttagatcgtctgtgttgggtttggtggagtcagaccctgtcaggacacagcatggacatgagggtcccgctcagctcctggggctcctgctgctctggcctcccgaggtaccagctgtgacactaccaattcgacccagtcctacctactccctcctgtctgctatctatggagacagatcacatactacgttcggccggngtagtcgacggccatacgagcgtatttcgttagccgttggtacgcagcaagaaaccgngggaccgaccgcccctagacgtagtcgtacgtactagtggctacactacgagtagttcgacggtaacggtccgggtacctacgtacggtacggtcgacgtcggacgtagtacgcgttagcgtagggactaagtaacctactactactacgtactagtaccagacgtaccgccgtagtaccgacgtaaccgtagggttaaacttactttacggtaacttttaaacgttttacgtaacgtacgtaaaccttaaagttacgtttaaactaaccggtttaaccgtaacccggttcggtaacgggttaccccgggtagggtaaacccggaacgggggttaaccgaagggtaaccggtaacgtttaaccccggaacggttaaggttccggtacggtactacccgg

SEQ ID NO: 216936 - DNA, 712 bp, Homo sapiens
  misc_feature: GYAE6OF02IQ979.1.34.D01.1.454.CMB.1.raw
  modified_base (128)..(128): a, c, t, g, unknown or other
  misc_feature (128)..(128): n is a, c, g, or t
  modified_base (315)..(315): a, c, t, g, unknown or other
  misc_feature (315)..(315): n is a, c, g, or t
  modified_base (453)..(453): a, c, t, g, unknown or other
  misc_feature (453)..(453): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctgngctcccgaggtaccagctgtagacataccaatcgacccagtcctccatccctccgtagtctacgactatcttagtggagaactgtacgtccacctatccgtacgttcggaccgggctagtcgacggcctagtcagtcgttagttacttacgccgttaggtcgacgtaacgacgaaacgtaaaccggnggacccggacctcccccgtaagacgtacgtacgtaacttcgtagttacggttacgacctaacgtaccgtaagtcgttacggacggttaacggggtccggtacccagttcccggaaggttacgacggtgtacgacggtntccgtagtcgggtacgaaactgtaactacgtaccgtacncgtaacgtnccgtacgngtaaccgctcgactacgtactaggtactttagtaaccgttattacttaactacggtcttaaaccgttacgttaagtttaacctaacggttacccgttaaccgttaacggttaccgggtacccggttacggaaccgggttaccggtacggtaaacgggtacgttaacgacctaacggtagtaccggacgtacgtaccctaacgg

SEQ ID NO: 216937 - DNA, 642 bp, Homo sapiens
  misc_feature: GYAE6OF02IWO7D.1.34.D01.1.454.CMB.1.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtacccagctgtgacatccaattgacccagtctccatcctccctgtctgcatctattggagacagagtcaccatcacttcgccgggcagtcaggccatcagcgtattctttagcctggttgcagcagaaaccngggcgacgcccctnagatcggtagtctagtggtgacactccagtattgcgtaagggtcgggtacccatccgtaggttcaggtggctaggtgcagtcgtgggaactaggtattaccaactctaccgtaacttactcacgtcacgtcctgccgtacgccgttagaaagttacttttacggaacttaaactttttacttaacttacgttacctaaactagtttaaactttacgttaaaccggtaaccccgttacgggttacgtaaccgggttttacccggaacccgggtaacgggggtaaccccgtaaaggggttaccggtaaacggttacccgaaacccggtaacgttcgggtaccggtaccgtacgtaacccg

SEQ ID NO: 216938 - DNA, 482 bp, Homo sapiens
  misc_feature: GYAE6OF02G94TI.1.34.D01.1.454.CMB.1.raw
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
  modified_base (447)..(471): a, c, t, g, unknown or other
  misc_feature (447)..(471): n is a, c, g, or t
  modified_base (473)..(474): a, c, t, g, unknown or other
  misc_feature (473)..(474): n is a, c, g, or t
  modified_base (476)..(482): a, c, t, g, unknown or other
  misc_feature (476)..(482): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtggggtcccatccaggttcagtggcagtgcatctgggacagattacactctacactatcagcacgcctgcagcctagaagtattttgactaatttacttactgtacaactagttacttaatacgttacccctacgtggaccgttcggaccagggggaccagggtaggaacgtacaaccggtacgtgtacggctggcaccgtatctgtcttacactccttacccacccgtctacaccgactacctcgtctgacggccggacgtcggacgacggcgctaagtagngtnacgatcgagncnnnnnnnnnnnnnnnnnnnnnnnnnanncnnnnnnn

SEQ ID NO: 216939 - DNA, 682 bp, Homo sapiens
  misc_feature: GYAE6OF02FHD5D.1.34.D01.1.454.CMB.1.raw
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctcatcctcctgtctgcatctattggagacagatccacatctacgttggccgggngacgtcacggtccagtcgagcgtattcttagcctggtcgcagcaagaaaccgngggccacgtcccctagaagattcggtagtcgtacgtggtcgactataccgagtacgttggacgtaaggggtccggtacctagtccgtaaggttcgaaggtcggacgtagtcgtacgtagttcgagggacagtactacgaccttcgaacctacgtactacgaacgtacgtacgtaccgtagaccgtacgtcgtaacggttaagttaactttacggtaacttaaacgtttacttaccgtaacgttaacctaacgttaaacgttaacgtttaaccgttaaccgtaacccggttaccggttacgggtaaccggttaccggaaccccgggtaacgggtaaccggttaacgggtaaccggtaaccggttaaccgaaacccgggtaagttcgggaccgtacggtcgtaacccg

SEQ ID NO: 216940 - DNA, 795 bp, Homo sapiens
  misc_feature: GYAE6OF02HVIT6.1.34.D01.1.454.CMB.1.raw
  modified_base (127)..(127): a, c, t, g, unknown or other
  misc_feature (127)..(127): n is a, c, g, or t
  modified_base (153)..(153): a, c, t, g, unknown or other
  misc_feature (153)..(153): n is a, c, g, or t
tcagacgagtgcgtcacgaccggtgctcgatttagatcgtctgtgttgggtttgggggagtcagaccctgtcaggacacagcatggacatgacgggtccccgctcagctcctggggctctgctgctntggctcccaggtaccagtctgtgacntacctaattcgacccagtctccatccctcctgtctgctatctagttggagacaggagtccaactatacgtacgttcgggcgggacgagtaccgacggtccatcgagcttacgttcgttacgtcgtggttcgacacgacgaacggaaccgacgggccgaccgccccgtagacgtacgttacgtacgtactagttacggtacgactaacgtccgtaagtacgttaggaccgggtaacgggttacccgggtaccctagttaccggtacggttacgtaacgggtcggtcgtaaggtacgtacgtacggttccggtacgggtaacgtaattaccgttaaccgtcttacgtaccctaacgttacgtaccgacgtaccgacgtaccgtacgtaccgttaacgttaccgtaaagttacgtttaacgttttacgaaacttttacgttttaaacgtttacgtaccgttaacgttaaacgttaacgtttaacgttaaacccttaaccggtttaaacccgttcggttacgggttaacccgggttaccgggtaaaaccgggtacgggttaaacccgggtagggtaaacccggtttaaccggtaaaccggtaaccggttaaacccggtgggtttaccggtacggtacccgtaaccg

SEQ ID NO: 216941 - DNA, 740 bp, Homo sapiens
  misc_feature: GYAE6OF02H2PBN.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacataccaattcgacccagtcctccacttccctccctgtctgcatctagtggacgactagacgtcaacctatccgtacgttcggcccggggcgtagtccgacggtccatacgacggcgtactttacctttacggtccgttggttcgcgtagacgaaacggaaaccgaggggaccgtaccgtcccctacgacgtacgtacgtaacgttccgtaacggtggtaccgacctaacgtacccgtaagtacgttacgggtaccggtaacgggggttcccgggtaccctaaccggttaccgtaacgggtttaccgtaagggtcggacggtagtacgtacgtacgtcgggtacgggactaaggttaaccgttacgtaaccttctacgtaactagtacgacgtacacgtccgtcgaccgtacgtcgtacgttaacgttagtttacgtacttaatttaacgttactcgtaacctaattaacgttacttaacgttaaccgttacccgttacgtacggtaccggttaccgggacggtaaccgggtacgaacgggttagaccggttaccgaacggttacgtacggtcggtactagtaaccccg

SEQ ID NO: 216942 - DNA, 724 bp, Homo sapiens
  misc_feature: GYAE6OF02FVFV2.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctattggagacagagtccaccatcctacgttcggccgggcgagtcgaggccatcagcgtatttcgtttacgccgttgggttcgcacgcgaacgaaaaccgagggccggacgcccctacgacgtacgtcggtagtcgtagtgggtcgctacttccgagtatagacgtaaggggtcgggtacccataccgtacggttcaggtcggcgtacgtcgactacgttcggtacgggaactagtactttaacacttacctactaacttactacgacgtcgacgtcctagaccgacgtccgtaaggtaaacgtttagttttcgaaactttaaagttttaacgttacgttacgttaaacgtaaaccgttaagtttaaacttaaccgtttaaaccggttacccccgttaagggtttaccgggttaaccggttcccggggtaaccgggaacccggggttaaccggtaaacggggtttaccgggtaaccggtttaacccgaacccggtttaaacggttacgggtcgggttaccgttcggtaaacccg

SEQ ID NO: 216943 - DNA, 662 bp, Homo sapiens
  misc_feature: GYAE6OF02GHGLC.1.34.D01.1.454.CMB.1.raw
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (406)..(406): a, c, t, g, unknown or other
  misc_feature (406)..(406): n is a, c, g, or t
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtaccagctgtgacatccaattcgaccagtctccatcctccctgtctgctatctagttggagacagagtccacatcacgttcggaccgggcgtagtcgacggccaatcgacgtcgtatttccttaggccttgggttcncgtagacgaacgaaaccgngggacgaccgtcccctcgaagtgttaccgtaagttctaagttggtacactacttccgaaggtacttggacggtaacggggttccggaccctatccggtagttcgaaggtcgganaggttcgactaagtcgggaggaacctaggtacttaccgtactctactatacgtcgaacgctacgtccgtagctacgtccgtaaggtaacgttacgttttacgaactttaacgtttactacgttagtaacctaacgtttaataacgtttaaccgttaccgacccggttagttaccgggtacgtaccggtacgggaaccggtaacgtaacggtacgttaacgacggtaaccggtaagttcggtacgtagtccgtaacc

SEQ ID NO: 216944 - DNA, 678 bp, Homo sapiens
  misc_feature: GYAE6OF02J1RBU.1.34.D01.1.454.CMB.1.raw
  modified_base (174)..(174): a, c, t, g, unknown or other
  misc_feature (174)..(174): n is a, c, g, or t
tcagacgagtgcgtcacgaccggtgctcgatttagatcgtctgtgttgggtttgggcatggacatgagggtcccgctcagctcctgggggctcctgctgctctggctcccaggtaccagctgtgacatccaattgacccagtctccatcctccctgtctcgctatctattgganacagagtcaccatcacgttgccgggcagtcagccatcagcgtattctttagccttggtgcagcagaaaccagggcacgcccctcagatcgtagtctagtggtgctatccagtacttgaccgtaagggtcggggtcccagtcccaaggttccaaggttcggctaggtcgactacgtcgtcggggaacaggtaactttacgaccgttctaccgtaactactcgacgtcgacgtcccgtggaccctaggacccttaaggtaacggttacttttacggacttaaacgtttttacttaccggttagttaacctaaacggtagtttaaactttaaccgttaaccggttaaccccttacgggttacggggtaccgttaccgggaccgtaacgggggtaacctaagggtacggtaaccggttaaccgaaccgtaacgttgggtacggtaccttaggaccctaaccgttattcccgttatcccttacgttaacctcccgttacccggtaaccc

SEQ ID NO: 216945 - DNA, 1005 bp, Homo sapiens
  misc_feature: GYAE6OF02GYUCF.1.34.D01.1.454.CMB.1.raw
  modified_base (102)..(102): a, c, t, g, unknown or other
  misc_feature (102)..(102): n is a, c, g, or t
  modified_base (321)..(321): a, c, t, g, unknown or other
  misc_feature (321)..(321): n is a, c, g, or t
  modified_base (348)..(348): a, c, t, g, unknown or other
  misc_feature (348)..(348): n is a, c, g, or t
tcagacgagtgcgtcacgaccggtgctcgatttagatcgtctgtgttgggtttgggggagtcagaccctgtcaggacacagcatggacatgacgggtcccgntcagctccgtgggctcctgctgctcgtggctcccgaggtaccagctcgtgaacacgtaccaattcgacccctagtctccacttccctccgtgtctacgactacttcttagttggaacgacagtacgccaccgtatccgtacgttcggccggggtacgtacgtccgaggtccaacgttcgacggtccggttaatttccgttttaccggccgttgggttcnccgaagtaccgtaaacggaaaacccgnggggtacccgacccgtacccccgttacggaacgtacgtttaccggtacggttaccttaaggtttccggacgtacctaaccgtacctaagggttacgttcggtaaccggtaacggggtttcccgggacccctaacttcccgggttaaacgggttttccgaaagggttccgggtacgtaaaccggttccgggtaacgtaccggtttccggtaaacggggaaacccgttagttaaaccttttaccgaaacccgtttcgtaacccttaaaaccgggttgtactaaccgggtaccgtaccggtcccggtaaacgggtaccgtaacccgggttaaccgttacgggttaaaacggtttaccgtttttaaccgggtaaaccttttaaacggtttttaaacgtttaacccgttacccgggttaaacttaaacccgggtttaaagtttttaccgttaaaaacccgggtttaaccccgtttaccccgggttaacggggtttttacccgggtaaaaccggttccccgggggtttaaaaccggggtaaacccgggtttaacccggggaaaccggggtttaaaaggttaaccccggggttaaaaccccttaaacccggggttaaaccgtttcgggggaacccggtttaacggtacccccggttaaacccgg

SEQ ID NO: 216946 - DNA, 655 bp, Homo sapiens
  misc_feature: GYAE6OF02GK80G.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcgttagccttggttgcagcaacgaaaccgagggcgacgcccctagagatcggtaagtctagttggtcgcactccagtattggacgaagggtcgggtcccagtccgaggttcaggtggcgtaggtcgctagtcgtagggaactagtacttacacttctacctaactacgtcgaacgtcgaacgcctcggaactacggtcgtagtaaagtttacgtttcgaactttaaagttttacgttaacctagttaacctaaaccgtaagtttactttaaacgtacccgtttaaacccgtacgggttacgggttacccggttacgggaaccggttaaggggaacctaaggggtacggtaaccgtacgaaccgttacggtggtaccggtactacgaccttacgtacgttcgttcgttaccttcgaccctttcccgacccggtaacc

SEQ ID NO: 216947 - DNA, 704 bp, Homo sapiens
  misc_feature: GYAE6OF02JU866.1.34.D01.1.454.CMB.1.raw
tcagacgagtgcgtcacgaccggtgctcgatttagatcgtctgtgttgggtttgggggagtcagaccctgtcaggacacagcatggacatgagggtcccgctcagctcctggggctcctgctgctatggctcccaggtaccagctgtgacactccaattgacccagtcctccatccctcctgtctgcattctagttggagacagagtccaccatacacttcggccgggcagtacagggaccagtcagtcgtactttcgttacgtccgtggttcgactagtacgaaacgtaaccggagggaccgacgcccctcgagtactcggtacgtactaggtggacgtcacttaccgagttcgtcgacggaacggggtcgggtaccctagtcgtaacggttcgacggtcggcgtaagtcgactaacggtcggtacgggaactacggtaacttacctacgttcctactaacgtacgtacgacgtacaacgtccgacgtacgtacgtacgttacggtaacgttttacgttactaacgttaatttacgtttaaccgtacgttaacgtaacttaagtttaaattttaaccggtaacccgttaacccggttaccggttacggggttaaaccgttccggaaccggggttaacgggaacggtaacggggttaaggtacgtaaccggtaacggttacggttcggtacggtctaccggacc

SEQ ID NO: 216948 - DNA, 646 bp, Homo sapiens
  misc_feature: GYAE6OF02HJZ1H.1.34.D01.1.454.CMB.1.raw
  modified_base (302)..(302): a, c, t, g, unknown or other
  misc_feature (302)..(302): n is a, c, g, or t
  modified_base (621)..(621): a, c, t, g, unknown or other
  misc_feature (621)..(621): n is a, c, g, or t
tcagacgagtgcgtcacgaccggtgctcgatttagatcgtctgtgttgggtttgggggagtcagaccctgtcaaggacacagcatggacatgagggtccccgctcagcctcctgggctcctgctgctctggcctcccaggtaccagctgtgacatccaattcgacccagtcctccactccctcctgtctgcatctagtggagacagacgtcaccatcgacgttcggccgggacgagtccgacggctatcgacgcgtaatttccgtttacgccgttggttcgcgtagacaacggaaaacccgnggggaccgaaccgcccccgtagagtacgttcgtaagtcgttagtggtcgactacgtccgaagtagttcgacggtaacggggtccggtaccctaggtaccgtaggttacgaggtcggacgtagtcgctaagttcggaggaacctagtacttaccaacttcgtaactactagtacgacgctaacggctacgacgtacgtacgtagtaaacgttgtttacgtaacttaattttaacgtaccgtagtaacctaagttaacgtttaactaacgttacccgtaaccgtggtacgtacggtcggaacgagggtacaggtacgaacncgaaccgtagtcgagtcgacgtacg

SEQ ID NO: 216949 - DNA, 632 bp, Homo sapiens
  misc_feature: GYAE6OF02H3P4Y.1.34.D01.1.454.CMB.1.raw
  modified_base (625)..(625): a, c, t, g, unknown or other
  misc_feature (625)..(625): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctagtggagacagagtcaccatcacttggccgggtacgagtcgaggccatcagcgtattcttagcctggttcgcagacaagtaaccgagggcaacgcccctagagtacgtcgtagtctagtggtcgcactcagtatgacgagggtcggtaccagtccgaggttcagtcggctagtgctagttcgtagggactagtattaaccacttcgtactaactatcgacgcgaccgtcctagcctacgtaccgttaggtaaacgttacgttttacggaacttttaaaagtttttaccttaacgtcgttaacctaacgttaacttaagtttacccgtaacgttccccgttaagggttcggttaccggttaccggacggtaaccggggaacgttaacgggtacggtaacgtaaccgtaaccggtaacgttcgggtaggtcccgttanaacccgg

SEQ ID NO: 216950 - DNA, 690 bp, Homo sapiens
  misc_feature: GYAE6OF02I43HQ.1.34.D01.1.454.CMB.1.raw
  modified_base (277)..(277): a, c, t, g, unknown or other
  misc_feature (277)..(277): n is a, c, g, or t
tcagacgagtgcgtcacgaccggtgctcgatttagatcgtctgtgttggggtttggggggagtcagaccctgtcaggacacagcatggacatgagggtccccgctcagctcctggggctcctgctgctctggctcccaggtaccagctgtgacatccaattgacccagtcctccatccctccctgtctgcatctattggagacagagtcaccatcacttggccgggcgagtcaggccatcagcgatttctttagccttggttgcagcaagaaaccgngggcgacgccccctcagatcgtagtctagtggtgcactcgagtagttcgacgtaaggggtccgggtaccctatccgtaggtttcgaggtcggcgtagtgctatcgtagggacagtacttacacttccgtactactacgtacagacctacgtaccctggccacggtccctaaaggttaagtttacgttttagtaactttaaactttttacgtttactttaccgttaacttaaaccgttaaagtttaacgttttaaacggttaaccccgtttaaccccgttaacggtttccggggttaacccggtttcccgggaaccgggggttaaccgggtaaccgggtaaaccgggttacgggaaacggttaacccggaaaccgttaaccgggttacggttaccgggtcgtaccgtaacccgg

SEQ ID NO: 216951 - DNA, 711 bp, Homo sapiens
  misc_feature: GYAE6OF02H7CGY.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccatccctcctgtctgctatctagttggagacagagtcacatcattcggccgggcagtcaggcatcagcgtattcttacgccgtggttagcagcaaggaaaccgtaggggccgaaccgcccctagaacggtactacggttagtacttagtcggtcgactactccgagtagttcggacggtaagggtccgggtaccctacgtacccggtaggttacgaggtcggactagggtcgctaacgtcggtaacggggaactaggttaacttaacctacgtacctacgtaaccttaacgtcgaagtaccgtaaccgtccgttacgggaaccgtacgtaccgttaagttaaagtttacgtttacggttaacttaaacgttttaacttaccgtaactaaccgtaactaagtttaaccttaacgttaacccgtaacccgttacggtacgggtttaacccgtccgggaaccggtaaacgggtacggtaaacgggttaacgtaacggttaaccgtaaacccgtaggttacggtcggttaccgcggttaacc

SEQ ID NO: 216952 - DNA, 692 bp, Homo sapiens
  misc_feature: GYAE6OF02ILWMR.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccactcctccctgtctgcatctattggagacagagtcaccatacacgttgccgggcgagtcacggccatacgacgcgtacttcgtttagccgttggttagcgagcaaggaaaccgaggggaccgacgccccctacgacggtaatccggtagtcctagtggtcacactcgagtattcggacgtaagggtcgggtacccacgtaccgtacggttcgtaggtcggcctaggtcgactacgtacgtcggggaactagtaacttaactaccgttactaccaacttactaccacgtaccgacgtcccgtagaccacgtaccgtaagtacgttagttttcgtactttaaatttactttacgttactacgtaaacgtaacgtttaagttttaaccgtaacccgtttaaccccgttaggtttaccgggtaaccggttacccggggaaccggtaaccgggggtaacgtaacggggtaacggtaacggttaacccaaaccgggttacgtcgggtacgtaccggtagtaaccccg

SEQ ID NO: 216953 - DNA, 571 bp, Homo sapiens
  misc_feature: GYAE6OF02G9LWO.1.34.D01.1.454.CMB.1.raw
  modified_base (239)..(239): a, c, t, g, unknown or other
  misc_feature (239)..(239): n is a, c, g, or t
  modified_base (522)..(522): a, c, t, g, unknown or other
  misc_feature (522)..(522): n is a, c, g, or t
  modified_base (531)..(535): a, c, t, g, unknown or other
  misc_feature (531)..(535): n is a, c, g, or t
  modified_base (537)..(544): a, c, t, g, unknown or other
  misc_feature (537)..(544): n is a, c, g, or t
  modified_base (546)..(571): a, c, t, g, unknown or other
  misc_feature (546)..(571): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtgggtcccatccgaggttcagtggcagtgcatctgggacagattacactctcactatcagcacgcctgcagctagatatttgctaatttntactgtacaactagttattaataccggtaaccccctaggtcggtaccgttacggacccgtaaggggggaacctaaggggttggaaaccgtccgaaaccgtaacgtgggttacgcgttcggacctaaccctaagttccgttacgttcctttacctaaccgtttcccccgttaccccctaaccccctttccgtacccgaacccgtccgttaacccggttcccgtttaccgtacgggccgggtaccggggtcttaccggggacgtaacgggcccgaataacgtagncgatcgtannnnncnnnnnnnncnnnnnnnnnnnnnnnnnnnnnnnnnn

SEQ ID NO: 216954 - DNA, 624 bp, Homo sapiens
  misc_feature: GYAE6OF02FR4TJ.1.34.D01.1.454.CMB.1.raw
  modified_base (223)..(223): a, c, t, g, unknown or other
  misc_feature (223)..(223): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggngagtcgaggccatcgagcgattctttagcctggttgcagcagaaaccagggcgacgcccctacagagttcgtagtctagtggtgactatccgagtattgacgaagggtcgggtccctagtcccgtaggttacaggtggacgagtgactacgtcgtaggggactaggtacttacactttcactaacttactacagacgagcctgccgaagccgtagaagttacttttcgaacttaagtttacttaccgtacgttaccaacgttacgttaactttaacgtaaccgttaaccccgttacgggttacggtaccggttcccgggacccggtaacgggggtaacctaaggggttaacggtaacgttacccggaaaccgtaccggttagggtccggtctacggtaccc

SEQ ID NO: 216955 - DNA, 663 bp, Homo sapiens
  misc_feature: GYAE6OF02GZ079.1.34.D01.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctccaggtaccagctgtgacatccaattcgacccagtctccatcctcctgtctgcatctattgganacagagtcacatacacgttgccgggnacgtcaggccatcagcgtatttctagccttggtcgcagcaacggaaaccgcgggacgaccgtcccctgaagtactcgtagtcctagtgggtcacactaccgtagtagttacggacggtaaacggggttccggtacccctaagtcccgtaagggtttaccaggtcggactaggtcgtactacgttacggtacgggaactaacggttacttaaccgtacctctaaccgtacttaacgtaccgtaacgccttaccggaccttcggacctacggtaccgtaagtaacgtagtttttacgaacgttttaagttaacgttacctaacgttacaaccgttagttaaccgtttaacgtaccgttacccgttaggtacggttaccgtcgggacggtaacggtacgaaggttccgaacgtacgacggtagttagtacggacgtactacccg

SEQ ID NO: 216956 - DNA, 744 bp, Homo sapiens
  misc_feature: GYAE6OF02HAY1K.1.34.D01.1.454.CMB.1.raw
  modified_base (128)..(128): a, c, t, g, unknown or other
  misc_feature (128)..(128): n is a, c, g, or t
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (430)..(430): a, c, t, g, unknown or other
  misc_feature (430)..(430): n is a, c, g, or t
  modified_base (552)..(552): a, c, t, g, unknown or other
  misc_feature (552)..(552): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctntgctccgaggtaccagctgtgacatcctaattcgacccagtctccactccctcctgtctgctatcgtagtgganacagactcactactcacgttcggacccggngagtccacgggccctanccgtagcgttactttcgtttacgtccgtggttcgacagacgaacgaaacggacgggccgaccgccccgaacgtacgtaacgtcggtaggtacgttagtcgggtactccgtaactaccgaagtaacgttcggtaacgggtacggggttccggtaacccgttacgtaccggtacggtttacgngggttacgtacggacgtacgtaccgtacggttcggaacggtaccgtaacgttaccgtaactaccgttactaccgtaatctaacgacgctaacggccttacggctgtacctggtaaacgtttnttactaacgttactttacgttaacgtacgttaacgaacgtttagttaacgttaacccgttaaaccgtacccgtttacggggtaccgttacccgggtaccggtaccggtaaacggggtacggtaaccggggttaaacgtaaccggtaacccgtaaggtaacccggttacgggtaccgtacgtaccccgtacgg

SEQ ID NO: 216957 - DNA, 485 bp, Homo sapiens
  misc_feature: GYAE6OF02H72VB.1.34.D01.1.454.CMB.1.raw
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (452)..(485): a, c, t, g, unknown or other
  misc_feature (452)..(485): n is a, c, g, or t
tcagacgagtgcgtcacgaccggtgctcgatttagatcgtctgtgttgggtttggggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacacttctcactatcagcagtcctgcacgcctgaagtacttttgacttaattttattactgtacaacagttattatacgttacccctaggtcggaccgtttcggaccgtacgggggaacctaagggtcgggaactacgaacctaacgtggtcgctgaccacctatcgtgttcttcacttcctcccgactactcgtacaccgtccacttcgtctggacgtccgggctgggacgaacggtcgntaactagntancatcgnnnnnnnnnnnnnnnnnnnnnnnnnnnnnnnnnn

SEQ ID NO: 216958 - DNA, 771 bp, Homo sapiens
  misc_feature: GYAE6OF02JPXN1.1.34.D01.1.454.CMB.1.raw
  modified_base (102)..(102): a, c, t, g, unknown or other
  misc_feature (102)..(102): n is a, c, g, or t
  modified_base (143)..(143): a, c, t, g, unknown or other
  misc_feature (143)..(143): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccngctgtgacatccaattcgacccagtcctccatcccgtcctgtctagcatcgtattggganacagtagtccaacnttccgacgttcggcccgggggcaacggttccgaacgggtaccctaagttccgaacgggtaccgtacttttaccgttttacggtaccgtttcgggtttacgaccgtaggtaccgaaaccgggaaaacccggtacggggaccggaaccggtccccccgttacggaaccgtacgttaccgggttaccgttacgttaacgttcgggtacgtaccctaacgttacccggaaggttacgtttacggaccggtaaacgggggttccggggtacccctagttaccggtacggttacggtaaacggtcgggaaacgttcggtcgtaaacgtcgtaccgtaacgggtaactacggtaacttccgtaactacctacgtaactacgctaacggctacggccttcggactcgtacgtagaactttgttccaatttatttactagttactacgtaaacgttacttaacgttacgtaaccgtacccttagggtacgttccggtaccggaacgggtaaccgtacggtaaggagtaccgtacgaaccggtgtacggtcgtacgtagtaccg

SEQ ID NO: 216959 - DNA, 712 bp, Homo sapiens
  misc_feature: GYAE6OF02GFD4G.1.34.D01.1.454.CMB.1.raw
  modified_base (500)..(500): a, c, t, g, unknown or other
  misc_feature (500)..(500): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctcctgtctgcatctagtggagacagacgtccaacctatccacgttcggcccggggacgaacggtccgacgggcccaagtccgaaggacggtatttaccttttaaggcccgttgggttcgccaggaccaaacggaaaacccgaggggtcccgacgccccctgaacggtactaccggtagtcctagtcggtacgctaacgtccgaaggtattacggacgtaacggggtcgggtcccagtccgtaggttcgaggtggacaggtcgactagtcggtacgggactagtacttacaccttactactaactactacgacgcaacgtccngtaccgacgtccgtagaaacgttgtttagaccttaaattttacgtacgttacgtaaactaacgttaagtttaactttaaacgttaccgtttaacccgtagggttaacggttacccggtttacgggacccggtaaacgggggtaaccgtaacggggttacgtaaaccggtaccgtaaacccggtacgttagggtccggtactacggtaacccg

SEQ ID NO: 216960 - DNA, 405 bp, Homo sapiens
  misc_feature: GYAE6OF02FUQU2.1.34.D01.1.454.CMB.1.raw
  modified_base (338)..(338): a, c, t, g, unknown or other
  misc_feature (338)..(338): n is a, c, g, or t
  modified_base (385)..(386): a, c, t, g, unknown or other
  misc_feature (385)..(386): n is a, c, g, or t
  modified_base (388)..(405): a, c, t, g, unknown or other
  misc_feature (388)..(405): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaattttattactgtcaacagtattatacgtacccctagtggacgttcggccaggggaccaaggtggaagtcaaccgactgtgctgcacatctgtctcatctccncatctgacgctactctctgacgcgggctggacgacggcgacagtagnngnnnnnnnnnnnnnnnnnn

SEQ ID NO: 216961 - DNA, 805 bp, Homo sapiens
  misc_feature: GYAE6OF02ISN3O.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctattggagacagagtcaccatctacttcggccgggacgagtccgacggccagtcaggtacgtatttacctttagccgttggttgcaagccgaacggaaaaccgaggggaccgaccgtacccctacgagtacgttcggttaacgtcgttaaggttcgggtacgacctaacttccgtaaggttacgttacgggtaacggtaacggggttccggggtaccccacgtttacccggagggtttaccgaggttacggaccgtaggttacgcgtaacgtccggtagggtaacctaacggttaacttaacccgtaacctttaccgtaacgtaaccttacgtaccgtacgaccttaaccggccgtagggaaccgtacggtaccgttaacgtaaacgttttcgttttaacgaacttttaaacgttttaacttaacgttaccgtaaccgtaaagttaacgtttaaactttaaccggtaacccggttaacccgtttacgggttaccgggtaccggtttacccgggaaccggttaaaccggggtaccggtaaacgggttaacgggtaaaccggttaccgtaaaccccgggttaaggttaccggtacgggttacccagggtaaccccc

SEQ ID NO: 216962 - DNA, 652 bp, Homo sapiens
  misc_feature: GYAE6OF02ISZUO.1.34.D01.1.454.CMB.1.raw
  modified_base (102)..(102): a, c, t, g, unknown or other
  misc_feature (102)..(102): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttggggtttgggggagtcagaccctgtcaggacacagcatggacatgagggtcccgntcagctcctggggctcctgctgctctggctcccaggtaccagctgtgacatccaattgacccagtctccatcctccctgtctgcatctatggagacagacgtcaccatcacgttgccgggcagtcaggccatcagcgtattcttagcctggttncagcaagaaacngggcacgcccctanagtatcgtagtctaagtggtgcactccgagtattgacgtacggggtcggtaccagttaccgaggttcaaggtcgcgtaagtgactatcgtaggggaactacgtaacttacgacttctacaacttactacgtacgctaacggccgttagacctacgacccgttaaggtaacgttattttacgactttaaattttacgtacgttacgtaaacctaacgtaagtttaacgttaaacgtaaccgttaaccccgttaggttaccgggtaacggtttcccgggaaccgggtaaacggggtacctaaacggggttaacggtaaacggttaacccgaaaccgggttacgttacgggtacgttaccgacgggtaacccc

SEQ ID NO: 216963 - DNA, 656 bp, Homo sapiens
  misc_feature: GYAE6OF02G8DXD.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccgagggcgacggcccctgagacttcgtagtctagtggtgcatccgagtattgacgtaagggtcggggtacccagttaccgtacggttacgaggttcggctacggtgacgtagttcggtaggggaacctaagtacgttaaccacttacctacgtaactacgtcgaagtccacgtcccgtagccgacgtaccctaggtaaacgtttattttacggaactttaaacgttttactttacgtacgttaactaaacgttagtttaactttaaacgttaacccgttaaccccgttaggtacgggttaccggttaccgggaacggttacggggaaccgtaaggggttacgtaacggttacccgaacggtacgttacggtcggtacctacggtaacccg

SEQ ID NO: 216964 - DNA, 923 bp, Homo sapiens
  misc_feature: GYAE6OF02G2WMM.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggcctcctgctgctcgtcggctcccgaggtaccagtctgtgacataccaagttcgaccagtcctccactccctccgtgtctgctattctagttggagtacagtacgtaccacctactctacgttcggccgggcgtacgtcgacggaccatcgacgtcgtatttccttaggtccgtggttacgacgacgtaacgaacggaaaccggagggtccggaccgtacccctacgaacgtacgttcggtaagttcgtaggtggtacgccgtaacgtaccgtagttaacgttacggacggtacgggggttacccggttaccgaacgtttccggacggtttacgagggtacgacggtaggttcgacgttacgtacggggtaacgggactaagtaaccttaacctcgttactaaccgtaagtttacgaacggacggaccctacggtcccctagggtaaccacggttcccgttaaagggaaacgttttttacgtttaaaccgggtaacctttttaaaacgtttttttacggtaaacccgttttacggggtaaaaccctttaaaacggtttaaagggtttttaaccggttaaaaaccccggtttttacccggtaaaccccgggttttaacgggtttaccccgggggttttaaacccgtaaccccgggggggggtaaacctttaaaccggggggggaaaacccgggggttttaccgggtaaaaccggggttaaccccgtttaaaacccccggggtaaaaccgggtttaccggggggttttacccgtaccgggttaaccccgtacgggttaaaccccccgg

SEQ ID NO: 216965 - DNA, 923 bp, Homo sapiens
  misc_feature: GYAE6OF02HT7G3.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctcctggggctcctgctgctctggcctcccaggtaccagctgtgacatccaattcgacccagtctccatccctcctgtctgcatctagtggacgacagactcaccatcacttcggccgggtacgaacgtcgacggccagtacgacggtacgttaactttccgtttaacggccgttgggtttagaccgtaacggaccgtaaacggaaaacccggagggggacccgaacccggtaccccccgtaaggaacggtaaccgttccgggtaacgtttaccttaaggttcgggtacgtacctaacgtacccgaaggtacgtttacggaaccgggtaacggggttccggggttacccctaacgttacccggtaacgggtttaccgaagggttcggaaccggtaaggttccgtaaccgttacggttaccgggttaggggaaccttaacgggtttaactttaacccccgtaacgtttaccccttaaccgtaaaccgttacgttaaaccggtaccggaccgttaacccggtccgtaacggaccttacgggtacccgttaaggttaaacgttttacgttttacgtaaacgtttaaacgtttttaacttaacccgtagttaaccgtaaacgtttaaggtttaaacctttaaccggtaaaccccggtttaccccgggttaagggttacccgggtttacccgggttaaccggggtaaaccccggtaaacggggggttaaaccgtaaagggggttaacccggtaaaaccgttaacccggtaaaaccccggtttcggttaacggggtacccgttaccggtaacgtaaccccgg

SEQ ID NO: 216966 - DNA, 767 bp, Homo sapiens
  misc_feature: GYAE6OF02G0060.1.34.D01.1.454.CMB.1.raw
  modified_base (103)..(103): a, c, t, g, unknown or other
  misc_feature (103)..(103): n is a, c, g, or t
  modified_base (172)..(172): a, c, t, g, unknown or other
  misc_feature (172)..(172): n is a, c, g, or t
  modified_base (214)..(214): a, c, t, g, unknown or other
  misc_feature (214)..(214): n is a, c, g, or t
  modified_base (293)..(293): a, c, t, g, unknown or other
  misc_feature (293)..(293): n is a, c, g, or t
tcagacgagtgcgtcacgaccggtgctcgatttagatcgtctgtgttgggtttgggggagtcagaccctgtcaggacacagcatggacatgacgggtccccgntcagctccgtgggctcctgctgctgtggctcccaggtaccagcctgtgacatccaattcgacccagtcnccatccctccctgtctgcattctagttgagactagatccacntacacttggccgggatagtcaggccatcgagtccgtattcgtttacgccgttggttcgcgtacgacaacggaaaaccgngggaccgaccgacccctacgaacgtacgttacgttacgtaccgtagttacggcgtaccaactcccgtaagtacgttaggaccgtaaggggttaccgggtaccctacgtaccgttacggttaaccggtaggtacggtaccgtaaggtcgtaccgtaacgttcggtacggggtaacaacggttaatttaaacccgacgtttaccctaaccgtaacctttaaacgccgaacggttaccgaaccgttccgtaccgcggtaacctaccgttaaacggtaagtttaacgtttcggttaacgtttaaaatttttaccggttacctttaaccgttaactaacgttaaacgttaaacgtttaagtaacccgttacccgttaacgtacgggtttaccggtacccggtaccggtaacgggtaaccgtaagggttaacggtaaaccggtacgaaacccggtaacgtcgggtaacgcgtacgtaccg

SEQ ID NO: 216967 - DNA, 754 bp, Homo sapiens
  misc_feature: GYAE6OF02H5P72.1.34.D01.1.454.CMB.1.raw
  modified_base (172)..(172): a, c, t, g, unknown or other
  misc_feature (172)..(172): n is a, c, g, or t
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
tcagacgagtgcgtcacgaccggtgctcgatttagatcgtctgtgttgggtttgggcatggacatgagggtccccgctcagctcctgggctcctgctgctctggctcccaggtaccagctgtgacatccaattgacccagtctccatccctccctgtctgcatctattgganacagacgtcaccatcacttggccgggngagtcaggccagtccgagtcgtatttaccgtttacgcttggttgcgacgcaagaaaccgngggccgtacgccccgtacgagtacgtcgtacgtctagtcggtgactataccgagtattcggacggtaacgggtcggggtacccctaagtaccccgtagggttacaggtcggctaacggtgactagtcgtaggacgtaagtacgttaccaccttcgtacctaactaagtcgacgaccgtaacggtcccgtggtaaccgtacgtacccgttaaggtaacgtttaacgtttacgtaaacttttaaacgtttttaacgttaactttaggtaaacctaacgttaagttaaccttaaaccgtttaaccggttaaccccgtttaacggtacgggttaacccggtttacggacccgggttaaacggggtaaccgtaaaggggttaccgggtaaacgttaaccccgaaccggtaaccgttagggttaccggccttaacggaccctaaccgttacgttacgtttcggttaccttcccgtttaaccgttccccttacccgtaaccg

SEQ ID NO: 216968 - DNA, 718 bp, Homo sapiens
  misc_feature: GYAE6OF02HCZU3.1.34.D01.1.454.CMB.1.raw
  modified_base (102)..(102): a, c, t, g, unknown or other
  misc_feature (102)..(102): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctcgtggcctcccaggtaccagctgtgacatccaattcgacccagtctccattcctcctgtctgctatctatggagacagactcacatctacgtgcggacgntacgnggccatcgagcgtacgtttcttacgccgttggttcgcacgacgtaacgaaaccggaggggaccaccggtcccctacgaagtaccgttacggtagttccgttaagtcggtacgcctacgttccggaattcgttacggccggttaacggggttaccgggtaccctacggttccggtacggttacgtacggtcggtacgtaggtcgtacgtacggttcggacggggtaatacgtaatttacccggtacttccgtaccgtaacgtactacgagcctaacggtcctaaccgctacgcccggttagaaacgtttcgtttaatacggtttaacttttacgtacgttacgttaaccgtaatttacgttaacgtttaaccgtttaacgtaacccgttacgggttacgtaaccggtttccgggaccgggtaaccggtaggttaacgggttaccggataaccggtaccgtacggttgtaccggtagtacccgtaccg

SEQ ID NO: 216969 - DNA, 802 bp, Homo sapiens
  misc_feature: GYAE6OF02G6XE9.1.34.D01.1.454.CMB.1.raw
  modified_base (166)..(166): a, c, t, g, unknown or other
  misc_feature (166)..(166): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggcctccagtaccatctgtgacatccaattcgacccngtcctccactccctcctgtctgcattctagtggagacagacgtcaccatcctacgttcggccgggacgacgtcacggcctaaatccgaagacgttacgtttacgtttacggtcccgttgggttcgacgaacggacgaaaccggaaaccggacggggaccgaaccgtccccgtagaacgtacgtacggttacgtcgttacgtcgggtcacctacgtaccgtagtagtttacgacggtaccggggtaccgggtaccctacgttccgtaaggttcgaggttcgggtacgtagtcgtacgtacgtaccggtgggaacgtacgtacttaccgtacgtacccgtactaacgtacgtaacgacgttaccgaccgtccgttacgaaccgtaccgtaccggtaagtttaaacctttaggtttaaccgttaacgtttaaaccttttaacgtttaaccggttacccgttaaactaaacggtttttaacgttaaactttaaacggttaacccccggtttaaccgtttaacggtacccggggtttaccggaaccgggtaacccggggtaaccggggtaaacgtaaccgggtaagggtaaccctaaccggttaaccgtacgggttaccgtacggtacggtaccctaaccg

SEQ ID NO: 216970 - DNA, 745 bp, Homo sapiens
  misc_feature: GYAE6OF02G3SPL.1.34.D01.1.454.CMB.1.raw
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (464)..(464): a, c, t, g, unknown or other
  misc_feature (464)..(464): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatccctccctgtctgcatctagttggagacagacgtcaccatcacgttcggccgggcgagtcaggccatcagcgtattcttagcctggtgcagacagaaccgngggcgacgcccctnagtntcgtagtctagtggtgacacgtccagtagttcggacggtaacggggttcggggtaccctagtcccgtagggttcgaacgggtggtacaggttcgccgtaagttcgggtagggaacctaggtaacttacctaaccgttcctacaacttcacgtacgtccgacgtcccgtcgacgtacgtaccgtaggttaaacgtttntttaacggaactttaacgttttaacttaccgttagttaacctaaagttaacgtttaatttaacccgttaacccggttaaccccgtttagggttaaccggggttacccggttaccggggaaccgggttaaacgggggtaaacccgtaaggggttaacggtaacccgttaaaccggtaacccgttaacgggttaccgggtggtaaccggttccggtaaaccctacgttaccgttccgttacgtttacctttacccggtaccgtttccccgttccccgtaaccg

SEQ ID NO: 216971 - DNA, 713 bp, Homo sapiens
  misc_feature: GYAE6OF02GNBIV.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagacgtcaccatcacttggccgggcgagtcagggccatcagcgtattctttagcctggttcgcagaccgaagaaacccgagggggaccgacggcccctgaaggacttaccggttagtcgtaagtggtcgctactccgagtagttcggacgtaaggggttccgggtacccacgtcccgtagggtttaccgaggttcgggactaggtcgactacggttccggtagggaacttaagtacgtttaaccacgtttacctacctaacttactaccgaggtacccgacggtcccgtacggacctaccggtccgtaaggttaaacggttactttttacggaactttaaatttttaacgtttacgttacgttaactaaacgttagtttaactttaacgttaaccgtttaaccccgttaagggtaccgggttaccgttaccgggaccggtaaggggtaaccctaaggggttacggaacggttacccgaaacggtaccgtagggttacggccgttacggtaccg

SEQ ID NO: 216972 - DNA, 764 bp, Homo sapiens
  misc_feature: GYAE6OF02G1HI0.1.34.D01.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctcctgtctgcatctattggagacagagtcacctatcacgttcggccgggcaggtccaggccatcgacgtcgtactttcttacgcgttggtcgcgagacgaacgaaccggngggccgaccgtccctagagtacgtcgtagttctagtggtcactactcgagtagtacgacggtacggggtccggtacctacgtcggtaggtacgaggtcgacgtagtcgacttacggtcggtacgtaactaagttacttaacctacgttccgtaactaacgttacgtccgaacgtccgtaaccgcgttacggaaccgtaacggttacgttaacggttaaacgtttacgtttttacgaaaccttttttaaacgttttaaccgttacggtaaccgttaaacctaaaacgtttcgttttaaacctttaaaccggttttaaaccccggtacccggttttaacgggttacggggttacccggttacggggtaaacccgggtaacgggggttaaaccgttaagggggttaaacccgttaacggtaaacccggtaaccggttacgggtttaccggggacgttttccccggaaaccgttaccccgg

SEQ ID NO: 216973 - DNA, 484 bp, Homo sapiens
  misc_feature: GYAE6OF02FOXMH.1.34.D01.1.454.CMB.1.raw
  modified_base (202)..(202): a, c, t, g, unknown or other
  misc_feature (202)..(202): n is a, c, g, or t
  modified_base (461)..(462): a, c, t, g, unknown or other
  misc_feature (461)..(462): n is a, c, g, or t
  modified_base (464)..(484): a, c, t, g, unknown or other
  misc_feature (464)..(484): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaagggtgggtcccatccaggttcagtggcagtgcatcgtgggacagacttacactcncatatcagcagcctgcagcctagaagttatttgactaattttatactgtacaactagttattactacgtacccctaggtggtacgttcggaccgaggggaccaagggtcggaacgtaccgaaaccggaacttggtcgggctcgctaaccagttccttgtccttaccgacttcccctcccccgtcccttccctacgaccgtcctacgttcccgttactcgggaccggccgggtacctgggaccgacggcgaccgagtcgnncnnnnnnnnnnnnnnnnnnnnn

SEQ ID NO: 216974 - DNA, 681 bp, Homo sapiens
  misc_feature: GYAE6OF02GQS0E.1.34.D01.1.454.CMB.1.raw
  modified_base (102)..(102): a, c, t, g, unknown or other
  misc_feature (102)..(102): n is a, c, g, or t
  modified_base (127)..(127): a, c, t, g, unknown or other
  misc_feature (127)..(127): n is a, c, g, or t
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (345)..(345): a, c, t, g, unknown or other
  misc_feature (345)..(345): n is a, c, g, or t
  modified_base (669)..(669): a, c, t, g, unknown or other
  misc_feature (669)..(669): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctntggctcccaggtaccagctgtgacatccaattcgacccagtcctccatcctccctgtctgcatctatgganacagagtcacatcacttggccgggngagtcacggccatcgagcgtatttcgttagccgttaggttcgacgagacgaacgaaaccgaggggaccgaccgtacccccgtagaacggtacgttaccggttagttaccgtaagttcgggtnaccttacgtacccgaagttacgttcggaccgtaaacgggggttcccgggtaccctacgttccgtacggtttacgaggttcggacgtagtcgtactacgttcggtacgggaactaggtactttaaccgacttaccgtactacgtactacgacgaccgtacgcccgtacgacgtacgtccgttaagtaacgtttacgttttacaactttaagtttaacttacgtacgtacaacgtttattaacgttacgtaacccgttacccgtaggtcgtaccggtacggaccggtagggaaccgtaggacgtaactaccgaacggtacgtcggngtccgagtaccg

SEQ ID NO: 216975 - DNA, 755 bp, Homo sapiens
  misc_feature: GYAE6OF02F9CPG.1.34.D01.1.454.CMB.1.raw
  modified_base (223)..(223): a, c, t, g, unknown or other
  misc_feature (223)..(223): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggngagtcgacggccaatcgagcgtattccgtttagcctggttgcagcgaagaaaccgaggggaccgacgccccctacacgtactacggtacgtcgtaagttggtcgacactccgagtagttgaaccgtaagggttccgggtacccgtaacgttaccgtacgggtttactaggtacggcgtaaggttcggtccgaagttccgtagggaactagtaacttaccgacttccgtaacctaacgttacgactacgaccgtaacgtcccgttagaccgtacggtccgttaaacggttaaacgttacgtttttacgaaacttttaatttttaaacgtttaaccgtttacttaaccgttaaacttacgttttaaaacgttaccttttaaaccgggttaacccccttaggggtttaacccggttacccggtttaccgggaaccgggtaaaccggggtaaacccgttaaacggggttacgggtaaaaccggtttaacccggtaaaccggtaaacgttcggtttacggtaccgttgtaaaccccg

SEQ ID NO: 216976 - DNA, 697 bp, Homo sapiens
  misc_feature: GYAE6OF02FL327.1.34.D01.1.454.CMB.1.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcgagcgtattcttagcctggttgctagcagaaaccgngggcgacgcccctanagatcgtagtctagtggtgctactccagtattgacgtaagggtcgggtcccagtccgaggtttacgaggtggacctaggtcgactacgttcgtaggggactaagtacttacacttcctactaaccgttanacgacggaccgtacgacccgttgacccgtaggtcccgttaggtaacgtttacgttttacggaaccttttaaattttacgtttaaccgtacgtttaaccgtaaacgtttagttaactttaaaccggttaaccgtttaaacccccgtttacggggttaacgggtaaccggttttacccggggaaccgggtaaccggggtaaacccggtaaagggggttaacggttaaaccggaacccggtaaacccggtaacgttaccgggttcggtaccgttaacgtacccgg

SEQ ID NO: 216977 - DNA, 740 bp, Homo sapiens
  misc_feature: GYAE6OF02ITUEN.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctcgtggcctcccgaggtaccagctgtgacatccaattcgacccagtcctccatcctccctgtctgcatctatggagacagagtcaccatcacgttggaccgggctagtcgacggacatccgagtacgtatttcctttacggccgttggttacgacaacggacaaacggaaaaccgtggggaccgaaccgccccctagaacgtacgttcggttaacgttacctaaggtgggtacgtacctaacgttaccaggttaattacggaaccggtaaggggtccggtaccctaagtcccggttaagttcgagttcggactaaggtccactacgtcggtaggactaagtaacttacaaccttctaccgtaactacgtacgagtccgtaacgccgtagtccacgtaccgtaagtaacgttacgtttacgtaacttaatttaacttacgtactaacgtaacgttaaagtttaacttaacgttaaccgttaaccccgttaaggttccgggttaacccggttaccgggtaacccgggtaaccgggtaaaccgggtaaacgggttaacggtaaccggtaacgtaaaccggttaaccgtacggggttacgtacccgtacgtaaccccg

SEQ ID NO: 216978 - DNA, 839 bp, Homo sapiens
  misc_feature: GYAE6OF02H745Q.1.34.D01.1.454.CMB.1.raw
  modified_base (100)..(100): a, c, t, g, unknown or other
  misc_feature (100)..(100): n is a, c, g, or t
tcagacgagtgcgtcacgaccggtgctcgatttagatcgtctgtgttgggtttggggagtcagaccctgtcaggacacagcatggacatgaggtccccgntcagctcctgggctcctgctgctctgctcccaggtaccagctgtgacatccaattgacccagtctccatccctccctgtctcgacattcctagttgggacactaggacttccacctatccacgttcggccggggacgagttccgaaggtccaagttcaagcgtattactttacgccgttggttgccgtagacctaacgaaaccgtagggaccgacgccccgtacgacgtacgtaccgtagttctaacgtggttcacgtactaccgaacgtagtttcggacgttaaacgggttccggggtacccttaacgtcccggttaacgggtttaccgaacggtttcggggaaccgttgggttaccgtacccggtaagtttcccggtagggacccgtaaacgggttacgtttaaaccgtaacccgttaccgttaaccaaccgttacgtaccgtaaacgccgtaaccgtcccgtagtaccccgtaacggtaccgttacggtaaacggtttactttacgttaactttaacgtttttacgtttaaaccgttcgttaacctaaaccgttaacggtttaacttaaacggtttaaaccgttaacccccgtttacggttacccgggtttaccggggtttacccggtaaccgggttaacccgggggaaaccttaaaccggggtaaccggtaaacggttaccccgtaaaccgggttaaaccggttacggttaccggggtacctacgggtaaccccg

SEQ ID NO: 216979 - DNA, 750 bp, Homo sapiens
  misc_feature: GYAE6OF02FYSWE.1.34.D01.1.454.CMB.1.raw
  modified_base (319)..(319): a, c, t, g, unknown or other
  misc_feature (319)..(319): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttcggccgggcgagtcgacggccatcagcgtattctttacgccttggttcgcagcaagaaaccgacggggcgacgcccctacgacgatacgtagtctagtaggtnctactccgagtagttgacgtaacggggtcgggtaccctacgtaccgtaggttacgtaagtcggctaaggtcgctaacgttcggtacgggaactaggtactttaacgaccttctactaacgttactaccggtagaccgtaacgtcccgttacgggacctaccggtaccgttaagggtacgttttaaactttcgggtaacttttaaacttttaacgtttaaccgttacgttaaacctaacgttaaacttttaacgtttaaacgtttaacccggtttaaccccgttacgggtttaccgggttacccgggtttaacccgggtacccgggtaaacgggggttaaacccggttaacggggttaacggttaaaccggtaaaccggttaaaccccggttaagggttaccgggtacggtacccggttccgtaaaccccgg

SEQ ID NO: 216980 - DNA, 522 bp, Homo sapiens
  misc_feature: GYAE6OF02FK5EI.1.34.D01.1.454.CMB.1.raw
  modified_base (196)..(196): a, c, t, g, unknown or other
  misc_feature (196)..(196): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacttggccgggcgagtcaggcccatcagcgtatttctttagccttggttcgcagcaagaaaccgagggcgacgcccctnagntcgtagtccagtggtncagtccagtattcgacgaagggtcgggtacccagtcaggttcaggtcgcagtgcagtcgnggacagacttacacttctcactncagcagcctgacngctagattgtttnacttaatttntactgtacaatntattataccgtaccttagtcggacgttccggcgaacgggacaacgggcgtaaacgtcgaaccgtagtcggacgccttagaccc

SEQ ID NO: 216981 - DNA, 579 bp, Homo sapiens
  misc_feature: GYAE6OF02HAOJ8.1.34.D01.1.454.CMB.1.raw
  modified_base (442)..(442): a, c, t, g, unknown or other
  misc_feature (442)..(442): n is a, c, g, or t
  modified_base (573)..(573): a, c, t, g, unknown or other
  misc_feature (573)..(573): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaaccatcacttgccgggcgagtcaggccatcagcgtattcttagcctggttgctagcagaaaccgagggccacgcccctgagtatcgtagtctagtcggtgcatccgagtattgcgaaggtcgggtacccagtccgtaggttcaggtcgacgtagtcgactagtcgtacggggaactacgtagtttaaccacgttctacctaactatcgacgcacgcctagccacgctagtaagttntttacgacttaatttaacttactacgtactaacgtagttaacttacgttaacgtaccccgttagtcggtacgttaccgggacgtacggggtaacagggttacgaacgtaccaacggtaccgtggacgtacngtaccc

SEQ ID NO: 216982 - DNA, 570 bp, Homo sapiens
  misc_feature: GYAE6OF02IVMEQ.1.34.D01.1.454.CMB.1.raw
  modified_base (224)..(224): a, c, t, g, unknown or other
  misc_feature (224)..(224): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcattctattggagacagagtcaccatcacttgccgggnagtcgaggccatcagcgattcttagcctggttcgcagacaaggaaaaccgngggcacgcccctanagactcggagtctaagtggtnacactcacggattgcgaagggtcgggtaccagtccgagttacaggtggactagtnactatcggnggacagtactacactctacacgtancagcanctgancgtctagaattgtttanacttaatttacgttactacgtaacaacgtaagtttacttaacgtaccgtaacccttacggtacggtacgttacggaacccggaagggaacctaagggtaacgtaacgtaccgaaccgtaagtcggtaggacctaggtaacccg

SEQ ID NO: 216983 - DNA, 677 bp, Homo sapiens
  misc_feature: GYAE6OF02G7T9K.1.34.D01.1.454.CMB.1.raw
  modified_base (531)..(531): a, c, t, g, unknown or other
  misc_feature (531)..(531): n is a, c, g, or t
  modified_base (549)..(549): a, c, t, g, unknown or other
  misc_feature (549)..(549): n is a, c, g, or t
  modified_base (661)..(661): a, c, t, g, unknown or other
  misc_feature (661)..(661): n is a, c, g, or t
tcagacgagtgcgtcacgaccggtgctcgatttagatcgtctgtgttgggtttgggggagtcagaccctgtcaggacacagcatggacatgagggtccccgctcagctcccgtggggctcctgctgctctggctcccaggtaccagctgtgacatccaattcgacccagtcctccatccctccctgtctgccatctatggagacagagtcaacatcacgtggaccgggcgtagtcacggcactccgagcgtatttctttacgccgttagttgccgaagaccaacgaaaaccgacggggacgaaccggccccctacgtaacgacttacggtaggttacctaggttacgggtgtacctaactacccgtaagtacgttaggaacggtaacggggttaccgggtaccccaacgttacccggtaagggttcgtaaacgggttcggaccgtaaggtcgtcgtaacggtcgtacggggaacctaagtacgttaaacctactaccgtactaaactacgtactacgacgacgcctgaacncgtactagatttacgttntactttaatttactactagtacaagttaacgttattaacaacgttacccgtagtacggtacgtaccggtacgaacgggtaacgaggtacggtaacgtaccgaagttaaccgngtacggagttcaaccg

SEQ ID NO: 216984 - DNA, 714 bp, Homo sapiens
  misc_feature: GYAE6OF02I3W1B.1.34.D01.1.454.CMB.1.raw
  modified_base (523)..(523): a, c, t, g, unknown or other
  misc_feature (523)..(523): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctcgtggcctcccaggtaccagctgtgacatccaattcgacccatcctccatccctccctgtctgctatctattggagacgagacgtccacctatccacgttcggaccggggcgtaacgtccggacggaccctagtccgaacggtaccgtattttaccgtttacggtccgttgggttcgacgacgaaccgaacggaaaccggacgggacccgaccgacccccgtagacgtacgttacgtacggttactagtcggtcactactaccgtagtacttacggacggtaaacggggtccgggtccaacgtccgtaggtttaccgaggttcggactggtactcgtaacgttcggtacgggaacagttaactccctaactcctacgtactacgtacacggaacncgttccgaggcttaccgcgttaataccggttatttaccgtaactttaatttaaccgtacgtacgacctaacgttagtttacctaacgtaccgtaaccgttccgagtttaccggtacggtaccgggtaacggtaacgtaacgggtaagtccgtaaaccggaacggttccgtgggttacccacgttccgaacc

SEQ ID NO: 216985 - DNA, 696 bp, Homo sapiens
  misc_feature: GYAE6OF02G3FIG.1.34.D01.1.454.CMB.1.raw
  modified_base (197)..(197): a, c, t, g, unknown or other
  misc_feature (197)..(197): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatccctcctgtctgcatctatgganacagacgtcacctatccacgttcgaccggggcaggtcaggccatcagcgtattcttagccttggtcncagcaagaaaccgngggaccacgcccctanacgtactcgtagtctagtgggtcgctactccgagtacgttagaccggtaaggggtcgggtacccctaagttcccggaagggtttcgaagggttcggccgtaagttcggactaacgttcggtacgggtaacgtagtaacgtttacccaaccgtttcacgtaactacgtcaacgtcgaaccgtccgtagccgtactccggttaagtaacgtttcgttttaaccgacttttaaaacgttttaccgttaacgtacgttaaactaaaccgtttaggttaaaccttttacgttaaacccggttaacccgttacggtacgggttacccggttaccgggaaccgggtaacgggtaaaccgtacggggtaacgaacgtaaccgtaacggtcgtcggtaggccgacgtaacc

SEQ ID NO: 216986 - DNA, 686 bp, Homo sapiens
  misc_feature: GYAE6OF02JC6TU.1.34.D01.1.454.CMB.1.raw
  modified_base (101)..(101): a, c, t, g, unknown or other
  misc_feature (101)..(101): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttggggagtcagaccctgtcaggacacagcatggacatgagggtccccgntcagctcctgggctcctgctgctcgtggctcccgaggtaccagctgtgacatccaattgaccctagtctccatcctcctgtctgcatctattggagacagagtccaccatcacttgccggacgagtcgaggtcctatcgagcgtatttcgtttggaccttggtcgacctagcctaagtaaacccggggcctaacgcccctanaggtactcgttagtctagtcggtacgcaacgtccaagtacgttcgacgtaacggggttcggtaccctagtcccggtaaacggttctacgggtacggtaccgtagtaccgtcgtaactcccgggttagggactaacgttacttaacccgtaacttccgttaacgtaacttaccgtaccgtaacgggtcctaacgtcccgttacgaccgtacggacctaaggttacgttatttccggaacttaagtttaccttactggttaaacctacttacggttaaacttaccgtaaccgttacccgttaggtaccgttacgtccggacggtaaccgggaactaagggtctaaacgtcccgaacggttaacgtgtaccgtacgtccgtaaccg

SEQ ID NO: 216987 - DNA, 609 bp, Homo sapiens
  misc_feature: GYAE6OF02JH984.1.34.D01.1.454.CMB.1.raw
  modified_base (171)..(171): a, c, t, g, unknown or other
  misc_feature (171)..(171): n is a, c, g, or t
  modified_base (248)..(248): a, c, t, g, unknown or other
  misc_feature (248)..(248): n is a, c, g, or t
tcagacgagtgcgtcacgaccggtgctcgatttagatcgtctgtgttgggtttgggcatggacatgagggtcccgctcagctcctggggctcctgctgctctggctcccaggtaccagctgtgacatccaattgacccagtctccatcctccctgtctgcatctattgganacagatcaccatcacttgccgggcagtcaggccatcagcgtattcttagcctggtgcagcagaacaggcgagccctnagatcgtagtctagtggtgcatccagattgacgaacgggttcgggtcccagtcccgtaaggttccgaaggttcggacaggttcgacacgttcgagggaaccagtacttacgactctacacgttactacgagcacgcctagaccacggacttaggaagttacttttagaacttaaagttttattaacctcgtaacaacgttagtttaattaacctaccgttaaccccttagggtacggtaccggttacggaccgtacggggaacaacgggtaagaacgtaacccgaacggtacgtcggtacggtcgtaggaccctacgtaacgtcgttcgttccttactaccgttcccttacccctaccccg

SEQ ID NO: 216988 - DNA, 664 bp, Homo sapiens
  misc_feature: GYAE6OF02J0LS8.1.34.D01.1.454.CMB.1.raw
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (646)..(646): a, c, t, g, unknown or other
  misc_feature (646)..(646): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagtagtcaccntcacttggccggacgagtcgacggccatcagcgtattcgttagcctggttncagacaacgaaaccgngggacgacgtcccctacgagtcgtcgtagtctagtggtacgacctataccgaagtcttcggacgtaacgggtcgggtacccacgttaccggtaacggtttcgaacggttgggaccgtagtcgacgtacgttaccggtaggggacttaaggtactttacccgacttaccgtacccgtaactactacgacgacgtcgtacccgtgacaccgtaccgttaaggtaattgtttaccgtaaactttaacttttacgtcctacgtaccaaagttagttaacgttaacctaccgtaccgttacggtacgttaccggttacggaaccggaagggtaacgtaacggtaggtaacgtaacccgtaacggtacgttcggnggttacccgacgtacccg

SEQ ID NO: 216989 - DNA, 425 bp, Homo sapiens
  misc_feature: GYAE6OF02G9HBI.1.34.D01.1.454.CMB.1.raw
  modified_base (200)..(200): a, c, t, g, unknown or other
  misc_feature (200)..(200): n is a, c, g, or t
  modified_base (359)..(359): a, c, t, g, unknown or other
  misc_feature (359)..(359): n is a, c, g, or t
  modified_base (396)..(396): a, c, t, g, unknown or other
  misc_feature (396)..(396): n is a, c, g, or t
  modified_base (402)..(403): a, c, t, g, unknown or other
  misc_feature (402)..(403): n is a, c, g, or t
  modified_base (405)..(425): a, c, t, g, unknown or other
  misc_feature (405)..(425): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaagggtgggtcccatccaggttcagtggcagtgcatctgggacagattacactcncactatcagcagcctgcagcctgaagtattttgactaattttattactgtacaacagttattatacgtacccctagtggtacgttcgaccgaggggaccaagggtgaacgtcaaacgtactggcgctcacacatctgtactcagtcctccccgcctccnacgcactcgtctgacggtccggctggaccgagccgtnagtagnnannnnnnnnnnnnnnnnnnnnn

SEQ ID NO: 216990 - DNA, 798 bp, Homo sapiens
  misc_feature: GYAE6OF02I7EI1.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccactcctccctgtcctgcacttactagttaggacgacagtacgtcaccattccacgttcggcccggggcgaacgtcgacgggaccatccgagccgtactttacgtttacgcccgttgggttacgacaacggactaaacggaaaacccgcgggggaccgtaccgtccccccttagacggtaccgttacggttaacggttacttacgtggggtacctacgtaccgtccgtaaggtacgttcgggaacggtaacgggggttcggggttaccccaacgtttacccggacggttaccgtacggtcggccgtaagttccgacgtaacgttcggtagggaacgtacggtaacctttaccgtaccttaccgtacctaacttacgtaccgacgtaccgtaccggacccgttcgaccgtacggtaccgtagtaaccgtttatttacgttaacgttaaattttacgtttactagttaacctaagttaactttaacgttaacgttacccgttaacccgttacggttaccgggttaaccggttaccgggtacccggtaaacggggtacccgttaaagggtaacgggtaacggtaacccggaaccggttaaccggttggtacggtacgtaccgtaacccg

SEQ ID NO: 216991 - DNA, 631 bp, Homo sapiens
  misc_feature: GYAE6OF02F2HJJ.1.34.D01.1.454.CMB.1.raw
  modified_base (271)..(271): a, c, t, g, unknown or other
  misc_feature (271)..(271): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctagttggagacagatcaccatcacttggccgggcgagtcaggccatcagcgtattcttagccgtggttgcagcaagaaaccgngggcgacgcccctgagactcgtagtctatgggtcgcatccagtactttggacgtaaggggttccgggtacccagtccgagggttcagggtcggctagtgctagttcggtacgggacaagtaacttacgaccttctaccgtactacgtcgaagccgacgtccgtgaccacggtaccgtaggtaaacgttcgttttagaacttttaagtttaactttacgtagttaacctaacgttaatttaaactttaacgtaaccgttaacccgttacggttacggtaaccggttcgggaaccggaacggggtaaccgtaagggtacggtaacgtaaccgaaccgtaacggtggtacggtcgtagtaccg

SEQ ID NO: 216992 - DNA, 753 bp, Homo sapiens
  misc_feature: GYAE6OF02H3I77.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagttggagacagatcaacatctacttcgccgggcacgtcacggccatcgagcgtatttctttagccgttggttcgcagcaaggaaaccgagggccgacgcccctagagtacgttacgtaggttacttagtcgggtacactacgtaccgtagtaagttcggaacgtaaggggttccgggtacccctaagttccgtaacggttcgtaaggtacggactaacgttcgactacgtacgtacggggaactaaggtaaacttacctaacttccttaccgtaacttaataccgaacgtacgaccgtccgttacggaccgtaacggaccgttaaggttaaacgtttacgtttaccggtaaacttttaaacgttttaactttaaccgttaacgtaaccgttaaacgttaactttaaacgttaaaccgtttaaacccggttaaccccgtttaacggttaccggtaaccggttttaccggggaaccggttaaccgggggtaaccgtaaagggttacggtaaacccggtaaccgtaaaccggtaccgttagggtaccggtaccggttccgaaccg

SEQ ID NO: 216993 - DNA, 563 bp, Homo sapiens
  misc_feature: GYAE6OF02FX7TM.1.34.D01.1.454.CMB.1.raw
  modified_base (276)..(276): a, c, t, g, unknown or other
  misc_feature (276)..(276): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcagtcaggccatcagcgatcttagcctggttgcagcagaaccagggcgagcccctnagtatcgtagtctagtggtgcatccagattgcgaaggtcgggtccagtcccaggtttcaggtggcagtgcatcgtggacagtactacnctaccgactatcacgcagcctanccgacgtcctacgaaagtacttttacgacttaattttaacgttactgtactaacagttaattagttaacgttaaccctaccgtagggtaccgttccggaccggacggggtaaccgaacggtagggtaacgaaccgtaaccggtaaccgttacggtcggtcgtcggtacctaacccg

SEQ ID NO: 216994 - DNA, 594 bp, Homo sapiens
  misc_feature: GYAE6OF02JK8N0.1.34.D01.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (468)..(468): a, c, t, g, unknown or other
  misc_feature (468)..(468): n is a, c, g, or t
  modified_base (554)..(554): a, c, t, g, unknown or other
  misc_feature (554)..(554): n is a, c, g, or t
  modified_base (561)..(561): a, c, t, g, unknown or other
  misc_feature (561)..(561): n is a, c, g, or t
  modified_base (589)..(589): a, c, t, g, unknown or other
  misc_feature (589)..(589): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctcctgtctgcatctattgganacagntcacatcacttgccgggacagtcagccatcagcgattcttagctggtncagctagaaaccgngggaccgtagcccctagacgactcggtagtctacgtggtcacactccaagtattcgacgtaaggggttcggtaccctagtaccgtagggtttacgagtcgggacttaagcggtcaagttccggagggtaacaggttaacttaaccgtaccttctaccgacttaagccgagtacaaccggctacgccacggaccttaggtaacgttnttttacgactttaaagttttctactagtaactaacgttaattaacttacgaccttacccgtgttcgacgttccggcgaacggtacngggtaanacgtaaccgaaccgtacgtaggcgtacntaccg

SEQ ID NO: 216995 - DNA, 827 bp, Homo sapiens
  misc_feature: GYAE6OF02IG6TH.1.34.D01.1.454.CMB.1.raw
  modified_base (251)..(251): a, c, t, g, unknown or other
  misc_feature (251)..(251): n is a, c, g, or t
  modified_base (592)..(592): a, c, t, g, unknown or other
  misc_feature (592)..(592): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctcgtggcctcccgaggtaccagctgtagaccactccaattcgaccctagtcctccactccctccctgtctgcacttctagtcggagacagactccaccatacctacgtcgggccggacgacgtaccncggacctagtccgagacgttatttcctttacggtccgttggttacgcgtacggacaaccggaaaccggacggggaccgtacccggtccccccgttatacggtaaccgttaccggttaacgttccgtttaaggttcggtacctaccgtaacgtacccgttaaggtacgtttacggaacgggttaacggggttcccgggtacccctaccggtaccgttacgggttacctacgggttcggacgtaggtacgtacctacgggtacggtacgggtacgtaacgttaaccgttaacctacccttactaaccgtaacgttacgtaccgtaacgacgtcccggttaccncgttacggacccgttaccggtaagtaaccgttttagttaccgttaatttaacgttttaaccgttacgttaccgttaactaaacttacggttttaacttaaacgtaacccgttaacccgttacgggtacccgtttacgggtaccggaacccggttaacggggtaaacctacggggttaaaccgtacggttaaacccgtacgttaccgggtaacgggttcctacgggaccgtacccg

SEQ ID NO: 216996 - DNA, 732 bp, Homo sapiens
  misc_feature: GYAE6OF02J13MD.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggcatggacatgagggtccccgctcagctccgtggggctcctgctgctctggctcccaggtaccagctgtgacatccaattcgacccagtcctccatccctccctgtcctgcatctatggagacagtacgtcaccatccacgttcggccgggcgaggtcacggacccatcgagcgtaactttcgtttacgccgttgggttcgctaagaccaaacggaaaacccgnggggacccgaccgtacccccgtacgaaggtacgttaccggttaagttccgttaaggttcgggttcgacctaacgtacccgtaacggttaattcggaacggtaaacgggggttccggggtacccctaacgtacccgtaaggtttccgaaggggttcggcgtaagttcggactacgtcggtacggggtaactaagtaccttaaccgactaccttacactatacgacgacacgtcccgagtccgtaacgtcgttaagtaaccgtttagtttacggaactttaaacgtttacgttacgtcgttaaacaccgttaagttaactttaacgtaccgttaccgtacggtacgttaccggacggtacgggaagggttaccggaagttacggaacttacccgacggtacgtcgtcggctagacctacgtcgttatccgtaactttcggaccttccgtcctacg

SEQ ID NO: 216997 - DNA, 714 bp, Homo sapiens
  misc_feature: GYAE6OF02GS85F.1.34.D01.1.454.CMB.1.raw
  modified_base (199)..(199): a, c, t, g, unknown or other
  misc_feature (199)..(199): n is a, c, g, or t
  modified_base (569)..(569): a, c, t, g, unknown or other
  misc_feature (569)..(569): n is a, c, g, or t
  modified_base (589)..(589): a, c, t, g, unknown or other
  misc_feature (589)..(589): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcgaagggtcgggtcccatccaggttcagtggcagtgcatcgtgggacagtattacnctctcactatcagcacgcctgcagtccgtagaagttattttcgacttaattttacttacgtcgtacaactaagttactttacgtaacgtacccctaggtacggtaccgttacggaccggaaggggtaaccgtaagggtacggtaaacgtccgaaaaccggtaacgtggtacggtcttacggactaacccagttccgttacggttctttacctaaccgttccctttaccccgaccgtaatttacccggtacggtaaaccgacccgtttacgttacccggttcgttaacgggaccgggtccgggtaaccgttgggggaaacccaaaggggggtcccctaaaggtaaccggtaagtccgtaagcgttacacgngtacgtagacgcggtaacgngtacgacgtacgtacgtacgtacgtacgtacgtacgtacgtacgtacgtacgtacgacgtacgtacgtagtacggtaccgtacgtacgtacggtacgtacgtacgtacgtacgtacgtacgtacg

SEQ ID NO: 216998 - DNA, 770 bp, Homo sapiens
  misc_feature: GYAE6OF02JDND7.1.34.D01.1.454.CMB.1.raw
  modified_base (311)..(311): a, c, t, g, unknown or other
  misc_feature (311)..(311): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccactccctccctgtctgctatctattggagacagagtacaccatcgtacgttcggcccggggcgacgtcgacggacccatccacgaccgtatttcctttacgccgttggttcgcgaacgtacgaacggtaaaacccggngggggaccgtaaccggtcccctaacgacggtacttaccggtagttcctagtagggtcactactaccgagtacgttacggacggtaacggggttacgggtaccccaacgttaccggtaggtttaccgaaggtcgggtacgtacggtcgacgtacgtaccgggtagggacctaaggtaacctttactaaccgttcctaaccgtaacttaagtcccgaaaggtccgtaccgtccctacggaccgtaccgtacccggttagaaagttttaccttttaccgaacttttaaaagtttaccgttaacgtcgtaacctaaaaggttacgttaactttaagttaaccccggtaccgtttacgggttcggtaaccggtccccgggaacggggtaaaccgggtacgggtaaagggttaccggaagttaacccgtaacccgggtagttcgggtaccgttacgtacgaaccg

SEQ ID NO: 216999 - DNA, 528 bp, Homo sapiens
  misc_feature: GYAE6OF02F24XC.1.34.D01.1.454.CMB.1.raw
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (372)..(372): a, c, t, g, unknown or other
  misc_feature (372)..(372): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcgagcgattctttagcctggttgcagcagaaaccngggcagcccctnagatcgtagtctagtggtgcatccagattgcaaggtcgggtcccagtccaggttcagtggcagtgcatcgtagggacagattacactctanactatcagccagcctgcagcctagaagtattttgacttaagtttattacgtagtacaactagttaattagtaaccgttaccctagtcggacgttcgggacaacggggtaccaagggtggaacgtccgaaaccgtaccgtggtacggtactggaccc

SEQ ID NO: 217000 - DNA, 670 bp, Homo sapiens
  misc_feature: GYAE6OF02I6RKD.1.34.D01.1.454.CMB.1.raw
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctcatcctccctgtctgcatctattggagacagacgtcaccatccacttcggccgggacgagtccgaggcccatccagccgtatttctttacgccttggttcgcagacaacggaaaccgngggaccgacgcccctanagtacgttcgtacgttcgtaagtcgggtcgacctacgtacccgagtacgttacggacggttaaacggggtccgggttaccccaacgttcccggtaggtttaccgtagggtacggacgtacggtcgacctaggtaccggtacggggaaccgtaagtaacctttaacccaaccgtttcctacgtaaccgttactacgaccgtcgacgtccctagacgtacgtaccgtaaggtaacgtttatttacgactttaagtttactagttactactaagtacgttattacgtaccgtaccgttagtacggtacgtccggacgtacgggtaccgtaggtaaccgacgtacgaacgtagtcggacggtcacgtacc

SEQ ID NO: 217001 - DNA, 836 bp, Homo sapiens
  misc_feature: GYAE6OF02HN309.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgaccctagtcctccatcccttcccgtgtctgctattcttagtggagacgagacgtcacctatcctacgttcggccgggtcgagtccgacggccatcgaagcgttatttccgtttacgtccgttaggttgaccgacggtaccgaaacggtaaaaccggcggggaccctacggtccccccgtagtacggtacgttaccgtacggttccgttacgttacgggtcgtacacttccgaagtgtttacggaccgttaaggggttccgggtacccctagttacccggtagggttacgacggttacgggaccttagggtacgtaccgtacggttccggtagggaaccttaggtaccttaaccctacgttaccctaacgtaactttacgtaccgtaacggtcccgtacggtacctacggtacccgttacgacccggtttaggtaaacgttttacggttttaacgtaccttttaaaaggttttacctttaacgggtcgttaaaccgtaaaccgttaagttttaaaccgtttaaccgttaaacccgggtttaccccgtacgggttacgggttaccccggtttacccgggggtaaccgggtaaacccggggtaacgtaaaccgggggttacgggtaacccgtacccggtaaaccgggtcttcggggttaccggtccgttacggaacccg

SEQ ID NO: 217002 - DNA, 865 bp, Homo sapiens
  misc_feature: GYAE6OF02GN9DT.1.34.D01.1.454.CMB.1.raw
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
tcagacgagtgcgtcacgaccggtgctcgatttagatcgtctgtgttgggtttgggcatggacatgagggtccccgctcagctcctgggctcctgctgctctggctcccaggtaccagctgtgacatccaattgacccagtctccatcctccctgtctgctatctattggagacagagtcaccatcacttggccgggcgagtcaggtccatcaggctatttctttagccttggttanccagacgaagtaaaccgngggcgaaccgcccctanagatccgtagtacttagtacgggtnaccgacgtacccgtgtaacgtttggcgtaaacgggggttccgggttacccccacgtacccgtaaggtttccgtaagggttacgggtacctagggttacgacgtaccgtttaacgggtccgggaacgtttaaggttaacttaaccgtaccttacttaacctaaaccgtttacgccgtaaacggtaacccgacgttacccggtaacgggtacccgtaccggtaaacggtttaccggtaaaagttttaccggttttaacgtttaacccgtttaaaacgtttttaaccgttttaaccggtttacctttaaccgtaaacggtttaaacccgtttaaaccttttaaccggttaaaccccgggtttaaccccgtttaaccgggggttaccgtaaaccgggttttacccggggaaccggttaaacggggttaaccccgggtaaagggttaaccgggtaaccgttaacccgtaaaccggttacgttaggggtaccgttaccgtacggaaccccgttaacgtacggtttccgtaacgtttaccggtttctacccgtttaccccggaccctttacccgg

SEQ ID NO: 217003 - DNA, 686 bp, Homo sapiens
  misc_feature: GYAE6OF02FX78D.1.34.D01.1.454.CMB.1.raw
  modified_base (143)..(143): a, c, t, g, unknown or other
  misc_feature (143)..(143): n is a, c, g, or t
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccngctgtgacatccaattcgaccctagtctccatccctccgtgtctgcattctagttggaagacagacgtccaaccgatcctacgttggcccggggctaaggtccaaggccctaatccgagcgtatttccgtttagccttggttgccagacagaaaccgngggacgaccgcccgtcagngtcgtatctagtggtcgctactacagtagttgacgtaaggggtcgggtaccccagttcccgaggtttacgtacggtcggtacgtaaggtccgagttaacgtccggttacgggaactaacgggtttacttaaacctcggttaccgtaaccgtaaacttagaccgtaacgttaccgggaactcccgttagacccgtagtaacccggtagtaacgttagtttttacggaactttaaattttaccgttaatccgttataaacgtagtttaacgttataacccgtaccgttagtaggtacccgttcggaaccggacgggaacgttaacggagtaacgtaccggaacttccggttaggacgttcgacctacg

SEQ ID NO: 217004 - DNA, 457 bp, Homo sapiens
  misc_feature: GYAE6OF02H25K3.1.34.D01.1.454.CMB.1.raw
  modified_base (225)..(225): a, c, t, g, unknown or other
  misc_feature (225)..(225): n is a, c, g, or t
  modified_base (440)..(457): a, c, t, g, unknown or other
  misc_feature (440)..(457): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcatatcagcagcctgcagcctgaagtntttgactaatttatactgtacaatagttattatacgtacccctaggtacggtacgttccggacgacggggacctaagggtggaatcgaaccgaactggtcggctgcacctatcctagtccttacgacttccgttcccgctacttctacgaaccgtctaaccgttcgtctacggagtccggggtctagggaccgaaggggtcccgatagtagcgannnnnnnnnnnnnnnnnn

SEQ ID NO: 217005 - DNA, 631 bp, Homo sapiens
  misc_feature: GYAE6OF02JV575.1.34.D01.1.454.CMB.1.raw
  modified_base (141)..(141): a, c, t, g, unknown or other
  misc_feature (141)..(141): n is a, c, g, or t
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
  modified_base (504)..(504): a, c, t, g, unknown or other
  misc_feature (504)..(504): n is a, c, g, or t
tcagacgagtgcgtcacgaccggtgctcgatttagatcgtctgtgttgggtttgggggagtcagaccctgtcaggacacagcatggacatgaggtccccgctcagctcctgggctcctgctgctctggctcccaggtaccngtctgtgacatccaattcgacccagtcctccatccctccctgtactcgctacttctagttgggagacagtgtccacatccacttggccggcgatccagccctatcagcgtattcttagcctggttcncagtcaagaaccggggccacgcccnacgtntctagtctagtgganctatccagtatgcgtaagggtcggtaccctagtccctgggttaccaggttcggcgaagttcgactcgtcggtacgggtacctaagtactttaaccgtcttacccgtacaaccggttanaccgacgactaaccggtccnggtaccacgtaccggttagtaaagtttacgttttacgactttaaaaccttttnttacccgtaagttacaacgttagttaacttacgtaccgttacctacggtcgtacgttccggaaccgtacggggtaaccagggttaccgtaacgtaccgtacgtaacgtctaacggccgttagaaccg

SEQ ID NO: 217006 - DNA, 853 bp, Homo sapiens
  misc_feature: GYAE6OF02JNMQ2.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccgaggtaccagctggtgaccatacccaagttcgaccccagttcctccatccctcccttgtctgctattcgtattgggacgacagtcgtaccaccattcacgttcgggaccgggcgtacgtccgacggccatcgacgtcgtattttaccttacggtccgttggttcgcacgacgtaaacggaaaccgacggggaccggaccgtcccccgtagtacgtacgttacgtgttacctaggttcggtcgcctacgtaccgtaggttagttaccggacggtacgggggttaccgggtacccgtaaccgttccggtaacgggttacggttaacggtaccgggtagtaaccgggttcgacccttaaacggttcccgggttacgggaaccgttaacggttaacctttaaaccgtcccgtttaacctccgtaaacgttaaccttacgaacgggtccctcggtaccctacggtccgtaaccggtcggttaaacgttaaggttttacgtttacggttaactttaaacgttttacttaaccggttaacttaacgtaagtttaaccttaacgtttaacccgttaacccggtttaaccccggttacggttaccgggtacccggttaccgggtaaccgggggtaaccgggtttaaaccggtaaccggggtaaaccggttaacggttaaaccggtaacccgtttacggtacgggtccgggtttacctacggtaaccc

SEQ ID NO: 217007 - DNA, 649 bp, Homo sapiens
  misc_feature: GYAE6OF02FNTKZ.1.34.D01.1.454.CMB.1.raw
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (424)..(424): a, c, t, g, unknown or other
  misc_feature (424)..(424): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcggccgggcgagtcaggccatcagcgtattctttagccgttggttgcagccagaaaccgngggccacgcccctcgngagtcgtagtctagtggtgcatccagtattgcgtaagggtcgggtccctagtcctacggttacaggttcggctaggtcgcgtaagttcggtaggggtaacacggtaacttaccgaccttcctacgtaacttancgtacgccgtacgtacctgccacggtcccttaaggaagtttacgtttcgacttaaagtttacttacgtagttacctaaacgttagtttaaacgttaccttaaccgttaccccgtaggttccgggtaacggtttacccgggaaccggtaacggggtaaccgtaaggggtttaccggaaacggtaccgtaacccggtaaagtttccgggaggtaccgtcggtaaccc

SEQ ID NO: 217008 - DNA, 782 bp, Homo sapiens
  misc_feature: GYAE6OF02IF16I.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccactccctccctgtctgctatctattggagacagactcacatctacgttggccggcagtcaggcatcagcgtactttcgtttacgccgtggttgccgagaccgaacgaaaacccggaggggaccgaacgcccccgtagaacggtacgttaccggttaacggttccttaagtcgggttacgtacctaacgttcccgaaggttaacgtttacgggaaccggtaaacggggggttcccggggttaccccctaacggtttacccggtaacggggttttccgaacgggttcgggaccgtagggtcgtacgtacgttccggtacggggactaaggtaactttacgaccttcctacgaactctacgacgacacggtccgtacgacgaccggtacgtacgttaaagttcgttttagaacgtttaaattttaacgttaccgttacgtaaccgtaacgttaagtttaacgttaacgtacccgtacccgttaaccccggttacggtaccgggttacccggtttaaccggggaaccgggtaaccggggttaacccggtaaagggtacgggtaaccggtaacccgtaaaccgggttaaccgttagggtccggtacgtacccgg

SEQ ID NO: 217009 - DNA, 782 bp, Homo sapiens
  misc_feature: GYAE6OF02HOJRR.1.34.D01.1.454.CMB.1.raw
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgctatctatggagtacagagtcaccatcacgttgccggtgagtcaggccatcagcgatttcttagtcctggttcncagccaaggaaccgagggaccgacgcccctanagtactcgtaagtcctagtcggtacacctacgtaccagtacgttcggaccgtaaggggttccgggtacccctaagttcccgtagggttacccgtaggtacggcgtaagtcgacgtacgtttaccggtaagggtaacctaagtaaccgttaccctaccgttaccgtaacccgtacgttaacgtccgaacggaccctaacggtcccgacggtccgtaaaccgccggttaaaggaacttttaaggtttccggtaaacttttaaacgtttttaacttaccgtaacggttaaccaaacggtttaagtttaacgttaaaccgtaacccggtttaacccgagggtttacccgggttaacccgggttttaacccgggaaccggggttaaaccggggttaaccggtaaacggggtttaaccggtaaaccgggttaaccccgtaaaacccgggttacggttacgggggttaacccgtacccggttaccgtaaacccgg

SEQ ID NO: 217010 - DNA, 748 bp, Homo sapiens
  misc_feature: GYAE6OF02I6LCN.1.34.D01.1.454.CMB.1.raw
  modified_base (257)..(257): a, c, t, g, unknown or other
  misc_feature (257)..(257): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccaatccctccctgtctgcatctattggagacagatcaccatcacttgccggcagtcagccatcagcgattcttagcctggttgcanacaagaaaccgagggcgacgcccctagagacgtcgtagtctagtggtgacatccatattgacgaaggtcggtacccaatcgaggtcgaggtgtcagtgctagtcgtagggactaagtacttacactactacctaacgtatccgagtaccgacgtcccgttaggacctaacggtacccgttaggtaaaagtttacgtttttaggaaccttttaaacgttttaaacttttacgtaacgttaaaccttaaacgttaacgtttaaacgttttaaacgtttaaaccccgttaaacccccgtttacgggttaccggggttaacccggtttaccccgggggtaaaccccgggtaaaccgggggggttaaaacccccgggtaaaacgggggttttaaacccggggtaaaaggtttaaaccccccgggtaaaacccggggtttaaaaaccccggttaacgggggtttaaccggtaaccccgttttacccgggaaccccgg

SEQ ID NO: 217011 - DNA, 807 bp, Homo sapiens
  misc_feature: GYAE6OF02JWH9L.1.34.D01.1.454.CMB.1.raw
  modified_base (202)..(202): a, c, t, g, unknown or other
  misc_feature (202)..(202): n is a, c, g, or t
tcagacgagtgcgtcacgaccggtgctcgatttagatcgtctgtgttgggtttgggggagtcagaccctgtcaggacacagcatggacatggagggtccccgctcagctccgtgggctcctgctgctctggctcccaggtaccagctgtgacatccaattcgacccagtcctccatccctccgtgtctgcattctattgganacagacgtcaccatcacgtcggccgggacgagtccgaggacccagtccgagtacgtactttacgtttacggtccgttgggttacgacgagacgaaaccggaaaacccggacggggaccgtacccggcccctcgaagtacgttaccggtaagttccgtagtgggtacacgtcgacctagtacgttcggaacggtaacggggtccgggtaccctaacgtcccgtaacggtttacgacggttcggacgtacggtcgtacgtacgtacggtacggggtaactaaggttaacctacccgtaccgtttacctacgtaacccttacgttacccgtaacggtacccacgtacccggtcggtaaaccgtaccggtaacggttaaaccggtttaagtttaccgtttttaggttaaaccccttttaaagttttacccgttagtaaccgttaacaaacggttttaacgttaaacgttttaaacgtaaccgtttacccgtttacggtaccgggttaccggttaccgggtacccgggtaaccgggtaaccgggtaaccggtaacgggttacgggtaaacgtacccggtaaccgttaggtaccggtacggtaccgtaccg

SEQ ID NO: 217012 - DNA, 680 bp, Homo sapiens
  misc_feature: GYAE6OF02HNCOS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctcctgtctgcatctagttggagacagacgtcaccatcctacgttcggccgggacgtacgtcacggccatcgacgtacgtactttcgtttaacgccgttggttcgcgtaacgacgtaaacgaaaccgagggaccgaccgtcccctagagtacgtacgtacgtactaggtggtacgctacgtacctagtacgttaggaccggtaaggggtccgggtaccctacgtaccggtacggttacgtacggtcggacgtacgtcgactacggtcggaggacctagtacgttaactaccttctactacgtactacgtacgcgtacgtacgtgacctacggtcgttaagtaacgttagtttacgtaactttaagtttacttacgtacgttaccaagttaattacgttaactaccgttaaccgttggttacggtaccggttcggaaccggtacgggtaacgtaaggtacggtaacgtaccgtaaccggtacgttcggacgttcacgtaacccg

SEQ ID NO: 217013 - DNA, 822 bp, Homo sapiens
  misc_feature: GYAE6OF02GN9FN.1.34.D01.1.454.CMB.1.raw
  modified_base (102)..(102): a, c, t, g, unknown or other
  misc_feature (102)..(102): n is a, c, g, or t
  modified_base (199)..(199): a, c, t, g, unknown or other
  misc_feature (199)..(199): n is a, c, g, or t
  modified_base (812)..(812): a, c, t, g, unknown or other
  misc_feature (812)..(812): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtgtacatccaattcgacccagtctccatcctccctgtctgcatctagttgganacagagtcaaccattcacttcggccggggtacgaggttaccacggaccctaataccgaaggccgtaagttttccgttttaacggccttcgggtttgaccgagtaccgaacggtaaaaacccgaggggacccgtaccggacccccgtacgacgtaacgtaccggttaacgttcgtaacgttgggttaggacctaacgtcccgtaaggtaacgtttacgggaccgtaaaacgggggttcccgggggtaaccccctaagtttcccgggtaacgggtttaccgtaggggttacggtacccggtaaggttcgaaccgtacgttccgggtaacgggtaacaagggttaacctttaacggtaaccctttcgtaacctaactaccgtaccgaacggtaccgtaacgtccgtaacgaccacggtacccgtaggaaacgttttacggtttacaagtttaacgtttaaactttaccgttacgacttaaacttaaggttaacctttaacgtaacccggttaaccccgtaggttaacgggtcccgttaaccgggacggttaaccgggaaccgtaacgggttaacggaaccgttaacggaaaccggttacgtacgggtacttaccgngtaaccccgg

SEQ ID NO: 217014 - DNA, 616 bp, Homo sapiens
  misc_feature: GYAE6OF02F4KSC.1.34.D01.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
  modified_base (465)..(465): a, c, t, g, unknown or other
  misc_feature (465)..(465): n is a, c, g, or t
tcagacgagtgcgtcacgaccggtgctcgatttagatcgtctgtgttggggtttgggggagtcagacctgtcaggacacagcatggacatgagggtcccgctcagctcctggggctcctgctgctctggctcccaggtaccagctgtgacatccaattgacccagtctccatcctccctgtctgcatctattgganacgtagagtcaccatcacttgccgggcagtcaggccatcagcattcttagccgttaggttcgacgagtcaagaaaccgagggacgacgacccctanacggtattcgtagtcgtagtggcgcgactccgaagtagttcgacggtaacgggtccgggtaccacgttaccgtaggttccgaggtcggcgaggtcgacacgtcgtacggacagtattacgctactacactacncgagacgacgcgtacganacgtcgtagtaagttcgtttanacgttaactttactacgtacgtaacacgttagttaacttagtacccgtttaaccggtacgttacggtacgttaccgggaacggacggggtaaccgtagggttaacgacggtacccgtaacggttaccgtaggttacgtcgtacggtaaccg

SEQ ID NO: 217015 - DNA, 682 bp, Homo sapiens
  misc_feature: GYAE6OF02JHXUP.1.34.D01.1.454.CMB.1.raw
  modified_base (300)..(300): a, c, t, g, unknown or other
  misc_feature (300)..(300): n is a, c, g, or t
  modified_base (429)..(429): a, c, t, g, unknown or other
  misc_feature (429)..(429): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggacgacagagtcaccatcacgttcggccgggcgagtccgaggcccatcaacggtcgtatttcgtttacggccttgggttacgcaaggaccaaacggaaaacccgnggggaccgtaaccgcccctagaggtacttcgtaaggtcctagtcgggtcactacgtaccagtacgttacggacggtaaggggttccgggtcccaacgttccggtacggttcgaaggtcggactaggtcncacgtcgtagggaactacgtactaccctacgtctaccgtacttacgcgacgccgtaccgccgttacgcgtaaccgtccgttaagagttttactacgttacttaaagtttaaccttagtacgttaacaacgttaagtttaacgttaacttacccgggtacccttacgggtggttacccgggttacgtaccggggaaacggtacgtaagggtacggtaacaccggtaacgtacgtcggtacgttcgacgtaaccg

SEQ ID NO: 217016 - DNA, 689 bp, Homo sapiens
  misc_feature: GYAE6OF02FI1OU.1.34.D01.1.454.CMB.1.raw
tcagacgagtgcgtcacgaccggtgctcgatttagatcgtctgtggttgggtttgggggagtcagaccctgtcaggacacagcatggacatgagggtccccgctcagctccgtggggctcctgctgctctggctcccaggtaccagctgtgacatccaattcgaccagtctccatcctccctgtctgcatctagttggagacgagagtccaccatccgtacgttcggccgggacgacgtcacggccatcagctattcgtttagccttggttgcagtcaagaaaccggaggggccgaccgccccctagacgtacgtcggtaaggtcgtaaggttcgggtacgcgacgtaccgaaggtattcggacgtaaacggggttcgggtacccctaagtcccggtaaggtttacgaaggttcggtacgtacggtcgtactacggtacggtacgggaactacggtaactttaaccgaccttcgtaacgtactaacgtacacgacctaacgtcctcgtaccacgttaccgtagtaagtttcgtttagaacgtttaatttacgttaaccgtcgtaacgtaacttaagttaacttaacgttaccgttaaccgttacggttacggtacgtccgggaacggacggggtaaccgtagggttacgtaacgtacccgaacgttaggtcggtcgaccgtgtaacccg

SEQ ID NO: 217017 - DNA, 687 bp, Homo sapiens
  misc_feature: GYAE6OF02JM2KU.1.34.D01.1.454.CMB.1.raw
  modified_base (234)..(234): a, c, t, g, unknown or other
  misc_feature (234)..(234): n is a, c, g, or t
tcagacgagtgcgtcacgaccggtgctcgatttagatcgtctgtgttgggtttgggcatggacatgagggtcccgctcagctcctggggctcctgctgctctggctcccaggtaccagctgtgacatccaattgacccagtctccatcctcctgtctgcatctattggagacagagtcaccatcacttggccgggcgagtcaggccatcaagcgtatttcttacgccgttggtncagtacaacggaaaccgagggacgacgcccctgacgactcgtacgtctagtcggtgctactccgaagtagttcggacgtaacggggtccggggtacccatacccgtaggttcaggtcggacagtcgctaacgtcggtagggaactagtacttaaccgtacttacgtaccaacttactcgaagtacctagcctagctagtccgttaaggaactttgttataaccgttaatttaccgttatacggtactaacgttaatttagtaaccttaaccggtacccgttaacggtcgggtttaaccggtcgggtaacccggtaaacggggtaacccgttaaagggtaacgggttaaccgtaacccgtaacccggtaacggtttacggtaccgggtcctaacgtcccaaccgttacgttacggtttacttaccttacgtcccgtttacccttaccccgaacg

SEQ ID NO: 217018 - DNA, 865 bp, Homo sapiens
  misc_feature: GYAE6OF02HVNZQ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatacctaattcgacccagtcctccactcctccctgtctgcatctagtgagacagagtcaccatccacttcggccgggcgacgtcgacggccagtcgagcgtatttcttacgtccgtaggttcgacacgacgaacggaaaccgagggaccgacgaccccgtacgagtacgtacggttaacgttcgtagtgggtctaccgtaactccgaagttacgttacggaccgggtaacggggtttccgggtaccccgtaacgttacccgggtaacgggtttaccggtaagggtacgggtaccgtacggttacgtaccggttacttaccgggggttaacgggtaaccgttaacggtttaaccttttaaacccgtccgtttaaccccgttaacgttaacccgtttaacgtacccggtaccgggtaaccgtaccggtcccggttagacccggtaacgttaccggtaacgttaagggttaaccgttttttacgaaacgtttttaaaccttttaacggttttaacttaaccgggtaaaccttaacggtttaaacgttttaaaccgtttaaccggtttaaacccggtttaccccgttaacggggtttacccgggttccggggttaacccgggacccgggttaacggggtaacccgggtaaggtaaaccgggtacggtaacccgtaaacccgggtaagtttacccgggtacggtaccgccgtaacccgg

SEQ ID NO: 217019 - DNA, 786 bp, Homo sapiens
  misc_feature: GYAE6OF02IR1T5.1.34.D01.1.454.CMB.1.raw
  modified_base (514)..(514): a, c, t, g, unknown or other
  misc_feature (514)..(514): n is a, c, g, or t
tcagacgagtgcgtcacgaccggtgctcgatttagatcgtctgtgttgggtttggcatggacatgagggtccccgctcagctcctggggctcctgctgctctggcctcccaggtaccagctgtgacatccaattcgacccagtcctccactcctccctgtctgctattacgtagttaggacgacagacgtccaccatctacgttcggccggacagtcacggaccagtcgacgtcgttactttcgttacggccgttaggtcgaccgaacggaaccgtaaaccggtaaaaccggcggggacccgtacccgtaccccgtacgtaacgttacgttacggttacgtttaaccgtacggttacgggtacctaaccgttaaccgtacgtaacggttaccgtacgggtaccggtaaccggggttcccggtacccttacgtcccgggttaaggttcgaacggtcgtacgtacgtacgtacgacggttacggaacggtaactacgttacctacgtacctcctanaacctgtaccgataccgtcgtacgtacgctacgtacgtagttacgtattagtacttagttacgtactagtaaccgttaagttacgttacctaccggttaacccgtacgttacgggtacgtaccggtacgggaacgtacgggtaaagtaccggtaacgtaccgtaacgtccggttagtaccgggtcttacccgggtacctaccgttacgtttaccggttccctttaaccggttacccgtacccgtttaccgtttaccccgggaaccttcccgg

SEQ ID NO: 217020 - DNA, 760 bp, Homo sapiens
  misc_feature: GYAE6OF02HMNYQ.1.34.D01.1.454.CMB.1.raw
  modified_base (199)..(199): a, c, t, g, unknown or other
  misc_feature (199)..(199): n is a, c, g, or t
  modified_base (268)..(268): a, c, t, g, unknown or other
  misc_feature (268)..(268): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (367)..(367): a, c, t, g, unknown or other
  misc_feature (367)..(367): n is a, c, g, or t
tcagacgagtgcgtcacgaccggtgctcgatttagatcgtctgtgttggggtttgggggagtcagaccctgtcaggacacagcatggacatgagggtccccgctcagctctggggctcctgctgctcgtggctcccaggtaccagctgtgacatccaattgacccagtctccatcctccctgtctgctatctattgganacaggatccacatcacgttggcccgggagagtcgacggccatccgagcgtaatttcttagccttgggtnccagtcgaaagaaccggaggggcaccggcccctagagtactcggtaggtcctagtgggtcactacncgaagtnttcggacgtacggggtccggtacccngtaccgtagggtttacgagggttcgcgtaacgtcgacgtaggtcggtagggtacctaaggttactaaccctaacgttccgtaactaacgttactaccggaacgtccgacggttcccagaccggtacgttccggtaagtaagttccttttaagtaccgttaaattttttaaccgtcgtaaccggttaactaactttaacgtttaacttaaaccggttaaaccccggttttacccggaacgggtttttaccggggtaacccggtttaccgggggaaccggggttaaccccggggggtaaaccttaaaggggttaacccggggaaacctttaaccccgggggaaaaccgtttcgggttaacccgggtttcggggtaccctttacccggtaaaccgg

SEQ ID NO: 217021 - DNA, 867 bp, Homo sapiens
  misc_feature: GYAE6OF02G1UEX.1.34.D01.1.454.CMB.1.raw
tcagacgagtgcgtcacgaccggtgctcgatttagatcgtctgtggttgggtttgggggagtcagaccctgtcaggacacagcagtggacatgacgggtccccgctcagctccgtgggctcctgctgctcgtggcctcccgaggtaccagctgtgacataccaattcgacccagtcctccatccctccctgtctgactattctagttaggacgacgagacgtccaacctattccgacgttcgggcccgggtagaacgtccgaacggccctagttccgaggtacgttaacttttccgtttaacggtcccgtttgggttacgaccgtacggaccgtaaacggaaacccggaggggacccgacccgtacccccgtagaacggtacttccggttaacgttacgttaggtcggtacgactaccgtaccgtaagtacttgggacggtaaacggggttccgggtaccctacgttaccggtaggttaccgtagggttcggtaacgtaggtacgtaccgtaggtaccggtaacggaacgtacgttaacgttacctaaccgtcgttaacctaacttaccgtacgacgacccgttacgtccgtaacgaccgtacgttacggtaacgttacgtttaacggttttaacgtaacgttttaaacgttttaacttaccgttacgttaaaccttaacgtttaaacgtttaaccgttttaacccggtaaacccgtttacccgtttaaggggttcccggttaacccgggtttaccgggtaaccccggggtaaacggggttaaaccggtaacggggttaaccggtaaccggttaacccggtaaaccgggttccggtaaacgggttccctacggtaccggtaaacccc

SEQ ID NO: 217022 - DNA, 592 bp, Homo sapiens
  misc_feature: GYAE6OF02FU9ZF.1.34.D01.1.454.CMB.1.raw
  modified_base (258)..(258): a, c, t, g, unknown or other
  misc_feature (258)..(258): n is a, c, g, or t
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtatttcttagccttggtncagcaagaaaccgagggcgacgcccctgagtatcgtagtctagtggtgcatcagtattgacgtaagggtcgggtcccagtccgaggttcgaggtcggctagtgctagtcgtagggacagtattacactctcactancagccagcctgcacgtctaggaattnttttacgactttaaattttacttactacgttaactaacgttagttaactttacttaaccgttaccccttagggttacggtaccggttaccgggaccggaacggggttaaccgtaaggggttaacgtaacggttaacccgaaccggtaagttcggtacggtcgtacgtacccg

SEQ ID NO: 217023 - DNA, 649 bp, Homo sapiens
  misc_feature: GYAE6OF02GJUC9.1.34.D01.1.454.CMB.1.raw
  modified_base (224)..(224): a, c, t, g, unknown or other
  misc_feature (224)..(224): n is a, c, g, or t
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagacgtcaaccatcacttgccgggngagtcaggccatcagcgattcttagcctgttgcagcagaaaccngggcagcccctgagatcgtagtctagtggtnctagtaccagattcgacgtaagggttcgggtacccattcccgaaggttccgagtcgggacctagtgaccgtagtcgtagggaactaggtaattaccgactcctataaccttaatccgaagacctacgcccgtagcaaccgtcgtaagaacgttatttacgactttaaagtttacttaacctcgttaacaaacgttacgttaacttaacgtttaaacccgtaacccgtttaagggttaccggttaacgttacccgggtacccggtaacgggggtaaaccctaaggggttaacggtaaaccggtaccgtaaacccggtaacggttagggtaccggtacgtaccggtaacccg

SEQ ID NO: 217024 - DNA, 668 bp, Homo sapiens
  misc_feature: GYAE6OF02FODA6.1.34.D01.1.454.CMB.1.raw
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
  modified_base (484)..(484): a, c, t, g, unknown or other
  misc_feature (484)..(484): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacagagtccaccatccacgttcggccgggcgacgtcaggccaagtcaggcgtatttcttagtcctggttcgcagcaagaaaccgngggcacgcccctacgagactgtagtctagtggtcncactccagtattcgacgtaaggggtcgggtcctaacgtcgtaaggttcaggtcgacgtaggtcgactaagtcggtagggaacctaaggtaactttaccaacttcctacctacgttaactccgaacgcgtaaccgtccgtacgtaccacggtaccgtaagtaacgttnttttacgaaactttaatttaccgttacgtacgtaactaaacgttagttaaactttaccgtaaaccggtttacccccgttacgggttacgggtaaccggtttaacccggggaaccgggtaacgggtaacccgggtaagggtacggtaacgtaccgtaacgtaaccggtggtacggtcagtacccg

SEQ ID NO: 217025 - DNA, 770 bp, Homo sapiens
  misc_feature: GYAE6OF02ICEBI.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagcctgtacatctaactagtaccacgtactccactcctccctcgtctcgcactctacttaggtacgacgagaacgtactaccaactactaccgttcgccggggaccggtaacgtacgtacggaccgtactacgtacggaccgtagtttacctttttacggttaccgtcggtttaggtccgaacgtaccgtaacggaaaaacccgtaaacggggacgggtaaccgaccccgttccccccgtaaagcgttaaccggttaacggtaccgtttacgttagggtcggtacctaacgtaccgtaacgtaacgttcgtacgaaacgggtcgggtacccgtacctacgtacggtacgtacgtaggtcaacggtgacgtacgtacggtggtaacgaagtacgttaactacgtcctacgtaactaacgtactacgacacgtcgtacgacgtacgtaccgtagtaagttaacgttcgtaaacgttaactttaattacttcgtaactaaacgtaagttaactttacgtaaccgtaacccgtacgtacggttaccggtaaccggttaccggaaacggtaaccggtaacggtaacggttaaacctaccgtaaccgtaacgtggttacgactcgacgtaaccc

SEQ ID NO: 217026 - DNA, 640 bp, Homo sapiens
  misc_feature: GYAE6OF02HICPZ.1.34.D01.1.454.CMB.1.raw
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
  modified_base (484)..(484): a, c, t, g, unknown or other
  misc_feature (484)..(484): n is a, c, g, or t
tcagacgagtgcgtcacgaccggtgctcgatttagatcgtctgtgttgggttgggggagtcagaccctgtcaggacacagcatggacatgaggtccccgctcagctcctgggctcctgctgctcgtggctcccgaggtaccagctgtgacactaccaattcgaccccagtcctccatccgtccctgtctagcatctatggagacagacgtcaccgatcacgttgccggacgagtcaggccagtcagcgtattcttagcctggttnctagcaagaaaccgtagggcgaacnccctnacgatccgtaagtcctaagtgtacgctacgtccgaagtattaggaacggtaacggggtccgggtaccctaagttcccgtaagtttccggaagtcggtacagtagtaacgtcgtagggacagtactaacnctctaacgtanactcgacgactacgccttaggactacgtaccgtagaaggttacttttanaactttaactttaagtaaccgtgtaactacgtaagttaacttacgtaaccgttacccgtagtcggtaccgttcgggaccggtaaacgggtacccggtaaggtaacgggtaaccgtaacgtaaacggtaccgtaggaacggtctaccgacctaaccg

SEQ ID NO: 217027 - DNA, 631 bp, Homo sapiens
  misc_feature: GYAE6OF02HT4Q7.1.34.D01.1.454.CMB.1.raw
  modified_base (570)..(571): a, c, t, g, unknown or other
  misc_feature (570)..(571): n is a, c, g, or t
  modified_base (590)..(591): a, c, t, g, unknown or other
  misc_feature (590)..(591): n is a, c, g, or t
  modified_base (593)..(594): a, c, t, g, unknown or other
  misc_feature (593)..(594): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (602)..(612): a, c, t, g, unknown or other
  misc_feature (602)..(612): n is a, c, g, or t
  modified_base (615)..(615): a, c, t, g, unknown or other
  misc_feature (615)..(615): n is a, c, g, or t
  modified_base (617)..(622): a, c, t, g, unknown or other
  misc_feature (617)..(622): n is a, c, g, or t
  modified_base (624)..(625): a, c, t, g, unknown or other
  misc_feature (624)..(625): n is a, c, g, or t
  modified_base (628)..(630): a, c, t, g, unknown or other
  misc_feature (628)..(630): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtcgggtcccatccgtaggttcaggtcggcagtgcatcgtgggacagtacttacacttcctacacgtatcgagccacgtccctgaccaggtacctagtaaagtttacgtttcgaactttaaattttacttaaccgttcgtaacgtaaacgtaagtttaacttaacgttacccgtaccccgttaaggttacgggtaccggtttaccgggacccggtaaggggggtaaccctaaggggtacggtaaccgtaccggtaaaccgtacggtcgggtacggtcctacggacctacccgttagttcgtactttccgtaccttcgtacccgtttcccgactttaaccgtcgtaacgtaaccgtcctacgtttccggagttacgggacgggtccggtacgtacggaccggtaaccggtcgacgtaacggtnntacgctagcagctgcgtanncnncgncngcnnnnnnnnnnncgncnnnnnngnnacnnnc

SEQ ID NO: 217028 - DNA, 761 bp, Homo sapiens
  misc_feature: GYAE6OF02HYB25.1.34.D01.1.454.CMB.1.raw
  modified_base (270)..(270): a, c, t, g, unknown or other
  misc_feature (270)..(270): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgaccctagtcctccatccctcctgtctgcatctagttggagacagactcaccatactacgttggccgggacgagtcacggccatcagcgtatttcgttagccttggttcncgagacgaacggaaccgagggccgaccgcccctgagtacttacggtacgttctaggtggtacgcctaacgtcctaaggtagttcggaacggtaaggggttcccgggtaccctaggttacccgtagggttccgagggttcggaccgagtcgtacctaggttccggtagggaactaacggtaacttacccgaccttcctaacgtacttactccgaacgtcgaccggttcacggacccgtaacgttaccggtaaagttaacgtttacgtttaacggtaaattttaaacttttacgttacgtaaccgtaactaaaacgtttagtttaacctttaaccgtaaaccccgggttacccggttaggttaaccgggttaccgggttaccccggggtaaggttaaacccgggggtaacggttaacggggttaaccggaaaaccggtttaaccccgaaaacggggtttaccgtacgggttaccggtacttacccggaacccg

SEQ ID NO: 217029 - DNA, 806 bp, Homo sapiens
  misc_feature: GYAE6OF02FWMNT.1.34.D01.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccattccctccctgtctgctatctattcgganacagagtccaaccatcctacgttcggccgggngagtcgaggccatccgagtcgtatttcgtttagccgttggttcgacgacgaccgtaacggaaaacccgaggggccgaacggtcccccgttacgaaggtacttaccggttaacgttaccttaaggttcgggtacgacctaacgttacccgtaaggttacgtttaggaaccggtaacgggggtttaccggggtacccctaagtttcccggtaacgggtttacgacggttcggacctaagggtcgacgtaacgtcggtacggggaactaggtactttaaccgacttcctaccgtaacttacgtaccgaacggaccgtacggtacccgtacggtacgaccggtacccgttaagggtaacgtttacgtttttaaccggacgtttttaaaactttacgtttaccgtacgggttaacctaaacgttaacgttttaaacttaaaccggttaacccgtttaacccccggttaggttaccgggttacccggttaccgggtacccggaacggggtaaccgtaacgggtacggtaaaccggtaccgtaaccggtacgttggtacggtaccgtactaacccgg

SEQ ID NO: 217030 - DNA, 703 bp, Homo sapiens
  misc_feature: GYAE6OF02JQ61G.1.34.D01.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtctccatcctcctgtctgcatctattggagacagatcacntcattgccggngagtcacggccatcagcgtatttctttagccgttggttgcgtagaccagaaaccgagggccgacgcccctgagtatcgtagtctgtaggtcgactagtcgagtattacggacgtaaggggtcggtaccacgttcgacggttcgagtcggactaggtcgactacggtcgtacgggaactacggtactttaaccgacttccgtaacctaacgttacgtacgacgtaccgtacggtaccctggtaccgacgtacccgttaaggttaaacgttacgttttacggtaacgttttaaattttaccgttacgttacggttaaccgtaattaaggtttaactttaaccgttaacggttaccccgttagggtacgggtttaaccggttaccggggtaacccggtaacggggtaacccgttaaaggggttaccgggtaaacgtttacccggaaaccgggttaacgttacggggtacggttacgtaccggtaacccg

SEQ ID NO: 217031 - DNA, 732 bp, Homo sapiens
  misc_feature: GYAE6OF02GWEYK.1.34.D01.1.454.CMB.1.raw
  modified_base (187)..(187): a, c, t, g, unknown or other
  misc_feature (187)..(187): n is a, c, g, or t
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacatagcatggacatgagggtccccgctcagctcctgggctcctgctgctctggctcccaggtaccagctgtgacatccaattcgacccagtctccatcctccctgtctgcntctattgganacagacgtccaccactcacgttcggccgggcgagtcaggccaatcgagcgtaattcgtttagccgttggttcgcgagtcaaacggaaaccgtaggggaccgacgcccccgtagaacgacgttaccggtagttaccgtagttcgggtacgctacgtcccgtaaggtagttacggaccggtaacgggggttcgggtaccccaacgttaccggtaacggttacgtaagggtacggtacgtaacgggtcgacgtagttccggtacgggaacgtacggtaactttacccgactttaccgtacgtaacttacgtacgaacgtccgacggtacccgtgaccgtacgtaccgttagtaacgtttacgttttacgtactttaaagtttacttaccgttataaccgtaacgtaagtttaacgttactaaccggttaacccgtacggttaccgggttaccgttacgggaacccggtacgggtaaaccgtaaggggtacgtaaacgtcccggttaaacgaccgttggaccggtacgtaccgtaaccg

SEQ ID NO: 217032 - DNA, 727 bp, Homo sapiens
  misc_feature: GYAE6OF02IBTQO.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctctggggctcctgctgctcgtcggctcccaggtaccagctgtgactactaccaattcgacccagtcctccactccctcctgtctgctatctatgagacagagtcactatcacgttcggccgggagacgtcgacggccagttacgagcgtactttcgttacggtcgttggttcacgacgaccgaacgaaaaccggcggggaccaaccggcccccttagaacgtaacgttccgtaagttcctagttagggtcgtacacgtaccgtagtagtacggacgtaacggggtcggtaccctagtaccgtacggttacgacgggtacgcgtaaggtccgtactaacggtaccggtacggggtaaacctaacgttaacgttaaccctccgttaacctaccgtaaacttaccgttccggaacggtaccaacggttccgtctaacgacgtaccgtaagttagtactttcggaatttaaccgtttagaccttaacgactaaacggttacgttacttaaccggtaacccgttaccgttacgggtaccgtaccggtccggtaacggaaccgggttaacctagggtaaccggattaacccgaaacggttaggccggtacggccgacgtaacccg

SEQ ID NO: 217033 - DNA, 765 bp, Homo sapiens
  misc_feature: GYAE6OF02JXJD3.1.34.D01.1.454.CMB.1.raw
  modified_base (201)..(201): a, c, t, g, unknown or other
  misc_feature (201)..(201): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatccaattgacccaggtctccattccctcctgtctgcattctagttgganacagagtcaccatcacttcggccgggctagtcgacggccatcgaagcgtactttacttacgtcctggttcgacgacggtaccgaaacggaaaacccggaacgggggaccgaccggtacccccctacgaacggtaacgttaccggttaggttaacctttagtacgggtcgaacgtaacctaccgaaaggttagttcggaaccggtaaagggggttccgggtacccctaggtaaccgtacgggtttacgtagggtacggtacgtaacgggtctacgtaacggttccggtagggggtaacctaaggtaacttaaccgtaaccttcgttacctaaacttcgttacaccggaacgtaccgtaccgtacggtacacgtacccggttagaacgtttagtttcggtaaactttaagtttacgttaaccttacgtaacttaacgttaagtttacttaacgttaaccgttaccgttaacggttacggtaccggttaccgggccgtaacggggtacgtaagggtaacgtaacggaaccggtaaccgtaacggttggacgttacggaccgtaaccg

SEQ ID NO: 217034 - DNA, 619 bp, Homo sapiens
  misc_feature: GYAE6OF02JGOSR.1.34.D01.1.454.CMB.1.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgagacagagtcaccatcacttgccggganagtcaggccatcancgattcttagcctggttcgctagacgaagaaacccgagggaccgacgcccccgtacaagacgtacggtaacgtcgttaatcgggtacacgaattccgagtatttggacgtaaacggggtcggggtacccaacgtccacggtttcaggtggacagtanaccgagttcggagggtaacagtaactttaccgacttctaaccgactaatcgacgcgacncctgacgcgtaccgtagaattgtttacactttaattacttaacgtagtactaagtaatttactaagttaacccgtacccttaggtacggtaacgttcggaacccgacggggtaaccaagggttaggtaacgtaccgaaccgttaagtcgtacggtactacgtaaccc

SEQ ID NO: 217035 - DNA, 677 bp, Homo sapiens
  misc_feature: GYAE6OF02HKCWW.1.34.D01.1.454.CMB.1.raw
  modified_base (105)..(105): a, c, t, g, unknown or other
  misc_feature (105)..(105): n is a, c, g, or t
  modified_base (133)..(133): a, c, t, g, unknown or other
  misc_feature (133)..(133): n is a, c, g, or t
  modified_base (222)..(222): a, c, t, g, unknown or other
  misc_feature (222)..(222): n is a, c, g, or t
  modified_base (341)..(341): a, c, t, g, unknown or other
  misc_feature (341)..(341): n is a, c, g, or t
  modified_base (506)..(506): a, c, t, g, unknown or other
  misc_feature (506)..(506): n is a, c, g, or t
tcagacgagtgcgtcacgaccggtgctcgatttagatcgtctgtggttggggtttgggggagtcagaccctgtcaggacacagcatggacatgacgggtccccgntccagctcctggggctcctgctgctcgnggcctacccgaggtaccaggctggtgacactaccaaagttcgacccagtcctcccactccctccctgtctgcatcaattggagaccganagtacaccatacgtacttggacccggggacagtaccgacggacactacgagtacgtactttcttaaggtcctggttagaccacgacgaacgaaaccggacggtacccgaacgcccctanagaacttccgtaagtcaacgttcgagaccagtacagtaacttgggacgaacggtcggtccctaagtccgtaaggtccgtaaggttcggaacgttagtcgacttaacggtacgtacggggtactaacgggttaactaccgtacctacgtacaacgttacacggtanacctacgtctagagttacgacctgtaatatcgtaacttatttacgtactacgtactaagacgttaactacgtaccgtactacggtacggtaacgttccggaacgacgggaaaccggtaggttaacgggaaacttaccggaacgtacgttacggtaacgcgttaaccggaac

SEQ ID NO: 217036 - DNA, 767 bp, Homo sapiens
  misc_feature: GYAE6OF02HXCQS.1.34.D01.1.454.CMB.1.raw
  modified_base (319)..(319): a, c, t, g, unknown or other
  misc_feature (319)..(319): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatccaattcgaccctagtctccatccctccgtgtctgcattctagtggacacagacgtcaccactctacgttcggaccgggcgaagtccgacggtccagtcgagtcgttatttcgtttacgcgttcggtgcgtacgacaacggaaccgacgggaccgaccgcccctanacggtacgttcgtacgttaccttagtcggtcacctacgtccgtaagtactttacggaaccggtaaggggtcccgggtacccctaggtacccgtttagggttaccgagggttcgacggtacggtacgcgttaacgttcggagggtaactacggtaccttactacgtccttactacgtactcaacgtaccgtacgtacctcgaaccgttcgtaccgtaagtaacgtttattacgtaacttttaaatttaacgttaccgtaacgtaaccgttaaagtttaacgttaacgtttaacctaacccgtttaaccccggtacgggttacccggtttacgggtacccgggtaaaccggggttaaccgggtaaaccgggtaaggggttaacccgtaaccgggttaaaccccgtaacggttacggttaccgggtaacgttacccggaccgttaaacccg

SEQ ID NO: 217037 - DNA, 941 bp, Homo sapiens
  misc_feature: GYAE6OF02GE8AG.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccgaattcgacccagtcctccattccctcccgtgtctgactatctagttggaagtacgaggtacgtaccaacctataccgtacgttcgggacccggggtacgtacggttaccgacgggccctaacgttccgaacggtaccgttaacttttccgtttaaggtccccgtttgggttacgaccgtaacggtaccgaaacggaaaaccccgggtacggggaaccgtacccggtaccccccgttacgaacggtaacgtttaccgggttaacgttaccttaagggtcgggttacgacctaaccgtacccgtaaggttacgtttcgggaaccggtaaacgggggttccccgggtaacccctaaccgttacccggtagggttaccgtacgggttcggtaccgtaggtcgtaccgtaacggttacggtaacgggaacctaaggttacccttaacccgtcgtttacccgtaactaaccgttaactacggtaccgtacggtacccggccgttaggaaccccgtacggtaccgttaaacgggttagtttaaccgtttttacggtaaaacctttttaacgttttaaccgttcggtttaaaccgtaaaaccgttaacgggtttaaaacgtttaacgtttaaacccggtttacccgttaaccccgttacgggggtttacccggtacccgggtttaacccgggggaaccgggttaaccgggtaaacggttaaaccggggtaccggttaaaccggtaacccgtaaccgggttaaggttcggttaaccgggtaccgtccgtaacccg

SEQ ID NO: 217038 - DNA, 700 bp, Homo sapiens
  misc_feature: GYAE6OF02F9Q2R.1.34.D01.1.454.CMB.1.raw
  modified_base (291)..(291): a, c, t, g, unknown or other
  misc_feature (291)..(291): n is a, c, g, or t
  modified_base (693)..(693): a, c, t, g, unknown or other
  misc_feature (693)..(693): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatcctaattcgacccagtcctaccatcctcccgtgtctgcatctattggagacaggactcaaccatcacgttcggccgggacgagtcgaggcccaatccaggctattcttagccgttggttcgcacgacaacgaaccggngggaccgaccgccccagacgtacgtcggtacgttctaaggtggcacgtactccgtagtacgttacggaccggtaaggggtccggtacctaacgttccgtaaggttaccggaggtacggacgtacggtcgtactacgttcgggacgggtaactaacggttaacttaacgtccgttaccttactaaccgtaactcgaacgtaccgtaccggtcctaggaccgtacgtacccgttaaggtaaacgtttcgttttacgttaacttaaacgtttatttacgtacgttaactaagttaagttaacttaaccgttaccgtaccgttacgggtacgtaccggtacggtacccgggtaaggtacccggtaagggttacgaacctacggtaacggtacggtaggtcggtacncgtaacc

SEQ ID NO: 217039 - DNA, 740 bp, Homo sapiens
  misc_feature: GYAE6OF02HTTU9.1.34.D01.1.454.CMB.1.raw
  modified_base (175)..(175): a, c, t, g, unknown or other
  misc_feature (175)..(175): n is a, c, g, or t
  modified_base (280)..(280): a, c, t, g, unknown or other
  misc_feature (280)..(280): n is a, c, g, or t
  modified_base (435)..(435): a, c, t, g, unknown or other
  misc_feature (435)..(435): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctcgtggcctcccaggtaccagctgtgacatccaattcgaccctagtccnccatccctcctgtctgcattctagttggacgactagactccactatcacgttcggcgggtcaagtcaacggccagtcagcgttattctttacggccgttaggttnacaggtacgaaacgaaaccggagggccgtaccggtacccctacgaagacgtaccgttaagtccgtttagcggttccgctaactacctaagggtactttcggacgttaagggggtccggtacccctagtcgtacggttcgaggtcggtactacggngtcaacggttcgtaagggaactaggtaacttaccgactttctacgtacttacgtacgactccgacgttacgcgaccgtaacgtccgtagggttaaatttcggtttacctaaactttaaagttttaccgttacgttaccgttaaacgaacctttaggttaaacctttaacggtaaaccccggttaacccgttagggttacccgggtacggttttaacccggacccgggttaaaggggaaccgtaacgggtttaacggaaccgtaaccggtaaccgttacgggtaccggagttcccgtaaggtaacc

SEQ ID NO: 217040 - DNA, 753 bp, Homo sapiens
  misc_feature: GYAE6OF02JUOGY.1.34.D01.1.454.CMB.1.raw
  modified_base (343)..(343): a, c, t, g, unknown or other
  misc_feature (343)..(343): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacactaccgaattcgaccctacgtcctccactccctccgtgtctcgcatctagttggagacagcgtacacctatcacgttcggcgggacgagtcgacggcatcagcgtacttcgttagccgtaggttgactagcgaacgaaccggagggtccaaccgccccgtacagtacgtcgtacggttactaggtacggtnactacgtaccgagtaccgttacggaccggtaacggtaccggggtaccctaaccgtacgtaccgggttacgacggttcggtaccgtcggtaaccgtcctaacgttccgggtaacggtaacgggtacctaacggttacctaactttacccggaacctaacgtacgtaccgtaagacccgtaaccggtccgttacggaccgttacccgaccggttaaagtaaccgttaagtttacaaacgttttaaagtttaccgttacgtaaccggttaataaccgtttaagttaaccgttaaaccgttacccgttaacccgttgggttaccgggttacggtacccggaaaccggttacgggaacccggttaaggccgttaagaacgtacccgtaaggtcccgtaggttccctaggaccccg

SEQ ID NO: 217041 - DNA, 671 bp, Homo sapiens
  misc_feature: GYAE6OF02IKW0M.1.34.D01.1.454.CMB.1.raw
  modified_base (197)..(197): a, c, t, g, unknown or other
  misc_feature (197)..(197): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatgganacagatcaccatcacttggccgggcgagtcaggccatcagcgtatttctttagccttggttcncagcaagaaaccgngggccacgcccctgagatcgtagtctagtggtgcactccagtattcgacgtaacggggtcgggtaccccaagttcccgtacgggttccaagggttcgggaccgtaaggttcggaccgttaacgtccgggtacggggaactaaggtaactttacccgtaaccgttccttacgtaaccttagttaccgaacgtaccgaacccgtccgttcgaccgtacgtacccttaaggaacgtttatttcgtaactttaaattttaccttacgttacgtactaacgttagttaactttactaacccgttacccgtacggtacgttaccggttaccggccggaaggggtaccctaaagggtacggtaaccgtacgtaaccgttaggtcggtacggccgtacgtacccg

SEQ ID NO: 217042 - DNA, 876 bp, Homo sapiens
  misc_feature: GYAE6OF02J1K7E.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctgtcggcctcccgaggtaccagtctggtacactactacctaagttcgaccccagttcctacccacttcccctccctggttcctcgactactacgttaagttcggaagaacctagggtactcccaaacctctaaccgtaccggttccgggcccggggtacgacggttaccggaccggacccttaagccggtacgtacgttaactttccgtttacggccggttcggttcgacgaacggtacgaaaacccgggaaaccgggtacgggcccggacccgtaccccgtagtaacggttaccgtacggttaccgttacggttacggtacgggtacacgtaaccgtaccggtacgttaaggtcggtaccgggttaacggggtaccgggttaccctacgtaaccgggtccggttagacgggtcggtaacgtcgggtacgccgtaacgtcgggtacggaacgtagttacctacgtactactaacgtctaacgtcgaacgtacctccggacgtgtacccggtacgacttaagtaacgtttacgtttaccgttaacgtttaaacgtttaactacggttaaccttaaggttaacctttaagttaaccggttaccttaaacccgggttaccgttacgggtccgggttaacggttacccgggtaaaccgggtacggggtaaacccgtaaagggggttccgttaaaaaggtacccccgggttaaaaggtccggttaacccggtgggttaccggacccttaacccgg

SEQ ID NO: 217043 - DNA, 683 bp, Homo sapiens
  misc_feature: GYAE6OF02JQQSK.1.34.D01.1.454.CMB.1.raw
  modified_base (126)..(126): a, c, t, g, unknown or other
  misc_feature (126)..(126): n is a, c, g, or t
  modified_base (194)..(194): a, c, t, g, unknown or other
  misc_feature (194)..(194): n is a, c, g, or t
  modified_base (337)..(337): a, c, t, g, unknown or other
  misc_feature (337)..(337): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctntggctccaggtaccagctgtgacatccaatgacccagtctccatcctcctgtctgctatctagtgganacagatcactatcacgtcggccgggcgtacgtcacggccaatcgacgcgtattccgttagccgtggttcgctaggacgtaacggaaacccgtaggggccgaccgcccctagaacggttactcggttaagtcctaggtcgggtnacctacgtccgtagtagttcggaacgtaaggggtccggtaccctaagtccgtaaggttcgaggtcggtaccgtaggtcgacgtaacgttcgagggtaacctagtacttaccgtaactcgtactactagtccgagttccacgtcgacgactaccggtacgtagttaacgtttattacggaaacgttttaattcgttaaccgttcgttaaataaccgttgtttaaacgttaacgttaacccgttacccgggtaagttcgggtacccgttacgggtaaccggaaggtacgtacggttaacggaaccgtaacggtaccgtaacggtcggtaacggtccgtaccgtaaccg

SEQ ID NO: 217044 - DNA, 867 bp, Homo sapiens
  misc_feature: GYAE6OF02HKKJV.1.34.D01.1.454.CMB.1.raw
  modified_base (143)..(143): a, c, t, g, unknown or other
  misc_feature (143)..(143): n is a, c, g, or t
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccngctgtgacatccaattcgacccagtctccatccctccctgtctncatctagtgganacagagtcaccattccgtacttcgggccgggacgtagtccgaggtccatcgagtacgtactttcgttacggtccgttgggttcgacaggtaccgaagaaaacccggaacggggcccgtaacggtccccctagtaacggtaccgtacgggttacgtacttaaggtcgggtactaccgtagtacccgtaagttaacggttcggaaccggtaaagggggttcccgggtaaccctaacgttaccggaacggtttcgtaagggcggtacgtacggtacgtaccgtacggttaccgggtacgggtaacctaagggtttaaaccttaacccgttaccgtttaacccttaactaaacggttaaccttaccgaaccgacgtaaccggtcccttacgggaactaccgggtacccgtaaggttaacgtttaacttttccggaaacttttaaacgttttacgtttaactaccgtttaaaaccgtaaggttaacgtttaaaccgtttaacggttaacccccggtttaaccccgttacggttacgggggtttaaacccggttccgggtaaaccccgggtttaaacggggaaaccgtttaaaccggggggaaggtttaaaccccgttaaccgggtaaaccggtaaccggtttacgggtacggttaacccgtccggtaaacccg

SEQ ID NO: 217045 - DNA, 842 bp, Homo sapiens
  misc_feature: GYAE6OF02F69N6.1.34.D01.1.454.CMB.1.raw
tcagacgagtgcgtcacgaccggtgctcgatttagatcgtctgtgttgggtttgggcatggacatgagggtccccgctcagctcctgggctcctgctgctctggctcccaggtaccagctgtgacactcctaattgacccagtctcctaatcccgtccctgtctagctactcttagttggaagaccagacgtccaaccatctaacgttggcccgggacgacgtacacggccaatccgaggtccggtatttcctttaggcccttagggttcgaccaggacgaaccggaaaacgacggggtaccgaccgtaccccgtaccgtacggactacggttacgttacgtaagtcgggttgaccgtacgttacccgagacgtttacggacggtaaagggttcgggtaccccgtaacgtcccggttaagggttccgtacggtttcgggacctaggtccgtacgaccgtgtacggggaactaggaaactttacgacttccgtaacacgtttacgaccgtaggtaaccgtaccgtacccgtacggccgtaaccggtaccgtacgtaaaaccgtttagtttaccgaaactttaaagtttttaacctttaagtccggtttaacaaccgttttaacgggtactttttaagtaccccgttaacccgttacgggtttaccgtaaaccgggtttcccggaaccggttaccgggggtaacccgtaaaggttaaaccgggttacgtaacccggtaaccgtaccgggttaacggttccggaaccggttccggaacccgttaacgtaacgtttccgaccgtttttccgtaaccgttcctttacccggttaccccgtaaccccg

SEQ ID NO: 217046 - DNA, 702 bp, Homo sapiens
  misc_feature: GYAE6OF02GAZON.1.34.D01.1.454.CMB.1.raw
  modified_base (543)..(543): a, c, t, g, unknown or other
  misc_feature (543)..(543): n is a, c, g, or t
  modified_base (555)..(555): a, c, t, g, unknown or other
  misc_feature (555)..(555): n is a, c, g, or t
  modified_base (572)..(572): a, c, t, g, unknown or other
  misc_feature (572)..(572): n is a, c, g, or t
  modified_base (576)..(576): a, c, t, g, unknown or other
  misc_feature (576)..(576): n is a, c, g, or t
  modified_base (589)..(589): a, c, t, g, unknown or other
  misc_feature (589)..(589): n is a, c, g, or t
tcagacgagtgcgtcacgaccggtgctcgatttagatcgtctgtggttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacacgtctacactatcagcagcctgcagtcctagaagtattttgactaattttacttaactggtacaaacgtaggttaactttaacgtacgttaacccccgttaggttacggtaaccgtttacgggacccgtaaggggggtaaacccctaaaggggtacgggtaaaaccggtcccgtaaaacccgggtaaacgttgggtacggtacgtacgaccgtaaccgtaattccgttcgttcctttacgaacttcccgtttaccccggactacttaccgtaggtaaaccgctaacgttcgtacgtaggacgggacgggtactagggaccgtaaaggggccgtaacgtaaagttacgngacgtacgtacngtacgatatcgcgtacncgtntacggacgtaacngacgtacgtacacgtacacggttacacgtacggaccgttacgaccggtacgtaccgtagtaccgtaccgttaccgtaccgttacgtaccgtaacggtacggtacgtacgtacg

SEQ ID NO: 217047 - DNA, 803 bp, Homo sapiens
  misc_feature: GYAE6OF02I182R.1.34.D01.1.454.CMB.1.raw
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacactccaattcgacccagtctccatccctccctgtctgacattctattggacgacaggactcaccagtctactggccgggcgagtcaacggccatcgacgcgtattccttagccgtggttgccagcaacgaaaccgngggcacgccctcaanactcgtagtctagnggtcgacacgtaccagtagttcggacgtaaggggttcgggtaccctaacgtcccggttagggtttaccgaagggttcgggtaccaagggttccgtacgtaacttccggggtaagtaaccgtaaggtaactttacctaaccggtttcctaaaccgtaacttacttaaacccggaacgttaccgaaccgggtacccttacgggaaaccgtacggttaacccctaagggggttaaattttaacggtttttacccggaaaagttttaacttttttaaaccgtaaccgtttaacggttaaaccgttaaaacgttaacgggtttaaaaacgttttttacggtaaaccccggtttaaccccggtttacggggtaccggttttaaccgggttcccgggtaaccggggttaaaccgggaacggttaaacggggtaaacgggttaacgtaacccggtaaccggaaccggttagggtaccggtaccgttacgaacccg

SEQ ID NO: 217048 - DNA, 804 bp, Homo sapiens
  misc_feature: GYAE6OF02G54DY.1.34.D01.1.454.CMB.1.raw
tcagacgagtgcgtcacgaccggtgctcgatttagatcgtctgtgttggggtttgggggagtcagaccctgtcaggacacagcatggacatggacgggtccccgctcagcctccgtggggcctcctgctgctctcggcctcccaggtaccagcctggtgaactatacctaattacgaccctagtcctccactccctcctcgtctgactatcgtagttcggagaccaggtactccaacctacgtcctacgtcgggaccgggtacgaacgtacgacggtaccctagtacgtacggtaccgttagtttaccgtttaacggtcccgttggggtttacaccggtaacggaacgtaaaccggaaaaccgggtacggggacccgtaaccccggtccccgtagtaaccggtaacgttacgggttaaccttacgtaacgtcgggtaccacgtacgtacggtaacgtagttcggacggtaacgggggtcccggtacctacggttcggtacggttacgacggtacgaccgtagaccgtacacggttacggaacggtacgtaacgttaaccgtaacctccttacgtaccttaacgtacgtacgaaccggcttaaccgccgttcgaaccgtcgtaaccgttaagttacttctttacggtacttaacgttaacgttcctaagaactaactttactaacgtttaccgtaaccgtccggtaaccgttgggacccgttacgggaccggtaaaggtaccgggtaaagggtacgtaaccgttaaccggaccgtttaagggtacctggacccggttcgtaaccg

SEQ ID NO: 217049 - DNA, 820 bp, Homo sapiens
  misc_feature: GYAE6OF02JSR2H.1.34.D01.1.454.CMB.1.raw
  modified_base (143)..(143): a, c, t, g, unknown or other
  misc_feature (143)..(143): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccngctgtgacatccaattgacccagtcctccatccctccctgtctcgcattcctagttggaagacagacgtccaaccatcacgttcggccggggcagtccaggccagttcaaggtccgtaatttctttacggtcgttcggttcggacctagaccgaaacggaaaacccgaggggacccggtaaccgccccccgttacgaacggtacgttaccgttacggttaccgttaggttcgggcgtaacctacgtacccgtaagtagttacggaacgggtaacggggttcccgggtaccctacggttcctaacgggtttacgtaacggtcgggtaccgagttaccgacgttaacgttacggtaggggaaccttaacgtaacgtttaccaaccgtttctaacccgtaactttacgaccggaccgaccttacgggtacccttccggtacgaccggttacgttaaacggttaacgtttactttttaccggtaactttaaacggttttttaaacccttacgtacgttaaccgtaaaccgttaaagttttaaccttaaaccgttaacccgttaaccccggtaggttaccgggtttaccggtaccggtaacccggtaaggggtaacccgtaagggtacgttaaaccgaacccggttaacggcgttacggggtaacttcccggataaccccgg

SEQ ID NO: 217050 - DNA, 676 bp, Homo sapiens
  misc_feature: GYAE6OF02G4F21.1.34.D01.1.454.CMB.1.raw
  modified_base (263)..(263): a, c, t, g, unknown or other
  misc_feature (263)..(263): n is a, c, g, or t
  modified_base (317)..(317): a, c, t, g, unknown or other
  misc_feature (317)..(317): n is a, c, g, or t
  modified_base (455)..(455): a, c, t, g, unknown or other
  misc_feature (455)..(455): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttcggcccgggcgagtccaggccatcgagcgtattcttagccttggttncagacaacggaaaccgagggccacgcccctagagtactcggtagtctagtggtnccactccagtattcggacgtaacggggttccgggtcccagttcccgtagggtttaccgtagggtcggtacagggtcgaccgtacgttcggtacggggaactaacgttaacttaaccgacctttacctactaaccttanaccacggaccacgtccgtgaccgtacgtaccgttaagtaaacgtttcttttaggacttttaaagttttacttaccgtagttaacctaaacgtttagttaacttaccgttaaacccggttaccccgttagggttcgggttaccgttccgggaacggtaacggggtaaccgtaagggtacggtaaaccgtaccgaaacggtagtccggtagtcgacgtacccg

SEQ ID NO: 217051 - DNA, 840 bp, Homo sapiens
  misc_feature: GYAE6OF02H3RT5.1.34.D01.1.454.CMB.1.raw
  modified_base (467)..(467): a, c, t, g, unknown or other
  misc_feature (467)..(467): n is a, c, g, or t
tcagacgagtgcgtcacgaccggtgctcgatttagatcgtctgtgttgggtttggggagtcagaccctgtcaggacacagcatggacatgacgggtccccgctcagctccgtggggctcctgctgctctggctcccaggtaccagtctgtgacataccaattcgaacccagtctccactccctcctgtctagctatacttagttggacgacaggaactccaccattaccgacttgggcccgggtagtacgtcgaacggcctacgtcgagtaccgtaagttttcctttacggccgttgggttacgacggacgacgaaacgaaacccggtaagggcctaccggacccccctagaacgtaacgtcggtaacgttccgttaagtcgggtacgtcctaaccgtaccgtagtaacgttcggaacgtaacggggtccggtacctaccggtacgttacggttcgtagtacgggtntaaacgtcgtactaacgttacgtaggggtaacctacggtaactttaacccaacccgtttcttaaaccgtactttaacgtaccgaacgtccgtaaccgggtaccttaaaccgggccctaaacgggttaccttacgggtaaagtttccgttttaacgaacctttttaaagtttacccgaacgtttaccggttaaacgaaacgtttaacgtttaaactttaaacccgttaaccggtttaaccccgtttaggggtaccgtttaccccggggttacgggtaaccccgggaacgggttaaaccgggtacggggttaaacgtaccggttaaacccggacgttaaacccgggtcggggtaacgttccgtaaccgtaacccc

SEQ ID NO: 217052 - DNA, 621 bp, Homo sapiens
  misc_feature: GYAE6OF02HDF3I.1.34.D01.1.454.CMB.1.raw
  modified_base (566)..(566): a, c, t, g, unknown or other
  misc_feature (566)..(566): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctggcagcctagaacgtattttgactaattttattactgtacaacgtagtattatacgtacccctagtcggtaacgttcgggaccaagggggaccaaggtcggaaagttccaaaccgtaacgtgtggctacggacaccgtatcgtcgttaccttacagtttcccttcccggacctatttaccgttacgggaaaccctacgtaacccttccggtacgttacgggaacgggtccccgggggtaacttacgggggaccgtaaaacccggggggccaacgttaaaccggttagggacagtacgacgacagtacgtacgtcgactacgtcacgagacgacgtcgagacgacgagcgacngtagacgtacgacgtacgtgagacagtacacgtctacgacacgactacgtacgtc

SEQ ID NO: 217053 - DNA, 693 bp, Homo sapiens
  misc_feature: GYAE6OF02HM3I9.1.34.D01.1.454.CMB.1.raw
  modified_base (568)..(568): a, c, t, g, unknown or other
  misc_feature (568)..(568): n is a, c, g, or t
  modified_base (593)..(593): a, c, t, g, unknown or other
  misc_feature (593)..(593): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatgggtgcatccagattgcaaggtgggtcccatccaggttcagtggcagtgcatctgggacagattacactctcactatcagcagcctgcacgcctgaagtatttgctaattttattactgtacaacgtagttaattactacgtaaccccttaggtcgggtacgtttccgggccgaacgggggtaccaaagggttacggaaacgttaccgaaacccggtaacgttgggtacggtacctggacccaacgtacttccgttggtacctttacgtaacctttccgttttaccccccggacttaacgtttacccgtaacggtaaaaccgtcccgtaaccctttccgggttcctaacgggtaccggggtaccccgggggttcttaccgggggaaacccctaaaacggggggtcccgtaacccggttaagggttaaacggcttaacggnaagttaccgcgcgtgtacgtagccncgtagatcgtacgtacgtacgcgtacgtacgacgacgcgtacgtcgtagacgtacgtacgcacgtacgtacgtagtacgtacgtctactactcgtcgtcg

SEQ ID NO: 217054 - DNA, 750 bp, Homo sapiens
  misc_feature: GYAE6OF02FN3WP.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaagttcgacccagtcctaccactcctccctgtctgctatctagttcggagacagacgtcaaccatcacgttcggccgggacgacgtcaggaccatccgagtcgtattcgttaacgccttgggttcgacacgacgaaacggaaaccggacgggaccgaccggtccccgtacggagtacgttcggttacgtaccgttaaggtcggttacgacctaagttacccgtaaggtactttacggaaccgtaaaggggggtccgggtacccctaccggttaccgtaaggtttaccgagggtacggcgtaaggtcgaccgtagtacggtagggaacctagtaaccttacaccgttacaccttaaactagtacgaacgtccgaccgtctacggcgtaacgtcgtaaaggtaacttatttacggaacttttaacttttacggttacgtacgttaaaccgtaacgttaacttaacgttaaccttaaccggttaaccccgtacgggttaccggttaccgggtacccggggtaacggaccgggtaaaaccgttacggggaacgtaaccgtacccgaacgggtaacgtccggacgtaccgtagtaacccg

SEQ ID NO: 217055 - DNA, 648 bp, Homo sapiens
  misc_feature: GYAE6OF02HO2UM.1.34.D01.1.454.CMB.1.raw
  modified_base (144)..(144): a, c, t, g, unknown or other
  misc_feature (144)..(144): n is a, c, g, or t
  modified_base (150)..(150): a, c, t, g, unknown or other
  misc_feature (150)..(150): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctcggctcccgaggtaccngctgtnacatccaattcgaccagtctccatcctcctgtctgcatctagtggagacagactcacatcctacttggccggcagtcaggccatcaagcgtattctttagccttggttgcagacaacggaaaccgtaggggccgacncccctagacgtaactcggtaggttctagtcggtgacacgtaccagtattcggacgtaaagggtccgggtcccaacgttccacggtttacgaggttcggacgtagtgtcgtattcggtaacgggactaagtaactttaccacttcgttacacgtactacacggtctacgccgttagccgtaaggtcctaaacggttattagttttacgaactttaagtttaacttcgtattaaaccgaacttacgtttaaactacgtaaccgtttaacccgttaggtaccgtttacggtaccgggacggtaaccgggaacttaagggtacgtaaacgaccgtaaccgtagttcggagggttacctagtaccg

SEQ ID NO: 217056 - DNA, 828 bp, Homo sapiens
  misc_feature: GYAE6OF02IPLMY.1.34.D01.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccactccctcctgtctgctatctagttgganacagatcacctatcacgttcggccggganaggtccacggaccagtccgacgtcgttacttttaccttacggcccgtttgggttccacgaacggaccgaaaacgggtaaacccggtaccggggaccgtaacccggtaccccctagaacggtacttaccgggttaagtaccttaacggttcgggtacgtaccgtaaccgttaccgaaggttacgtttacggaccgggttaaacgggggttccgggtacccctaacggttacccggttacgggtttaccaagggttcggtacgtacggttcggtaccttaggtttccggacgggtaaccagtttaaccttaccgtaccgtttcctaaccgtacgttactacgaagtacctacggttccagaccgtacggtaccttaaggttaaccgttttaagtttaccgtaacttttaaacgtttactttaccgtaacgttaacctaaacggtttattaaacgttttaaccaaccccggtttacccgttagggttaccgggtttaacccggtccgggtaaacgggtaacggggttaacccgtaaaggggtccggtaaaccgttaacccgaacccggttaaggttcccgggaaggtcccttacccggacc

SEQ ID NO: 217057 - DNA, 511 bp, Homo sapiens
  misc_feature: GYAE6OF02FIZXS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtccaccatcacttgccgggcgagtcaggccatcagcgattctttagcctggttgcagcagaaaccagggcgagcccctcagatcgtagtctatggtgcatccagattgcaaggtcgggtcccatccaggttcagtggcagtgcatcgtgggacagtattacactctcactatcagcacgcctgcagcctgaagtattttgactaatttactactgtactaacagttatatacgtaccctagtcggacgtcggcgacgggaacctaaggtcgaagtaccgaaccgtaacgtggtacggtcgtagtaccg

SEQ ID NO: 217058 - DNA, 387 bp, Homo sapiens
  misc_feature: GYAE6OF02GF0HX.1.34.D01.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (344)..(344): a, c, t, g, unknown or other
  misc_feature (344)..(344): n is a, c, g, or t
  modified_base (377)..(387): a, c, t, g, unknown or other
  misc_feature (377)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagtattacactctcactatcagcagcctgcacgtcctgaagtnttttgctaattttntactntacaanagtattatacgtaccctagtgaccgttcgcgagggaccaggtgancaacgatgngctgcacntctgtcttcatcctcccgctatcagacncactcgtcagacgcggctgaccaggcacagcgnnnnnnnnnnn

SEQ ID NO: 217059 - DNA, 605 bp, Homo sapiens
  misc_feature: GYAE6OF02FXZY7.1.34.D01.1.454.CMB.1.raw
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (363)..(363): a, c, t, g, unknown or other
  misc_feature (363)..(363): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccttggtgcagcagaaaccgngggcgacgcccctanagatcgtagtctagtggtgcagtccagtattggcgtaagggtcgggtacccagtccagggttcaaggtggctagtgcatcgtgggacagtacttacgacttcnctaactatcagcagcctgcagcctagaagtatttacgacttaaatttagttactgttaacaacgtattaacttactaaccggttaaccccttagggttacgggtaccgtttccgggaccgtaacgggggtaaccaaagggttacgggtaaacgtaccgaaccggtaacgtcggtacggcctacggtacctaaccgtagttccgttacgttacctttacgtaccttcccgttaccccgtcccc

SEQ ID NO: 217060 - DNA, 656 bp, Homo sapiens
  misc_feature: GYAE6OF02ISKUA.1.34.D01.1.454.CMB.1.raw
  modified_base (101)..(101): a, c, t, g, unknown or other
  misc_feature (101)..(101): n is a, c, g, or t
  modified_base (195)..(195): a, c, t, g, unknown or other
  misc_feature (195)..(195): n is a, c, g, or t
tcagacgagtgcgtcacgaccggtgctcgatttagatcgtctgtgttgggtttggggagtcagaccctgtcaggacacagcatggacatgagggtccccgntcagctcctgggctcctgctgctctgctccaggtaccagctgtgacatccgaattcgaccctagtctccatccctcctgtctgcatctatgganacagagtcaccattccacttcggccggcgagtccaggccatccagcctagttcttagccttggttcacgtagtacaacggtaaaccgagggtcgaaccgcccctacgacgtacgtacgtaggtactacgtggtcactacgtccgagtacgttggacgtagggtcggtaccctacgttacgtacgggttcaagtcggctaacgtgactacgtagtcgggaactagtaacttacgacttactcctacgttaactacagaccgtaccgtcctagtacgacgtccgttaagtacgttacgtttcgaacgttaacttttaagtaccttacgtacaaacttgttaactttaaccgtaccgttaacccggttaccggtcgtaaccgggtttccggaccggttaacgggtacgtaagggtaccggtacgtaaccgtaacggtaccgtacggtacggtccgtagtacccg

SEQ ID NO: 217061 - DNA, 543 bp, Homo sapiens
  misc_feature: GYAE6OF02IHGT8.1.34.D01.1.454.CMB.1.raw
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
  modified_base (411)..(411): a, c, t, g, unknown or other
  misc_feature (411)..(411): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (509)..(543): a, c, t, g, unknown or other
  misc_feature (509)..(543): n is a, c, g, or t
tcagacgagtgcgtcacgaccggtgctcgatttagatcgtctgtggttgggtttgggagtcaggccatcagcgattctttagcctggttgccagcagaaaccagggcgagcccctcagatcgtagtctatggtgcatccagattgacaagggtggggtcccatccaggttcaggtggcagtgcatcgtgggacagtattacactctcactncagcacgcctgcacgcctagaaagtntttgtactaattttacttactgtaacaacgtattaattactacgtaccccgtagttacggtacgttcggaccgacggggtaaccaagggtacggaacgtaccgaaaccggaacgttcggtacggtcgtgaccgtaaccacgttcttcgttcgttcctaccgttccgtttacccncccgttcttaccccgtaccgaccttccgtaactttccgtacggtcgacgggccgggtacgtacgggacgaacgggccgtaacgtacgtgngancgtannnnnnnnnnnnnnnnnnnnnnnnnnnnnnnnnnn

SEQ ID NO: 217062 - DNA, 481 bp, Homo sapiens
  misc_feature: GYAE6OF02F3FRO.1.34.D01.1.454.CMB.1.raw
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (425)..(426): a, c, t, g, unknown or other
  misc_feature (425)..(426): n is a, c, g, or t
  modified_base (428)..(429): a, c, t, g, unknown or other
  misc_feature (428)..(429): n is a, c, g, or t
  modified_base (432)..(433): a, c, t, g, unknown or other
  misc_feature (432)..(433): n is a, c, g, or t
  modified_base (437)..(440): a, c, t, g, unknown or other
  misc_feature (437)..(440): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (456)..(458): a, c, t, g, unknown or other
  misc_feature (456)..(458): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (476)..(477): a, c, t, g, unknown or other
  misc_feature (476)..(477): n is a, c, g, or t
  modified_base (479)..(479): a, c, t, g, unknown or other
  misc_feature (479)..(479): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcacgcctgcagcctagaagattttgactaattttatactgtacaactagtattatacgtacccctagtggacgttcggccgaggggaccaaggtggaagtcaaccgactagtggctncacatctgtctnatccttcccncatctagacactactctactgacgacgggctagggaccgtaaaggccgactaacgttagacgtcancgnanananannanncannacannnnanananaganananannncncnananacacncacannanag

SEQ ID NO: 217063 - DNA, 678 bp, Homo sapiens
  misc_feature: GYAE6OF02GR8SW.1.34.D01.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (269)..(269): a, c, t, g, unknown or other
  misc_feature (269)..(269): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagacgtcaccatcacttggccgggnagtcaggccatcagcgattcttagcctggttgcagcaagaaccgngggcacgcccctcagatcgtagttctagtggtgactactccgagacttggacggtaacgggtcggggtcccaacgtccgtaacgggtttacacggttcggcgtacggttgctaacgtcggtagggtaccgtagtaacttaaccgtacctcctaccaacttacgtccaacgaccgtaacgtcccgtacggaccacggtacctaaggtaactttacggttttacgtaaactttaaagttttaacgttaccgttagttaaccgtaaaccgttaagttaacttaacggttaaccgttaaccccgtttacggtaccgggtaaccggttccgggaaccggaacggggtacccggtaaggtaccgggtaaagtaccgaaacccggttaccgtagggtacggtaccgtagtaccccg

SEQ ID NO: 217064 - DNA, 523 bp, Homo sapiens
  misc_feature: GYAE6OF02GNERL.1.34.D01.1.454.CMB.1.raw
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (475)..(475): a, c, t, g, unknown or other
  misc_feature (475)..(475): n is a, c, g, or t
  modified_base (477)..(482): a, c, t, g, unknown or other
  misc_feature (477)..(482): n is a, c, g, or t
  modified_base (484)..(484): a, c, t, g, unknown or other
  misc_feature (484)..(484): n is a, c, g, or t
  modified_base (486)..(489): a, c, t, g, unknown or other
  misc_feature (486)..(489): n is a, c, g, or t
  modified_base (491)..(493): a, c, t, g, unknown or other
  misc_feature (491)..(493): n is a, c, g, or t
  modified_base (495)..(496): a, c, t, g, unknown or other
  misc_feature (495)..(496): n is a, c, g, or t
  modified_base (498)..(501): a, c, t, g, unknown or other
  misc_feature (498)..(501): n is a, c, g, or t
  modified_base (503)..(503): a, c, t, g, unknown or other
  misc_feature (503)..(503): n is a, c, g, or t
  modified_base (505)..(511): a, c, t, g, unknown or other
  misc_feature (505)..(511): n is a, c, g, or t
  modified_base (513)..(519): a, c, t, g, unknown or other
  misc_feature (513)..(519): n is a, c, g, or t
  modified_base (521)..(523): a, c, t, g, unknown or other
  misc_feature (521)..(523): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtcggggtcccatcaaggttcagcggcagtggatctgggacagtatttcactctacaccatcagcagcctgcacgcctagaagttattttgacttaagttactattcgtacaaacgacggaccaacgtacgtttccccgacgtaaacggttccggaccgaagggaaccaagggtacggaaaaccaaacgaacgtggtaggctagacacctatcgtgttcttacacttcccgttcccgacattcgtacgaaccgctaccgtccgtactgggaccggccgggtactacggggacgaacgggtccagtaactacggnagtangtacacggntnnnnnnanannnnannnannannnnanannnnnnncnnnnnnncnnn

SEQ ID NO: 217065 - DNA, 785 bp, Homo sapiens
  misc_feature: GYAE6OF02IDW7P.1.34.D01.1.454.CMB.1.raw
  modified_base (103)..(103): a, c, t, g, unknown or other
  misc_feature (103)..(103): n is a, c, g, or t
  modified_base (129)..(129): a, c, t, g, unknown or other
  misc_feature (129)..(129): n is a, c, g, or t
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
tcagacgagtgcgtcacgaccggtgctcgatttagatcgtctgtgttgggtttgggggagtcagaccctgtcaggacacagcatggacatgacgggtccccgntcagctccgtgggcctcctgctgctntcggctacccaggtaccagctgtgacatccaattcgacccagtctccactccctccctgtctacgctacttctagttgganacagacncaccatccacgtttggcccgggagtaacgtccgacggccactcgacgcgttatttaccgtttacgccgtttggttacgacgacgcaacgtaaaaccgnggggaccgaccgccccttagacgtacgttccggtacgttactagttggtgacctactaccgaggttacttcggacgggtaaccggggttcggggtacccctaagtttacccgggtacgggtttccgtaaaggtcgggaccgttaagggtcgtaccgtaacgttcggtaacggggaaccttacggtaactttaccgaacctttcgttaacctaacgttacacgaaccgtacaccggtccttacggaccgtacgtaccgttaaggtaactttcgtttaacgttaacttaaagtttttaccttacgttacgtaaaccgtaacgttaattttaacgtacgtttaaacccgtaccgttacgggttacggttaacccgtttaccggggccggttaaaccgggtacggtaaacgggttaacggaaccgttaccggtaaacccgttagggtacgggtacccggtaggttaccgaaccg

SEQ ID NO: 217066 - DNA, 514 bp, Homo sapiens
  misc_feature: GYAE6OF02F9JFE.1.34.D01.1.454.CMB.1.raw
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (484)..(514): a, c, t, g, unknown or other
  misc_feature (484)..(514): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatcgtgggacagattacactctcactatcagcagcctgcacgcctgaagattttgactaatttattactgtacaaactattaattacttaacgtaccccgtaagtcggtacggttccggaccgaaggggaccaagggtgaacgccgaaccgaactggtcggctcgacctaccattcgtcgttaccttacgtacttcccgttccccgacctaagttccgtacgtaaccgccctaaccgttccggttacgtacggacgggtccgggcgtacgggtaccgaagggccgtacaacggttagngngcncnnnnnnnnnnnnnnnnnnnnnnnnnnnnnnn

SEQ ID NO: 217067 - DNA, 528 bp, Homo sapiens
  misc_feature: GYAE6OF02HQLW6.1.34.D01.1.454.CMB.1.raw
  modified_base (141)..(141): a, c, t, g, unknown or other
  misc_feature (141)..(141): n is a, c, g, or t
  modified_base (271)..(271): a, c, t, g, unknown or other
  misc_feature (271)..(271): n is a, c, g, or t
  modified_base (367)..(367): a, c, t, g, unknown or other
  misc_feature (367)..(367): n is a, c, g, or t
  modified_base (485)..(485): a, c, t, g, unknown or other
  misc_feature (485)..(485): n is a, c, g, or t
  modified_base (491)..(496): a, c, t, g, unknown or other
  misc_feature (491)..(496): n is a, c, g, or t
  modified_base (498)..(501): a, c, t, g, unknown or other
  misc_feature (498)..(501): n is a, c, g, or t
  modified_base (503)..(503): a, c, t, g, unknown or other
  misc_feature (503)..(503): n is a, c, g, or t
  modified_base (505)..(528): a, c, t, g, unknown or other
  misc_feature (505)..(528): n is a, c, g, or t
tcagacgagtgcgtcacgaccggtgctcgatttagatcgtctgtggttgggtttgggagtcaggccatcagcgattctttagcctggttgcagcagaaaccagggcgagcccctcagatcgtagtctatggtgcatccagnttgcaaggtgggtcccatccaggttcagtggcagtgctatcgtgggacagtattacacttctctactatcagtcacgcctggcacgtccgtagtaagttatttcgtactaatttattactgtaacctaanagttattacgtaaccgttaccccgtagtggtaccgttcgggaccgtaacggggacgaggggtacggaacgtaccaaccggtacgtggtagaccgtnaccgactgttctgttcctacgtccttcccgttccccggactacttcgtaagacccgtacttaaccgtcggtactggacggtccgggtcgtcggaacgtagggcaagtagagctgctgnacgtannnnnnannnngncnnnnnnnnnnnnnnnnnnnnnnnn

SEQ ID NO: 217068 - DNA, 824 bp, Homo sapiens
  misc_feature: GYAE6OF02HZ7BW.1.34.D01.1.454.CMB.1.raw
  modified_base (292)..(292): a, c, t, g, unknown or other
  misc_feature (292)..(292): n is a, c, g, or t
tcagacgagtgcgtcacgaccggtgctcgatttagatcgtctgtgttggggtttggggggagtcagaccctgtcaggacacagcatggacatgagggtccccgctcagctcctggggctcctgctgctctggctcccaggtaccagctgtgacatccaattgacccagtcctccatccctccctgtctgcatctattggagacagagtcacatcacttgccgggcagtcaggccatcagcgattctttagcctggttgcagacaagaaacccaggggaccgacgaccccctnacggatacggtagtctagtggtgctacgttaccgagtagttgacgtaaacggggttcgggtaccctaagtacccgtagggttactagggttcgggacgtaggttacgacgtaaacgtttcggtaacggggtaacctaaagggttaacctttaaccgtaccttaccgtacgtaaaccgtagttaccgtaacggtacgtaaccgggtacccgttaggaccgtaaccggtacccgttaaaggtaaacgtttaaacgttttttacgggaaacccttttaaaaagttttttaacgtttaaccgttacgttaaccgtaaaaccgttaaaggttttaaactttaaaacggttaaacccggtttaaacccccgtttacgggttaaccggggttaacccgggtttaacccgggtaacccgggtaaaccgggggggttaaaaccccgggttaaaggggttaaccggggaaaccgtttaacccgggtaaaaccccggtaacggtttaaaccgggtacggttaaccggtacccgggtaaacccg

SEQ ID NO: 217069 - DNA, 688 bp, Homo sapiens
  misc_feature: GYAE6OF02F6OR0.1.34.D01.1.454.CMB.1.raw
  modified_base (102)..(102): a, c, t, g, unknown or other
  misc_feature (102)..(102): n is a, c, g, or t
  modified_base (223)..(223): a, c, t, g, unknown or other
  misc_feature (223)..(223): n is a, c, g, or t
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctattggagacagagtcaccatcacttggccgggngagtcgaggccatcagcgtattctttagccgtggttcgcagcaagaaaccagggcgacgcccctnagtagtcgtagtctagtggtgcatcagtgttgacgtaagggtcgggtacccagtaccgtacggttacaggtcggactacggtgactagtcggtagggaactaggtacttaccgaccttccgtactacttatcgacgtcacgtcctagaccgtagtacccgtaggtaagtttacgttttagaacgtttaaactttttacgttacgttaccgttaaactaaccgttaagttttaaacctttaacggttaacccgttaaccccgtttacggggtacggtttaacccggttacccgggggaaaccgggttaaccgggggaaacccgttaaaggggttaccgggtaaaacggttacccgtaaaccgggttaccgttagggtccgggtaccgtacccggtaacccg

SEQ ID NO: 217070 - DNA, 791 bp, Homo sapiens
  misc_feature: GYAE6OF02J0JSF.1.34.D01.1.454.CMB.1.raw
  modified_base (438)..(438): a, c, t, g, unknown or other
  misc_feature (438)..(438): n is a, c, g, or t
  modified_base (457)..(457): a, c, t, g, unknown or other
  misc_feature (457)..(457): n is a, c, g, or t
  modified_base (568)..(568): a, c, t, g, unknown or other
  misc_feature (568)..(568): n is a, c, g, or t
tcagacgagtgcgtcacgaccggtgctcgatttagatcgtctgtgttgggtttgggtgagtcagaccctgtcagtacacagcatggacatggacgggtccccgctcagcctccgtggggcctcctgctgctctggcctcccgaggtaccagctgtagaccatcctaattcgacccagtcctccactccctccctgtctgctacgttctagtggaacgacaggtacgtaccacctactctacgtccggccgggtacgtacgtaccgacggtccataccgagtacttacttccgtttacgtcgttggttacgcgaacgacgtaaaccggaaccggacggacccgaaccgtccccgtagacgttacgtacggttacgtaccgtaggtggccgtactacgtaccgtagacgttacggacggtaacgggtccgggttaacccncgttaccggtacgggttanacgggttcgacgtaggtccggactcgggacgtcggaagtaccttaacgtaaccttacgttaccactacgttacgacgtaaccgccgtaacgccgtaacggccgttaaacgnggtaacgttaaagttttcttaacgttaacttaaccggttttaataccgttaccgtaaacttaaacgttacgtttaacgttaaaccggttaacccttccccggagggttacccggtttaccgggtaaccggggtaaccgggaaccgggttaaacggggtacggtaaacggtaaccgtttaacccgggaaccgtttacggtcgggttacccggtagtaaccccgg

SEQ ID NO: 217071 - DNA, 938 bp, Homo sapiens
  misc_feature: GYAE6OF02IQ358.1.34.D01.1.454.CMB.1.raw
tcagacgagtgcgtcacgaccggtgctcgatttagatcgtctgtggttgggtttgggggagtcagaccctgtcaggacacagcatggacatgagggtccccgctcagctcgtgggctcctgctgctcgtggcctacccgaggtaccagctgtagacatccaagttcgaccctagtcctaccactcccgtccctgtcctgactagtctagttaggagaccagacgtccacctagtcctacgttcggcccggggacgtacgtcgacggaccctagtaccgagtaccgtaacgttttcgtttaacggtcccgttagggtttcgacctaacgggtaaccaaaaccggtaaacccgggacggggtacccgtaaaccccgtccccccggtaagtaacggtaaccggttaccggtttaaacgttcccggttaaaggttccggggtacggtacccttaacgttacccgttaaacgggttacgtttacggggaacccggttaaacgggggtccccggggttacccttaaccgggtttaccccgggtagggtttacccggtaacgggttccggaccggtaaaggtccgtacgttacggttccgggtaacgggtaactaaccgggtttaaacctttaccgaaccccgtttacgttacccggttaaaacttcgggtaaacccgttacggtaacccgggtacgttacccggtaacggttaccggtaaaccggtttcgtaacggtttaacggtttaactttaacccgtagtttttaaaaccgttttacttacggtaaaccgttaaaccgttaagttaaaacgtttccttaaacccggttaactacccccggtttaagggtacgtttcccggtaaccggtacggggaaccggttacggtaaacgggtcgtaaccgtacggacgttaccggttcggtacgtaccacggttaccg

SEQ ID NO: 217072 - DNA, 667 bp, Homo sapiens
  misc_feature: GYAE6OF02I5RMT.1.34.D01.1.454.CMB.1.raw
  modified_base (231)..(231): a, c, t, g, unknown or other
  misc_feature (231)..(231): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcgaaggtgggtcccatccaggttcagtggcagtgcatcgtgggacagtattaccactctcactatcagcagcctgcagcctagaagtnttttgactaattttactacgtgtacaacaagttattaataccgtaccccgtagttacgggaacgttccgggaccaagggggtaaccaagggtacggaacgttaccgaaacccggtaactcggtcgacgtcgaccgtaaccgtattcgtacgttctacgtacctcccgttacccgcctaagtcgaacggtacctacgtaacccgttctacggtacggtacggccggtacgtacggacgtaacgggtccgaaccgtagtaacggtcacgtgcccgtaacggcgtacgtactacgacgtacgtacgtacgtacgtacgtacgtactacgtacgtacgtacgtacgtacgtacgtacgtacgtacgtaccgtacgtacgtacgtacggtacgtaccgtaccgtacgtcggtaccgtaacgtacggtaccgtaccgtaccg

SEQ ID NO: 217073 - DNA, 718 bp, Homo sapiens
  misc_feature: GYAE6OF02G76AX.1.34.D01.1.454.CMB.1.raw
  modified_base (217)..(217): a, c, t, g, unknown or other
  misc_feature (217)..(217): n is a, c, g, or t
  modified_base (365)..(365): a, c, t, g, unknown or other
  misc_feature (365)..(365): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatcctaattcgacccagtcctccactccctccctgtctgctattctattggagacagagtccactntctacgtcgccgggcgtagtccgacggccagtcgacgcgtactttcgtttacgccgttggttcgactacggaccaaacggaaaccgcggggacccgaccgtcccccctagaacggtacgttaccggttagttacgtaaggttcgggtnaccgtacgttcccgtaaggtacgtttacggaacggtaacgggggttccgggtaccccttataccgggtttacgggttacgagggtcgtcgtaggtcgcgtacgttcggtaggtaacgtagtacgttacaccgttccgtactaacgttagtacgtacgaccgaccgtcctagaccgtacgtacgtagtaacgtttattacgttactttaagtttacgtttactacgtaaacttaacgttaactttactttaccgttaaccggttacccctagggttaccgggttacggtcccggacggtaacggaacggtaggtaacggtaacgtaccgaacggtacgtggtacgcgtactacg

SEQ ID NO: 217074 - DNA, 638 bp, Homo sapiens
  misc_feature: GYAE6OF02INB09.1.34.D01.1.454.CMB.1.raw
  modified_base (103)..(103): a, c, t, g, unknown or other
  misc_feature (103)..(103): n is a, c, g, or t
  modified_base (186)..(186): a, c, t, g, unknown or other
  misc_feature (186)..(186): n is a, c, g, or t
  modified_base (274)..(274): a, c, t, g, unknown or other
  misc_feature (274)..(274): n is a, c, g, or t
tcagacgagtgcgtcacgaccggtgctcgatttagatcgtctgtgttggggtttgggggagtcagaccctgtcaggacacagcatggacatgagggtccccgntcagctcctgggctcctgctgctgtggctcccaggtaccagctgtgacatccaattcgacccagtcctccatccctcctgtcngcatctagttggagacagtacgtccactatctacgttcggaccgggtcaagtcacggccatcgagcgtatttcgttacgcgtggttcncagtacaaggaaaccgcgggcaccgcccctagacgtagtacgtagtctagtcggtgacgtactccgtaagtacgtcggacggtaacggggtccggtaccctacgtccggttaaggttcgtaaggtcggacgtagtacgacgtacgtcggtacgggactagtaacttacgtacttccgtactaacgtatccgacgtaccacgcgttacgcgtaacgtccgttaagtaagtttcgtttactaactttaactttacgtacgtacgtaactacgttaagttacttaacggtaccgttaccgtaggtacgtacgtcggacgtacggaggttacgtaggaccgtacgtaacgcgttagcgtactgtaccg

SEQ ID NO: 217075 - DNA, 721 bp, Homo sapiens
  misc_feature: GYAE6OF02G6PVS.1.34.D01.1.454.CMB.1.raw
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccatcctccctgtctgcatctagtggagacagagtcaccatcctacttggccgggcagtcgaggccatcagcgtattcttagcctggttgcagcaagaaaccgngggcacgcccctnagatcgtagtctagtggtgcactccgtagtacttggaccgtaaggggtccggggtacccaagtccgtagggtttaccaggtcgggcgagtcggtactacgtcggtacgggaacctaaggtactttaaccgacgttcctacgaacgttactaccacggtacaccggtacccgttggacccgtacggtacccttaagggaaacgttttagtttttacaaaccgttttaaagttttaaccgtttacgtaacggttaacctaaacgttaaagtttaacgtttaaactttaaaccggtttaaccccgtaacgggtttaccgggttaaccgggttacgggtaaccccgggtaacgggggtaacccgttaaaagggttaggggtaaaccgtaaccgttaaccgggtaaaccttggggtaccggtaccgtacggtaacccg

SEQ ID NO: 217076 - DNA, 807 bp, Homo sapiens
  misc_feature: GYAE6OF02FWJ9Q.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtgggctcctgctgctcgtggctcccaggtaccagctgtgacactacctaagttcgaccctagtcctaccactccctccctgtcctgctaatctagttggaacgacgaggtactaccaaccgtataccgaccgttcgggacccgggtacgaacggtccgaacggaccctaagtcgaacgtcgttacgtttaccgttaacgtccgttaggttaccgacaacggtaaccgaaaccgggtaaaacccgggaggggtaccccggaacccgtaccccccggtagtaacggtaccggttaccggttaacgttaccggtaacggttggggtaccaccgtacgttaccggtaaggttaacgttcggtaacgggtaacgggggtttcccggtaacccgtacgttaccggtaacggggttactacgggtacggtacgtacggtcgtacgtcgtacgggtacggtaactacggtaaccgttaccgacttacgtacgtaccttacgacacggtacgaccgttcgtacgacgaccgttacgtaggttaactttcgtttaacgtaactttaacgttattacggtaactacgtaagttaagttaaccttacgtaacctacccggtgttacgtaccggtacggtaaccggtaacggtacggtaaggtaccgtaacgtaaccgtacgtaacggtcgtacggtactcgtaaccg

SEQ ID NO: 217077 - DNA, 673 bp, Homo sapiens
  misc_feature: GYAE6OF02FP5EW.1.34.D01.1.454.CMB.1.raw
  modified_base (171)..(171): a, c, t, g, unknown or other
  misc_feature (171)..(171): n is a, c, g, or t
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (397)..(397): a, c, t, g, unknown or other
  misc_feature (397)..(397): n is a, c, g, or t
  modified_base (442)..(442): a, c, t, g, unknown or other
  misc_feature (442)..(442): n is a, c, g, or t
tcagacgagtgcgtcacgaccggtgctcgatttagatcgtctgtgttgggtttgggggagtcagaccctgtcaggacacagcatggacatgagggtcccgctcagctcctgggctcctgctgctctcggctcccaggtacccagcctgtgacatccaattcgacccagtcncctatcctcctgtcngccatctattggagacacgngtccaccntctagttcgccgggcagtcagggtcccagtcacggctattcttagcccgtgttcgtaccagctaacggaaaccgacgggtacgacggtaccccctatacggaactccggttacgcgtaacgtaggttcggcacgtcctaagacttggaccgtaagggttcggtccctacgtcgtacggttacncgtaggccagttccgacacgttcgcgggaacgagtacgtttaacncgttacctcgtaacttactccgtaacgactcggtaccttggtacctaacggtcctacgtaacggtattttacgtacctaagtttacttttacgaacgtttacaaacgtttaggtaactttacgttaccgttaacccgtacgtttacggacgtcccgggttaccggaacgggtaccgtaagggttcgggaacgttacccgtaacctaacggtacgtcggtactaccgtaccg

SEQ ID NO: 217078 - DNA, 570 bp, Homo sapiens
  misc_feature: GYAE6OF02I2EUJ.1.34.D01.1.454.CMB.1.raw
  modified_base (102)..(102): a, c, t, g, unknown or other
  misc_feature (102)..(102): n is a, c, g, or t
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattcgacccagtctccatcctcctgtcngcatctatgganacagagtcaccatcacttcggccggcgtagtccaggccatccagcgattcttagcctgttgacacgctagaaaccngggacacgcccctagagatacgtacgtntagtggtcgacatcctagtacttcgcgaaggtcggtaccatcgaggttcaggtgcagtnacatcgtagggacacgtattacacgtctacgactacgnacgacacgcctgcacggacctaggaacttactttagacttaatttaatacgtagtactaagtagtaatttaacgtaaccgttaccctaggttacgaccggttacggccggtacgggaacgaacggttacggaaaggtaccctaacggtacgtacggtacgtacgtcgaacccg

SEQ ID NO: 217079 - DNA, 642 bp, Homo sapiens
  misc_feature: GYAE6OF02GDS94.1.34.D01.1.454.CMB.1.raw
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttggccgggcgagtcaggccatcagcgattcttagcctggttgcagcagaaaccgagggcacgcccctcgagtatcgtagtctagtggtncatccagtnttgacgaaggtcggtccctagtccgaggttcaggtcgggcaggtgacagttacgtgggactacggtacttaaccactccttactaaacttcgtaccacggtaccaacggtcccgtagccgacggtcccttaggtaacgttattttcgtaactaagttttaccttacgttagtaacctaaggttatttaaacgtttaccgtaaaccgttttaaccccgtaggtttccgggtaacccggttccgggtaaccgggacggggtaaacccgtaaggggtaccggtaaggtacccggttaaacggaccgttacgggtcgtacctcgggtaacccc

SEQ ID NO: 217080 - DNA, 751 bp, Homo sapiens
  misc_feature: GYAE6OF02H04LV.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccactccctccctgtctgcatctagttggagacagagtacacctatcctacgttcggcccgggacgacgtccgacggccaacgtcgagccgtatttccgtttacgtccgttggttacgtcgacgacgaacggtaaacccgaggggaccgtaccgaccccctacgacgtacgttacgtacgttcgtagtggtcgactacgtaccgagtacgttacgacggtaacgggtccggtacccgtacgtaccgtacggttacggtacgtacggtagtacggtcgacgtacgtacggacgggtaactaacggttacttacccgacttcctacaacttacgtaccgaagtcccacgtcgacgtaccgtaacgtccgttaaggtaacgttttattaccgtaaacttttaactttaacgtttccgtaaccgtaaacgtaactttaagtttaaccttaacggttaacccgtaacccggtttaggtaccggttaaccggttccgggaaaccgggtaacgggtaaccggttaagggttaccggaaaccgttaccgaaacccggttcggttaggtccggtaccgtacgtaacccg

SEQ ID NO: 217081 - DNA, 712 bp, Homo sapiens
  misc_feature: GYAE6OF02I3SB8.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggcctcccaggtaccagctgtgacatccaattcgacccagtctccatcctccctgtctgcatctagtggagacagtagtcaccatcacttcggccgggcgacgtcgaaggccctatccgaagtccgtactttaccgttttacgccgttgggttcgcgaagcgaacgaaaacccgagggccgaaccgccccctagacgacgttcgtagtctagtggtcgactactccgaagtacttggaccggtaaggggtaccggggtcccacgttacccgtaggttcgagggttacggccgtaggtcgacgtagttcggtacggactaagtacttaacgacttccgtactaactacgtcgaagtcgacgtcccgtgaccgtacgaccgttaaggtaatttagtttacgacttttaaatttacgttattacgttaactaaacgttacgtttataaccggtttaaccgttacccgtagggttaccggttccggtacggacccggtaacgggtaacgtaacggtacggtaccgtaaccgtacggtacgttaggtcggtcgtcgacccgtacgttctacgtttcgttaccgttacctcccgttacccgttaccccctacccg

SEQ ID NO: 217082 - DNA, 731 bp, Homo sapiens
  misc_feature: GYAE6OF02H19MV.1.34.D01.1.454.CMB.1.raw
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccgaggttcagtggcagtgcatcgtgggacagattacactctcactatcagcagcctgcacgccgtagtacgttatttcgacttaatttacttacgtagtacaaactagttacttaactacgtaccctaacggtggttaccggttcggaccgaacgggaaccgtaagggtacggtaaacgtaccgtaaaccggtaacgtgggttacggtccgtacgacccgtaaccgtacgttccgttacggtttaccttaccgttaaccgttcccgtttaccccgacgttaacgtttacccgtacggtaaaccgtcccgttaacccgtttacggttcccgtacggggtaccgggtaccggggtaacccgttaggggtaacccggtaacggggtccccgtaaaccggtaaaggttaacggctttaccgggagtacggtacgtacgttacgtacgtacgtacgagagtacgtacgtacgtacgtacgtaccgtacgtacgtacgcgtacgtacgtacgacgtacgtactacgtactacacgtacgtcgccgtacggtaccgtacgtacgtacgtagtagtacg

SEQ ID NO: 217083 - DNA, 740 bp, Homo sapiens
  misc_feature: GYAE6OF02FU4XW.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccgaggtaccagctgtgacatccaattcgaccctagtcctccatccctcctgtctgcagtctattggagacagacgtccaccgtactcgacttcggccggtacgagttccgacgggtcccagttccgagtaccgtacgttcgtttaacgtccgttgtcggtacgacggtaccgtaaaggaaacccgacggggaccgaaccgtcccccgtagacgtaacgtaccggttacgtacgtacggtgtacgtacctaactccgtaagtacgttacggtaaccggtaacgggttccgggtaccccgtacgtacccggtacgggtttacgaacgggttcggtaccgtaagttcgaccgttaacgttccgggtacgggtaactaacgtttacgttaaccgtaccggtacctacgttaaaccgtacgtacgtacgacgtacccgtactacggtacggtacttccggttaagtaacgtttacggtttactacgtttaacgtttaacgttacgttacggaacctacgtaaacgttacttacggttacctacccgttaggtaccgtcggtacgacggtacggactaggtacacggtacgactacgtgcgtacgtcacg

SEQ ID NO: 217084 - DNA, 706 bp, Homo sapiens
  misc_feature: GYAE6OF02IR4DL.1.34.D01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (355)..(355): a, c, t, g, unknown or other
  misc_feature (355)..(355): n is a, c, g, or t
tcagacgagtgcgtcacgaccggtgctcgatttagatcgtctgtgttgggtttgggggagtcagaccctgtcaggacacagcatggacatggagggtccccgctcagctcctggggcctcctgctgctctggctcccaggtaccagctgtgacatccaattcgacccagtcctccactcctccctgtctgctatctagtgganacagactcacctatccacgttcggcccgggcgacgtcgacggccatcagtcgttattccgtttacgccgttggttcgcgagaccgaaggaaaaccggnggggaccgacggtcccctanacggtactaccggttacgtcgttagtcgggtacnctactacagtagtcgacgtacggggtcgggtaccctacgttaccggtggttactaggtcggacgtaggtcgactagtcggtacgggtaacgtacgttacgtttaccaaccgttctaaccgtacgtacgtaccgacggtaccgaccgtccgtacggcgtaccgtccgtaaggtaacgtttctttacgtacttaatttcgtactagttaactaacttaattaagttaccgttaaacccgtaccgtttacgtaccgggttccgggttaccggaccgggttaaagggacccggttaaggtaccgggttaaccgtaccgtaaccgggttactcgggtacggtaccgtaccggaacg

SEQ ID NO: 217085 - DNA, 816 bp, Homo sapiens
  misc_feature: GYAE6OF02IR3GJ.1.34.D01.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
tcagacgagtgcgtcacgaccggtgctcgatttagatcgtctgtgttgggtttgggcatggacatgagggtcccgctcagctcctggggctcctgctgctctggctcccaggtaccagctgtgacatccaattcgacccagtctccatcctcctgtctgcattctattaggagacgagacgtccactatcctacgttcggccgggngaacgtcaggccatcagtcgatttcttaggcctgggttacncgtaacgctaaggaaaccgtaggggaccgaacggtccccttagacgtacgttacggtagttaccgttagtaggtcgacctaacttcccaaggtacttacggaccgtaaacgggggtccggggtcccctaagttacccgtacgggttaccgtaaggttacgggacttaaggtcggaccgttaggtttacccgaggggggttaacctaacgggttatttaacccgacgtttaccgtaccgtaaaaccttcgtaccgtaagccgtacgtaccgtcgtacgtacgtacgtaggtaagttacggtttacgtacgttaacgtttacttaacgttacgtaacgttaaacgtacgtttaaactcggtttaacccggttaacccgttagggtttaaccggtacccggtttaccggggacccggtaaaccgggggttaaccggaacggggtttaaccggtaaccggtaaccttaacccgggaattaccggggttaaaccggtcgtaccggtaacggcccttaaagtttcccgtacggttttcccaccgtttacccgttcccttaccccgttacccccgg

SEQ ID NO: 217086 - DNA, 718 bp, Homo sapiens
  misc_feature: GYAE6OF02FXJ9X.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccactccctccctgtctgctattctagttggagacaggagtccaccatctacgttggccgggcgagtcaggccatcgagcgtattctttacgccgttggttcgctacgacgtaacggaaaccgagggggaccgacgaccccctacgagtacgttacggttacgttactacggttgggtcgctaaccgtacctaaggtagttacggacggtaacgggggtcggggttacccctaagttaccgtaaagggttcagggtcggcgtaaggtcgacgtagttccggagggtaactaggtacttaaccctctactaacgtacttacgactacggcctaacgtccgtaggactacggcctaggtaacgtttagttttacggtactttaaattttacgttacgtacgttactaaacgtttagttaactttaacgttaccgttaaccccgttagggtacggttaaccgggttccgacgggtaacgggtaaccggtacgggtaacggtaacgttaaccggtaaccgttaacggttcgggtacgacgtacggtaacccg

SEQ ID NO: 217087 - DNA, 600 bp, Homo sapiens
  misc_feature: GYAE6OF02F9VK6.1.34.D01.1.454.CMB.1.raw
  modified_base (274)..(274): a, c, t, g, unknown or other
  misc_feature (274)..(274): n is a, c, g, or t
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
  modified_base (473)..(473): a, c, t, g, unknown or other
  misc_feature (473)..(473): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtccaccatcacttggccggcgagtcaggccatcagcgtattctttagcctggttgccagcaagaaaccgngggccgacgccccctgaggtactcggtagtctaagtgtgacactccgagtatggacgaagggtcgggtacccanccgttttaggactaggtgcagtacagtcgtagggactagacttacaccttntaccacgtatcgagtcacgtcctgccgagtaccgtagtaagttactttagaccttaagtttaacttactgtaanaacgtagttaattaccgttactaaccctaggttacggtaccgttccggaccggtaggggtaacccgtaagggtaccggtaacggtacccaacggttccgtaggtccggtacgttacggacctaaccg

SEQ ID NO: 217088 - DNA, 766 bp, Homo sapiens
  misc_feature: GYAE6OF02F0544.1.34.D01.1.454.CMB.1.raw
  modified_base (530)..(530): a, c, t, g, unknown or other
  misc_feature (530)..(530): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccactccctccctgtctgcatctagttggagacagagtccaccatctacgttcggccgggcgacgtccgacggccactccgacgtccgtattttccgtttacgtccgttgggttcgacgaacggaccgtaaacggaaaaccggacggggaccggaacccgtcccccgtacgaacggtacgttaccggttagttacgttacggttgggtcgtccgtactaccgagtagttcgacggtaacggggtaccgggtccctacgtccgtacggttcgaggtcggacgtagtcgtcgtacgttacggacgggaacgtaggttaccttacaccgttactcctaacgtactacgacgtcaccgccgtcnccgacgttaccgtaaggttaactttagttttaccgaatttttaaacgttttacgttacctttacgtaaaccttaagttacgttttaaactttaaccggttaacccgttaacccgggtttacggttaccgggtaacccgggttaccgggtaccgggtaacgggggtaaccctaaggggttaacgaaccggtttaaccggaacggttaccggttaggtaccgggtactcggtaacccg

SEQ ID NO: 217089 - DNA, 1199 bp, Homo sapiens
  misc_feature: GYAE6OF02GLE8V.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtggggctcctgctgctcgtggcctcccgaggtaccagctgtgacactccaattgacccagtcctccactccctccctgtctgcattctattggacgacagactcaccatccacgttcggcccgggcgagtaccgacggccagtccgagtcgtatttccgtttacgccgttgggttacgcaacgacgaaacggaaaccggacggggaccgaccgcccccgtacgaacggtacgttaccggttacgttcgttagttacgggtcgacgtaacttaccgaaggtacgtttacggaaccgggttaaacgggggttccgggttaacccccgtagtttacccccgggttaaggtttaccggtaacggggttcggggtacgttaacgggtacgtacccggttaaaccgtttacccggggttaacggggtaaaccggttaacggtttaaaccgttttaaccccggtttaaaccccgtttaccccgttttaacccgtttaaaaccccgttaaaccgggttaacccgggttaaaacccgaccccgggttaaaccccgggttacccccggttaccgggttaaaccccgggtaaccccgggttttaaaccccgggttttaaaaccgggggttttaaaaacggtttttttaacccggtttttttaaaccggttttaaaacccgtttttttaaaaacggttttttttaaaacccgttttttaaacccgggtttttaaaccccggttttaaaaaaccccggtttaaaaaccgggttttaaaacccgttttttttaaacccggtttttaaaaaacccggtttttaaaaccccccggggtttttaaaccccccccgggttttaaacgggggtttttaccccgggggttttaaaaccccccgggggggtttttaaaccccgggggggttaaaacccccggggggtttaaaaacccggggggggttaaaaaccccccggggggttttaaaaaaaccgggggggtttaccccggggttttaaaaaaaccccgggtttaaaaacccccggggggttaaaacccccgggtttaaaaaccgggtttttacccccgggggggttaaccgggg

SEQ ID NO: 217090 - DNA, 567 bp, Homo sapiens
  misc_feature: GYAE6OF02I61VY.1.34.D01.1.454.CMB.1.raw
  modified_base (309)..(309): a, c, t, g, unknown or other
  misc_feature (309)..(309): n is a, c, g, or t
  modified_base (359)..(359): a, c, t, g, unknown or other
  misc_feature (359)..(359): n is a, c, g, or t
tcagacgagtgcgtcacgaccggtgctcgatttagatcgtctgtgttgggtttgggggagtcagtaccctgtcaggacacagcatggacatgagggtccccgctcagctcctggggctcctgctgcgtctggctcccaggtaccagctgtgacatccaattgacccagtctccatcctccctgtctgcatctattcggagacagacgtcaccatccaacgttgccgggcaggtcaggccatcaagcgattcgtttagcctaggttgcagcagaaaccagggcgagcccctcagatcgtagtctatggtncatccagattgcaaggtcgggtacccatccgaggttcaggtgacagtcgnatctgggacagacttaacgactctctactatcagcaagcctggcagcctagaagtatttgctaatttacgttactagttacaacgtagttaattacttaacgttaccctacgttcggaaccggttaccggaccgtaacggggtaaccgtaagggtacggtaaaggtacccaaacccggtaaccgttcggaacgggtctacggtacccg

SEQ ID NO: 217091 - DNA, 683 bp, Homo sapiens
  misc_feature: GYAE6OF02H5YZQ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagtctgtcgacatccaattcgacccagtcctacacttcctccctgtctgcatctaagttggagacagagtcacgatcacgttgccgggacgagtcacgcatcagcgtattactttagtcctggttcacgacgacaacggaaccgaggggtaccgaacgccccctaagaagtacgtacgtagtactagtcgtgactactacgagtacgtgacgtagggtaccggtaccctagtaccgaggttacaggtacgacgtacggtgacgtagtacggtcgggaactacgtaacgtaactaccgtactaaccagttaactacgaacgtacgacgcgttacgacgacgtcgttaagtaggttactttaagtaactttaagttttaacttaccgtagtaactaacgttaacgttaagtttaacgtaaccgttaaccgttaacggtaccgggttaaccgttacgggtaccggaaaccggggtaacggtaacggttaacggaacggttaaccgtaaacggtaaccgtacggtacggtaccctaggtaacccg

SEQ ID NO: 217092 - DNA, 677 bp, Homo sapiens
  misc_feature: GYAE6OF02FTY9J.1.34.D01.1.454.CMB.1.raw
  modified_base (143)..(143): a, c, t, g, unknown or other
  misc_feature (143)..(143): n is a, c, g, or t
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
  modified_base (313)..(313): a, c, t, g, unknown or other
  misc_feature (313)..(313): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccngctgtgacatccaattgacccagtctccatcctcctgtctgcatctattggagacagagtcaccatcacttcgccgggngagtcatgcctatcgagcgtatttcttacgccgttggttgcagacaagaaaccgngggccgacgcccctgagtatcgtagtctagtggtcnctacgtccagtattgacggtaacggtcggggtaccctacgttccgtaggtttccgaggttcggactagtcgacgtagttccgtaggggactaacggttaatttaacccgaaccttccgtacctaacgttacgttaccgacggtaccacgtaccctggaccgtacgtacccgtaggtaaacgtttacgtttagaacttaagtttttactacgtttagtaacctaaagttaacgtttaacttaacgttaacccggttaaccccgttacgggttacggtaaccggtttccggaaccgggtaacggggtaaccgtaacggtacggtaaccgaccgtaaaaccggtcgtacggttcggtaccgtaacgg

SEQ ID NO: 217093 - DNA, 880 bp, Homo sapiens
  misc_feature: GYAE6OF02JUKK4.1.34.D01.1.454.CMB.1.raw
  modified_base (614)..(614): a, c, t, g, unknown or other
  misc_feature (614)..(614): n is a, c, g, or t
tcagacgagtgcgtcacgaccggtgctcgatttagatcgtctgtgttgggtttgggggagtcagaccctgtcaggacacagcatggacatggagggtccccgctcagctccgtggggcctcctgctgctctggcctccaggtaccagctggtgacatccctaattcgaccccagtcctcctactccctccctgtcctgcacttccttagtggaagacgagtacgtcaccctagtacctacgttccggacccggggtacgacgtaccgacgggacccaagtccgaaggtccgttaacgttttccgtttacggtcccgtttcggggtttacggaccgaacggaccgaaacggaaaacccccggtaggggggaccccgaaccggaccccccgtacgtaacggtaccgttacgtaacgggttccttaacggttcgggtacgaccgtaaccgttacctaaaggtaccgtttacggaccgggtaacggggttacccggggtacccctaccgtaccgttaacgggttccggtacgggttcggaccgttaagtcggtaccgtaggttccggagggtaaccgtaagttaaccgttactaacccgttcgtaacccacgtttaanccgaagtacctaccggtccgtaacgcgttaacccgacgttaacggtaagtttaccgtttacggtaacgtttaaaccttttaagttaccgttaacgttaaccgtaaaccgtttaacggttttaacttaaaccgttaaccccgttaacccgttaccggttcgggttaaccgttacccgggggaacgtaaccgggtaaacggtaggggtaaactaacccggtaacgttaaccggtaccgttaccggtagggttacccgtgttaaccccg

SEQ ID NO: 217094 - DNA, 672 bp, Homo sapiens
  misc_feature: GYAE6OF02JAPUO.1.34.D01.1.454.CMB.1.raw
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (369)..(369): a, c, t, g, unknown or other
  misc_feature (369)..(369): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctagttggagacagagtccaccatcacgttcggaccgggcgacgtcaggccagtcagcgtatttcttagccttggttncancgaagaaccgagggcgacgcccctcgacgtatcgttagtctagtggngacatcagtntagacgaggtcggtccatccgtaggttcaggtggacaggtcnctagtcgagggacagttactacctacgtctactacgtactcgacgactcgccctggacctacggacccgttagtaaagttacttttacaacgttttaaagttttacgtacttaaccggtacttaaaccgttaagttttaaaccgtttaacgttaacccccggtttaaccccgttagggtaccgggtttacccgtaacccgggggtaaccggtaacggggttaaaccggtaacggggttaacggaacccgtttaaccgggaaacccgttaagggttacggttccgtaccggttacctaacccgg

SEQ ID NO: 217095 - DNA, 690 bp, Homo sapiens
  misc_feature: GYAE6OF02ICN7F.1.34.D01.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatcctaattcgacccagtctcactcctccctgtctgcatctatggagacagacgtcaccatacacgttggccgggacgacgtcgaggccatcaagcgtattctttacgccttggttncagacaagaaaccgagggtaccacggccccctagaagtacttacggtacgtacgttagtggtacgactaactacgagtattcggacggtaacggggtccgggttacccctagttacccggtaggttcgaggttcggacgtacgtagactagtacggtacgggaactaggtaacgttaactaccttaccgtactaactacgtaccgacgtaccgacctcgtacggtaccaacgtccggtaagttaagtacgtttttaacgactttaaattttaacgttacttacgtaactaacgttaattaacttaacgtaaccgtacccgtacggttacgggtaaccggtttcgggaccggtaacgggtaaccggtaaggtaacgggtaactacggaaaccgtacgttacgggtacgtaccgtagtaacccg

SEQ ID NO: 217096 - DNA, 840 bp, Homo sapiens
  misc_feature: GYAE6OF02ILLJX.1.34.D01.1.454.CMB.1.raw
  modified_base (126)..(126): a, c, t, g, unknown or other
  misc_feature (126)..(126): n is a, c, g, or t
  modified_base (210)..(210): a, c, t, g, unknown or other
  misc_feature (210)..(210): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctntgctcccgaggtaccagctgtgacactccaattcgacccagtctccgactcctcctgtctcgcacttctagtcggaacgacaancgtacactactaccgtcggtcggacggacgtaggaccgtacgacgtacgtacgaacgtacgttacgtttacgtacggttccggttcgttcgacggtaacgaaccggtaaaaccggaaccgggtacggaccggttaccccgccgtacgaacgttaccgttaggttacgttagttacgtcgggtacctcgtaaactaacggttacggttacgtaccggtacgggtaccggggttaccgtaccgttaccgggttaccgttacggttacggtaacggtcgtaacgttcggactacgtttaacggcggtaacgtactaacgtactactcctacgtactacgtacagtacgacgtacgtccgaacgtcgtaaccgtacttagttaactttaacgtacgtttaaacgttactttaaccggttacgtacgttaaaccgtaagtttaacgttttaaaccggtacccgttaaaccggtttacccggtaacgggtttacccgggttaaccggttacccggggtaaaccgggtaaaccgggttaacggttaaaccggggttaacccggtaaccggttaaaccccgggtaacggttttaccgaccccgggttttaacggtaccccgtaacggtttaaccccgg

SEQ ID NO: 217097 - DNA, 427 bp, Homo sapiens
  misc_feature: GYAE6OF02JZ0CZ.1.34.D01.1.454.CMB.1.raw
  modified_base (314)..(314): a, c, t, g, unknown or other
  misc_feature (314)..(314): n is a, c, g, or t
  modified_base (317)..(318): a, c, t, g, unknown or other
  misc_feature (317)..(318): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (392)..(394): a, c, t, g, unknown or other
  misc_feature (392)..(394): n is a, c, g, or t
  modified_base (397)..(398): a, c, t, g, unknown or other
  misc_feature (397)..(398): n is a, c, g, or t
  modified_base (400)..(427): a, c, t, g, unknown or other
  misc_feature (400)..(427): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtgcagtgcatctgggacagattacactctcatatcagcagcctgcagcctgaagtattttgactaatttattactgtacaactagttattaatacgtacccctaggtggacgttcgccagggaccaggtggaatcgaacgactgngcnncacatcngtctcntctccgctatctgaactactcgtncgagccggntggacacggcnctagtagntcngacngnnncannannnnnnnnnnnnnnnnnnnnnnnnnnnn

SEQ ID NO: 217098 - DNA, 863 bp, Homo sapiens
  misc_feature: GYAE6OF02GSW6S.1.34.D01.1.454.CMB.1.raw
tcagacgagtgcgtcacgaccggtgctcgatttagatcgtctgtgttgggtttgggcatggacatgagggtccccgctcagctcctgggctcctgctgctctggctcccaggtaccagctgtgacatccgaattgacccagtctccatcctccctgtctgcatctagttggagacagacgtcacctatccgacgtttcggccgggtcgtaacgttccgacgggtaccctaagttccgacggtccgtaacttttccgttttaacggtccccttggggtttacgccgaacggtaccaaaaccggaaaacccggacggggtaccgtaaccggtaccccccgtcgaaggtaacgttaccggttacgttaccgtaaggtttcggtaccggtactaaaccgttccgaaggttaacgtttaccggaaccggtaaaggggttcccgggggtaaccccttacgttacccggtaagggtttaccgacggggtcgggtaacctagggttaccgaccgtacggtttaccggtacggggaaacgttaacgttaacgttaacccgtacgtttaccctaccggtaaccttacgtacccgagtaccgtaccgtccgtgaccgtacgtaccgtaacggtaagtttgttacccgtaacttaagtttacttacgtacgtaactacgttaagttactttacgtaacccgttaccgttaacgggttcggtaccgtaccggaaccggtaacgggtaaccgtaaggggttaaccgaaccgtaacggtaaacccgttggtacgggttaccggaccgtttaccgaaccgtaaccttacgttcgttaccgttaccttaacccggtttcctttaccccgtaaccctccgg

SEQ ID NO: 217099 - DNA, 793 bp, Homo sapiens
  misc_feature: GYAE6OF02G6SKY.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctctgctgctctggctcccaggtaccagctgtgacatccaattgacccagtctccatccctcctgtctgctattcttagttggacgacagagtccaccatcacgttcggccgggcgagtcgaggtccagtcagctattcgtttacgcctggttgacagacgtagaaaccggagggacgacgtcccctactacgtacgtacgttacgtcgtacgtgggtcgactacgtcctagtagttgacggtaacggggtccggtaccctacgtaccgtacgggtttacgtacggttcgggacgtacggtcgtaccgtaacgtttcggtacgggtttaaaccgtaggttaacctttacccgtaacctttaaccggtaccttaacgtaaccgttccgaaacggttcccgtaacggtcccgtacggtccgaacggtaccgtaagggttaacgtttacgttttacgggtaaccttttaagttttaaaccgttacgttttacccgtaaattaacgtttaacgtttaaacgtttaaccggtttaaacccgttccccgggttaaaggtttccgggtaccggggtttacccggacggggttaaaccgggggtaaccgtaacggggttaacgggtaaccgtaaccggtaacccggttaaccggttgggggtaaccggtcccgttacggggaaccc

SEQ ID NO: 217100 - DNA, 663 bp, Homo sapiens
  misc_feature: GYAE6OF02FSFX5.1.34.D01.1.454.CMB.1.raw
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctccaggtaccagctgtgacatccaattcgacccagtctccatcctccctgtctgcatctattggagacagtagtccaaccatccaacgttcggccgggcagtccgaggtccaatcgagcgattctttagccttggttgctagacagaaaccgagggccgacgcccctanagactcgtagtctagtggtgcagtccagtagttgcgtaacggtcgggtacccagtcccgtaagggtttccaggttcggcgtaaggtcgactacgttcggtaggggaacctaaggtactttaccgtaaccttcctactaacgttacgtcgtaacggacctacggcccttaggccaaggttcccttaaggtaagttactttttaggaacttttaaagtttacttacgttactacgtaacttagtaatttacgttaacgtaccccgttaggttacggtaccggtttccggacggtaaacgggtaccgtaacgggttacgtaaccggtaccgtaaccggtaccggttagtaccggtactacgtaacc

SEQ ID NO: 217101 - DNA, 594 bp, Homo sapiens
  misc_feature: GYAE6OF02IGCS1.1.34.D01.1.454.CMB.1.raw
  modified_base (321)..(321): a, c, t, g, unknown or other
  misc_feature (321)..(321): n is a, c, g, or t
  modified_base (470)..(470): a, c, t, g, unknown or other
  misc_feature (470)..(470): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttcggccgggcagtcacggccatcgagcgtatttctttagccttggttcgctagacaacggaaaccgaggggccgacgccccctacgacgtattcgtagtctagtggtncatccagtattgacgtaagggtcgggtcccagtccgtaggttcaggtaggctaggtcgacgtagtacgtgggtaactaggtactttacctacctcttaccaacttataccgacgacgaccgtcctcgacgacgtaccgtagtaacgttnttttacggacttaaatttttacttactcgttacaactagttaacttacgtaccttacccgtagtgtaccggtcgacggacgggacagggtacgacgtacgaacgtagtggtacggctacgtacc

SEQ ID NO: 217102 - DNA, 897 bp, Homo sapiens
  misc_feature: GYAE6OF02FRO96.1.34.D01.1.454.CMB.1.raw
  modified_base (590)..(590): a, c, t, g, unknown or other
  misc_feature (590)..(590): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctcctgtcctgcattctagttggagacagtagtccacctatctacgttcgggcccgggcgtacgtcgtacgggcccatcgacggcgttaactttcctttacgccgtttagggttcgacgtaggaccgtaaacggaaaacccggacggggaccgtaacccggtcccccttacggaaggtacgttaccgggttaagtccttaaggttgggttccgtaacttaaccgtaccggtaaggttaacgtttacggaaccgggttaacggggggtacccggggtttaacccaccgggtttacccgtaacggggtttcgaacggggtacgggtaccgtaagggtcgttaaccgtcgttaccggggtaacgggaactaacgggtttaacttaacccgtaccttaccgttaactaccgtttaanaccggtaacgtcccgtaaccggtcccgtaggtacccgaaccgttacccggtttaaacggtaaacgttttaccgttttaaccgggtaaaccttttttaaacttttaacggtttacccgttaacttaaaccggttaacgtttaaacgttaaccgttttaaccgtaaaccccggttttacccggttacgggttacccgggtacccggtttaccggggtaaacccggaacgggggttaacccgtaaggggtttaaccgtaacccggtaaccgtaacccggttaaggtcggtaggttacccgacggtaaccc

SEQ ID NO: 217103 - DNA, 680 bp, Homo sapiens
  misc_feature: GYAE6OF02HEEP1.1.34.D01.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcacatcacttgccgggcagtcaggccatcagcgtattctttagccgttggttgcagcaaggaaaccagggcgacggccccctanacgatcgtagtactagtggtgcaatccaagtatttagacgtaaaggggtcggggtaccccagtccgtacggttacaggttcgggactaggtcgacagttccgtaggggaactaggtaacttaacgacttactaccgaacttacgctaagaccaaggtcccgtagtaccgagttacccgtagtaaaacggttattttacgacgttaaatttttaacgttacgttagtaaccgtaaacttaagttaacgtttaaaccttaaaccgggttaaccccttaagggttaccgggtaaccggtttacccgggaaccggtaacgggggtaaacccggtaaggttaacgggaaacgtacccgtaaaccggtaaccgttaggtaccgggtactacggaacccg

SEQ ID NO: 217104 - DNA, 665 bp, Homo sapiens
  misc_feature: GYAE6OF02IDEUN.1.34.D01.1.454.CMB.1.raw
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
  modified_base (405)..(405): a, c, t, g, unknown or other
  misc_feature (405)..(405): n is a, c, g, or t
  modified_base (653)..(653): a, c, t, g, unknown or other
  misc_feature (653)..(653): n is a, c, g, or t
  modified_base (660)..(660): a, c, t, g, unknown or other
  misc_feature (660)..(660): n is a, c, g, or t
tcagacgagtgcgtcacgaccggtgctcgatttagatcgtctgtgttgggtttgggggagtcagaccctgtcaggacacagcatggacatgagggtccccgctcagctcctggggctccctgctgctctggctcccaggtaccagctgtgacatccaattgacccagtcctccactccctccctgtctcgactatcttattggacacagtacgtccaccatccattcggccgggnagtcaggccatcagcgtacttcttacgccttggtcncagacaacgtaaaaccgngggtcgaaccgtccctcgaactaacggttcgtaacgtctaagtcgggttcactacttaccgaaggtattaccgtacgtaaggggtccgggtacccaacgtccgtaaaccgggtttnacgggttacgggcctaggtacgtaccgtaattccggtaaggggacctaggttaaattccgaccttacgtaaccacgtatacgaccgacggctacctcgcgtaacgcccgttaagtacgttagttaccggttataaagtttacttacgacggttaaccaacgtttaataacttaacgtaccgtacccttgggaccgttacgtccggacgtaacgggtacagggtacgaacgtcggaaacgtcgacggtntccgganaccgg

SEQ ID NO: 217105 - DNA, 594 bp, Homo sapiens
  misc_feature: GYAE6OF02FQZHB.1.34.D01.1.454.CMB.1.raw
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
  modified_base (314)..(314): a, c, t, g, unknown or other
  misc_feature (314)..(314): n is a, c, g, or t
  modified_base (411)..(411): a, c, t, g, unknown or other
  misc_feature (411)..(411): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatcaccatccacttggccgggcgagtcaggccatcagcgattcttagccgttggttcncagcaacgaaaccgngggaccgacgccccctanacgatcggtatctagtgggtcncatccgagtattcgcgtaaggggtcggtaccctagtcctaggttccaggtggcaggtcgctagtcggtggaacaggtacttacgactctactactancgagcacgcctaggcacgtacgtagaagttcttttagactttaatttacttacgtagttaacaagttaagttaacttaacgttaccgttacccttaggtacggttacggtccggtaacggacgggtaaccgtaagggtacggtaacgtaccgaaccggttacgtggtacggtcctacgtaccg

SEQ ID NO: 217106 - DNA, 638 bp, Homo sapiens
  misc_feature: GYAE6OF02GBF65.1.34.D01.1.454.CMB.1.raw
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatccacttggccggacgagtcaggccancgagcgtattccttagccttggttgcagcaagaaaccgngggcacgccctnagctacgtagtctagtggtgctagtccagtattcgacgtaacggggtcgggtacccaggtccctaggttacgaggtcggacgtaagtgactaagttccggtagggaacaacggtactttaaacctaccgttctaacaacttagtacacggtacaccgtcccgtagaccacggtaccaaggtaacgtttacggttttacaactttaaatttttacgttaaccgttacgttaacctaacgtagtttaaacttaagttaccgtaaccccgttagtacggtaccggttaccgacgggtaacgggaaccgtaagggttacgaagttaccgaacggtagtaggtcgtacgtagacccg

SEQ ID NO: 217107 - DNA, 510 bp, Homo sapiens
  misc_feature: GYAE6OF02ILBLQ.1.34.D01.1.454.CMB.1.raw
  modified_base (230)..(230): a, c, t, g, unknown or other
  misc_feature (230)..(230): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (479)..(510): a, c, t, g, unknown or other
  misc_feature (479)..(510): n is a, c, g, or t
tcagacgagtgcgtcacgaccggtgctcgatttagatcgtctgtgttggggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcacgctgcagcctagaagtnttttagactaattttattactgtacaactagtattatacgtacccctagtggtacgttcggacgagggacctaagggtggaacgtacaaaccgagtggtcggctgacactactcttcgtctctactccttacccctaccccgtctacccgacgtcctaccgtacgttcctaagggccggtaccggggtctaccggggacggtaacgggcccgtactaaacggttacgcgcttagcgnacncncgncngnnnnnnnnnnnnnnnnnnnnnnnnnnnnnnnn

SEQ ID NO: 217108 - DNA, 781 bp, Homo sapiens
  misc_feature: GYAE6OF02G2VZ6.1.34.D01.1.454.CMB.1.raw
  modified_base (379)..(379): a, c, t, g, unknown or other
  misc_feature (379)..(379): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatacctaattcgacccagtcctaccactccctccctgtctgcattctagttggaagacgaggtactacaacctactacctaaccgttcgggccgggtacgaacgtccgacggtaccactacgaggtaccgttaacttttccgttacggtccgttggttacgactagacgaaacgaaccggaggacccgaccgtcccctagacgtacgtacgtagttacgtagtcggtnactactacgagttagtacggaccgggtaacggtccggtaccctaacgtaccggtacggttacgaggtcggacgttagtccgacgtcggtacggtacgggtaacctagttaacttaccctactaccgtactaacgtactacgacgacgtaccgtacgacgtaccgtacgttacgtaagttaacgttatttaacgtactttaaacgtttacgttacgtaccgttaaacgtaacgttaacgtttaacgttaacccgttaaaccgttacccggttaacgggtttaccggtaccgggttaccgggtaacccggggttaaccgggtaaccgggtaaacgggttaaccgggtaacccgttaaccggtaaccggttaacggtaccggtacggttaccgaccggtaacccg

SEQ ID NO: 217109 - DNA, 647 bp, Homo sapiens
  misc_feature: GYAE6OF02HB8TB.1.34.D01.1.454.CMB.1.raw
  modified_base (186)..(186): a, c, t, g, unknown or other
  misc_feature (186)..(186): n is a, c, g, or t
  modified_base (270)..(270): a, c, t, g, unknown or other
  misc_feature (270)..(270): n is a, c, g, or t
  modified_base (379)..(379): a, c, t, g, unknown or other
  misc_feature (379)..(379): n is a, c, g, or t
  modified_base (442)..(442): a, c, t, g, unknown or other
  misc_feature (442)..(442): n is a, c, g, or t
  modified_base (456)..(456): a, c, t, g, unknown or other
  misc_feature (456)..(456): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtagacatccaattcgacccagtctccatccctcctgtcngcatctattggagacagagtccaccatccacgttggccgggacgagtcacgggcctatcgagcgtatttcgttacgcttggttnacacgacaacgaaaccggcgggacaccggtccccacgagtactcggtacgtactacgtggcgtacactacacgtattggacgtaaggtcggtccactacgtcgttacgngtacggacgtagtacgtcaagtcgtacgggaactacgtaacttacgcttaccgacaaccttancgacgcgactacgngtaacacgtacgaagttaacttacgttactacttaaagtttcttaagtaccagtaaacttggttaactaaccttacggtaaccccgttacggtacggttaccgggtcggttaaccggaaccggggtacgtaaacgggttaacgtaacggtaccctaaaggtccggttaggttaccggaagtccggtaaccc

SEQ ID NO: 217110 - DNA, 683 bp, Homo sapiens
  misc_feature: GYAE6OF02HUEIB.1.34.D01.1.454.CMB.1.raw
  modified_base (225)..(225): a, c, t, g, unknown or other
  misc_feature (225)..(225): n is a, c, g, or t
  modified_base (323)..(323): a, c, t, g, unknown or other
  misc_feature (323)..(323): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctagcatctattggagacagagtcaccatcacttggccgggngagtcacggccatcgagcgtattcttagtccgtggttcgctagcaacgaaaccgagggccgacgcccctacgagtacgtcgtacgtctagtgggtacncaactccgagttacttggaccgtaacggggtaccgggccctagttacccgtaacggttcgaaggttcggacgtacgtcgactaacgttcgtacggggactaaggtaacctttacccgtaacttacccgtactaaacgttacgtaccgaagtccctaacggtccctaacggcgtaaaccgggtccttaacggtaggttaactttttacgaacgtttaacttttagttaccgtacgttaaccgtaaactagttaacctttagaacccgttacccgttaggtacgtttacggtaccgggtagaccggggtaactaagggtacgaaccgtacgaacggtaccgttaggtacggcctgtaacccg

SEQ ID NO: 217111 - DNA, 687 bp, Homo sapiens
  misc_feature: GYAE6OF02GDCX2.1.34.D01.1.454.CMB.1.raw
  modified_base (227)..(227): a, c, t, g, unknown or other
  misc_feature (227)..(227): n is a, c, g, or t
  modified_base (258)..(258): a, c, t, g, unknown or other
  misc_feature (258)..(258): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctcctgtctgcatctagttggagacagagtcaccatcgacgttcggccgggnagtcaggccatcagctattcttagcttggtnacgagcaacgaaccgaggccgaccgccctagagtactcgtacgtctagtggtgactactccgagtattcggacggtaagggtcggtaccctaggttccgtaagggttaccaggttacggactaacggtgtaccgtaagtcggtacgggtaactacggttaacttacccgtaccgtttactaccgtaaccttaacggtccgaacgtaccggtaccggtacctacgggtccaacggttaccgtaggttaaagttacgttttacgaaacttaaagtttacctacgtacgtaactaacgttacggttaactaaacgtaccgttaacccgttaggtacggttaccggttacggacccggttaacgggtaaccggtaaggtaccggtaacgtaccggtaaaccggttcgtagggtccgtaccggtacgtaacccg

SEQ ID NO: 217112 - DNA, 616 bp, Homo sapiens
  misc_feature: GYAE6OF02FXPJY.1.34.D01.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (392)..(392): a, c, t, g, unknown or other
  misc_feature (392)..(392): n is a, c, g, or t
  modified_base (412)..(412): a, c, t, g, unknown or other
  misc_feature (412)..(412): n is a, c, g, or t
tcagacgagtgcgtcacgaccggtgctcgatttagatcgtctgtgttgggtttgggcatggacatgagggtccccgctcagctcctgggggctcctgctgctctggctcccaggtaccagctgtgacatccaattgacccagtctccatcctccctgtctgcatctattggagacagagtcaccatcacgttggccgggngagtcaggccatcagcgattcttagcctggtncagcagaacgngggcgacgccctanagatcgtagtctagttggtgactactccgaagtattcggacgtaaacggggttcgggtaccccagttcccgaagggtttcagggttcggacgtggtacgctagttacgcggtaacagtacttaacaccgtttacnctaaccgttatcgacgtacncggtacctgccgtagtcctaaggtaacttagttcacttaatttacttagtcttaacaacttagtacttaactacgttaccctaggtacgtaccgttcgggacctaagggggacctaagggtacggaacgtacgaaccgtagtacggtcggcctagggaacccacggtactcttacggtccttaccgtacgttcctcccgtaccg

SEQ ID NO: 217113 - DNA, 682 bp, Homo sapiens
  misc_feature: GYAE6OF02HCLSG.1.34.D01.1.454.CMB.1.raw
  modified_base (102)..(102): a, c, t, g, unknown or other
  misc_feature (102)..(102): n is a, c, g, or t
  modified_base (191)..(191): a, c, t, g, unknown or other
  misc_feature (191)..(191): n is a, c, g, or t
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
  modified_base (459)..(459): a, c, t, g, unknown or other
  misc_feature (459)..(459): n is a, c, g, or t
  modified_base (670)..(670): a, c, t, g, unknown or other
  misc_feature (670)..(670): n is a, c, g, or t
tcagacgagtgcgtcacgaccggtgctcgatttagatcgtctgtgttggggtttgggggagtcacgaccctgtcaggacacagcatggacatgaggtcccgntcagctcctggggctcctgctcgctctggctcccaggtaccagctgtgacatccaattcgcccagtctccatccctcctgtcctagccntctagttggagacagtacgtccacctagttactcgttcggccgggcgaacggtccgacggtaccagtcaacggtcgttaactttccgttagccgttaggttcgcgagacaacgaaacggnggccgacgtcccgngaacgtctacggtacgtactggtacggtcacgtactcgagtagtgtccgtaggggtccggttcacgtcgtaggttcgagttgggactagtcgctacgtcggaaggctaagtactaccgcttactcgtaacttancgaacgtcgacgtactggaccgtacgtacctaggtacgttctttaacggtctttaaatttttcgtaccgtagttaacaaccgtttaagtttcttaaacgtaccgttaacctttcgggtacgggttacccgacccggggttagggaacccgggttaaacggtagggttacccgaaaccggtaccggtaaccggtaaggtccggtttacggcnccgggttaaccc

SEQ ID NO: 217114 - DNA, 737 bp, Homo sapiens
  misc_feature: GYAE6OF02F4SNJ.1.34.D01.1.454.CMB.1.raw
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttggggtttgggggagtcagaccctgtcaggacacagcatggacatgacgggtccccgctcagctcctggggcctcctgctgctctggctcccgaggtaccagctgtgacatccaattcgacccagtctccatccctccctgtctcgcatctagttggagacagagtcaccatcacgttggccgggcgacgtcacggccagtcagcgattcttagcctggtcgcagcaagaaaccngggacgacgccccacgagntcggtatcgtagtgtcgcagtcgtagtacgttgacgaaggtcgggtaccacgtccgtaggtacgaggtcggacacggtagctaacgtcgtagggaccagtaacgttaacacttacctcgtaacgtactacgaacgcgtacggtccctggacctacggtacccgttaacgtaaagttaccgttttaacggacctttaaagtttacgttttaacgttaacttaacccgaaaacgtttaaccggttttaaatttaaccggtaaacccgggtttaaccccgttaacgggttacccgggtttaaacccgggttacccgggtaaacccgggtaaaccggggggtaaaccccgttaaaacgggggttaacggtaaaccgggttaaaccccgggttaaacccgggtaacccgtttagggtaaccgggttcccgtacgtaaccccg

SEQ ID NO: 217115 - DNA, 901 bp, Homo sapiens
  misc_feature: GYAE6OF02HYITI.1.34.D01.1.454.CMB.1.raw
tcagacgagtgcgtcacgaccggtgctcgatttagatcgtctgtgttgggtttggtcatggacatgagggtccccgctcagctcctggggctcctgctgctcgtggcctcccgacggtaccagtctgtgacacttacctaagttccgacccgtagttcctacctacttccccttcccttgttccgtgtactacttacgttagttaggacgaacgaggtacgtaccaacctactacctacggttcggacccgggacgtacggtacgacggacctactacgtacgtacgttacgttttaccgtttaacggtccgttgggttcgacgtacgaacgaaacggtaaaaccggacggggtacccgacccggtacccctacgaacgttacgttacggttacgttacgttacggttggtacgactactaccggtaagttacgttacggaacggttacggggtccggtaccctacggtaccgttacggttacgtaggtcggacgtaggtcgtacgtacgttacgggacggtaactacgttaacttaacctaccgttacctaactacgttactacgtacgaccgtacgtcgtacggtaccgtacgttaccgtaagttaacgtttacgttacgttaacgtttaactttacgttaacgttaccgtaacgttaacgtttaacgtttaaccttaacggttaaccccgttacccgttaacgggttaccgggttacccgggtaacccgggaacgggtaaaccgggttaaccgggtaaacgggttaaccggtaaccggttaccgtaacccggttaaggtccgggttaccggtaaccgttacggtaacccgttaacgttcgtttaccgttaccgtttaacctacccggtttaccctttaccccgttaccccgttacccg

SEQ ID NO: 217116 - DNA, 975 bp, Homo sapiens
  misc_feature: GYAE6OF02H7J4D.1.34.D01.1.454.CMB.1.raw
  modified_base (82)..(82): a, c, t, g, unknown or other
  misc_feature (82)..(82): n is a, c, g, or t
  modified_base (203)..(203): a, c, t, g, unknown or other
  misc_feature (203)..(203): n is a, c, g, or t
  modified_base (962)..(962): a, c, t, g, unknown or other
  misc_feature (962)..(962): n is a, c, g, or t
tcagacgagtgcgtcacgaccggtgctcgatttagatcgtctgtgttgggtttgggggagtcagaccctgtcaggacacagnatggacatgagggtccccgctcagctcctggggctcctgctgctctggctcccaggtaccagctgtagacataccaattcgacccagtctccatcctcctgctgctatctagttggacganagtacgtccaccgatcgtacttcggaccggggtactaagtcgaaggtcccaagttacgaagtacggtaacttttccgttttaaggccctgggtttagaccgtaacgtcgaaaggtaaaacccaggggtacccgaacggtaccccccctaagtaacggtaacgttacggtacgttacgttaacgttcgggtacaccgtaacttacccggtaagtacgttacggaccgggttaaacggggtccggggttacccctaacggttacccggtaagggtttacgtacgggttacgggtacttacggtaacgtccgttaacggttacggttacgggggaaacctacggtttaaacgtttaaacccgtaaccgttttacccgttaaccgtaaacccgttaacgtttaccgaaacggtttaccccgaagggttacccttaccgggttaacccgtaacgggttaacccggtttaacgggtaaaacgtttaacggttttttaccggaaacgttttaaaaccgtttttaccgtttttaaacggttacgttaaacccgggtttaaacgtttaaaccggtttaaacgttttaaaacgttaccccgggttttaaacccccgggtttaaacggttaccgggtttaaacccggggttttacccggggaacccgttaaaccggggggttaacccggtaaaacgggggtttaaccgtaaaccggggttaaccctaaaaccggggtttaacccgttaacggggttacttacccggggtnttaaaccccccgg

SEQ ID NO: 217117 - DNA, 798 bp, Homo sapiens
  misc_feature: GYAE6OF02IRL2X.1.34.D01.1.454.CMB.1.raw
tcagacgagtgcgtcacgaccggtgctcgatttagatcgtctgtgttgggtttgggggagtcagaccctgtcaggacacagcaatggacatgagggtccccgctcagctccgtgggctcctgctgctctggctcccaggtaccagctgtgacatccaattcgacccagtcctccatccctccctgtctagatcgtattggacgacagagtaccacctactctaaccgttcggccgggacgtacgtcgacggaccatcgaagcgttatttcgttacgccgtggttcacgacgtaccaaacggaaccgcgggccgaccgtaccccgtacgacgtacgttcgttacgttcctagttggtacaaccgtaccgaagttacgttggaccggtaacggggttccggtaccctaagtccgtaaggtttaccgagttcggaacgtacggtagtaccgtcgttacggacggaactacgtacgttaaccctcgtacccttacgtaacgttaacgcctaacggtccgtaccggtaccgttggaaccccggttcgtaacggttaaccggttaagttttaccgtttaacgttaaaccttttaagtttttacccgaacgtttaaccggtaaacctttaaacgttacgtttaaaccgtttaaacccgtttaaaccccgtaaaccggtttacggggtacccggttaaccggtcccgggaaagggtaaccccggggtaagttaaaccggtcggttaaccgaaccgttaaaccgggtagttcggtaccgtaaaccggtcgtacccgtaatttcccgg

SEQ ID NO: 217118 - DNA, 889 bp, Homo sapiens
  misc_feature: GYAE6OF02JT1B8.1.34.D01.1.454.CMB.1.raw
  modified_base (566)..(566): a, c, t, g, unknown or other
  misc_feature (566)..(566): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggcctcctgctgcctctcggcctcccgaggtacccagccttggtacgactactccaattcgaccctagttcctccacttccctcccttgttcctgacctagttcttaagttcgggaacgaaccggaaggtaccgttccaaccttacgttaccccttaagttcggggaccccggggtaaccgacgttaccgacggtacccctaagttcccgaacggtttccggtaaagtttttccgttttaaccgggccccgttaaggggtttcgaaccgtaacggaccgaaacggaaacccggtcggggcccgaacccgtccccgttaccgaagtaccggtttcttacgtacgtaaggtccgggactcctaacgttccaaggttcgttacggaccgggttaacggggtccggttacccaacgttcccggtaagggtttccaagggtcggtaactcgggtntaccgttacgtacggtacgggtaaactacggtaaccttacggtaccttcgtaccgtaacttccgaccgtacggaccgttacgaaccccgtttggaaaccctttaccggtaaccggttaaacggttaacggtttttactttaccggttaaacttttaaacgtttacccggtttactaaacccgggtacttaaacgttacgtttaacgttaaaccgtaaccggttaccgttacggtaccggttacggtaccggtaacggacccggtaaggtacggttaacgaaccggttacccgaacgtcgttgggacctaccggttacaacccg

SEQ ID NO: 217119 - DNA, 772 bp, Homo sapiens
  misc_feature: GYAE6OF02I1LJC.1.34.D01.1.454.CMB.1.raw
  modified_base (153)..(153): a, c, t, g, unknown or other
  misc_feature (153)..(153): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggcctcctgctgctctggcctcccaggtaccagctgtnacatccgaattcgacccatctccactccctccctgtctgcacttctagtggacgacgagacgtaccacctatcctacgttcgggcccggggacgtacgtaccgacggccctagtccgacgtccgttaacttttccgttacggtcccgttgggttccgacgtaacggaacccgaaacggtaaaaaccccgggacggggggaccctacccggacccccgttaacgaggttaaccggttcgggttaacgttaccttaggtcgggtactaccgttactacccgtagtacgttacggaccggtaacgggggttcccggtacccctaacgtcccggttacgttcgaaggttcggacgtgttacgcgtacgtacgagggtactaacgtactacctcttctaactacgtactcgacgactcgtactcgggctacgtaccgtaagttagttacgttcgttaaattaattttaccgtacgtaactaaccgaagtttacgtttaactaccggtttaacccgtaacccggtttgggaccggttaaccgtccgggtaaacccggacgggttaaacggtaagggttacgttaaaccgaaccggacggttaccgtacggcggtaccagtacccg

SEQ ID NO: 217120 - DNA, 676 bp, Homo sapiens
  misc_feature: GYAE6OF02JP5YO.1.34.D01.1.454.CMB.1.raw
  modified_base (126)..(126): a, c, t, g, unknown or other
  misc_feature (126)..(126): n is a, c, g, or t
  modified_base (142)..(142): a, c, t, g, unknown or other
  misc_feature (142)..(142): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (332)..(332): a, c, t, g, unknown or other
  misc_feature (332)..(332): n is a, c, g, or t
  modified_base (390)..(390): a, c, t, g, unknown or other
  misc_feature (390)..(390): n is a, c, g, or t
  modified_base (611)..(611): a, c, t, g, unknown or other
  misc_feature (611)..(611): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctntggctcccaggtaccngctgtgacatcccaattcgaccctagtcctaccagtcccctccctgtcctgacattctagttgganacagngtccaaccattcctactggaccgggctaagtccaaggccatcgacgctattcttagccttaggtnctagacaacggaaaccgngggtaccaccgtcccctacaggaacttcggacgttntacgtgggtcacgtactccgagttactcgggacgtaaacgggggttccggtaaccccncgttaccggtaacgtttcggtaaggtcgaaccggtgtccggaacctgtacccggttagggaccttaaggtacctacgtacctacgtacctaacttacgtacacggacctacggtcctccggacgactccgttaaggtaactttcgtttacgaccttttaagtacctttacgtagacttaacggtattcgtaaacgttacctaccggttagccgggtttacnccggtaaggaggtaaccgtaaggtacggaacctaacgtaccgttatcgggagtaccgcgtaaccg

SEQ ID NO: 217121 - DNA, 720 bp, Homo sapiens
  misc_feature: GYAE6OF02IMVQG.1.34.D01.1.454.CMB.1.raw
  modified_base (130)..(130): a, c, t, g, unknown or other
  misc_feature (130)..(130): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
  modified_base (439)..(439): a, c, t, g, unknown or other
  misc_feature (439)..(439): n is a, c, g, or t
  modified_base (626)..(626): a, c, t, g, unknown or other
  misc_feature (626)..(626): n is a, c, g, or t
tcagacgagtgcgtcacgaccggtgctcgatttagatcgtctgtgttggggtttgggggagtcagaccctgtcaggacacagcatggacatcggacgggtccccgctcagcctcgtggggcctctggtcngtcctggtcgtcccacggtacctacgctcgtgacatccctactgtacccactcgcctcaccttcccgtcgtctcgtcactccttattgggacgtacgacgngtccaaccctntacctaccgttcggtcccggggacaccggaccggtccgaccggtcctagtacgtaccgtcgttacggttcttcgggcgttacggtacacgtaccccggaacgggaaaccggccgggccgggtaacccctcggtaccggnttacgcgttacggtactccgggttagtnaccgtacacgtacgggtcgcggttacgggnggggttaccccacggttcggtaacggtttccggtaacgcgtcggtaacgcgttaagccggtagtccggtacggaacgtgttaacctactaccgtctaacgtacgtacgtacgccgttaagccgtacgccgttacggcgttacgtagtacgttattcccgtaatattctaactctagactcgtacgtntaccgtaccgtggtaccgtacggctagggttccgaacggttcggtaacgtacggtaaccgtcggtacgacggacttacggtacgtacgttaccg

SEQ ID NO: 217122 - DNA, 910 bp, Homo sapiens
  misc_feature: GYAE6OF02FQKB6.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccgaggtaccagctgtgacatccaattcgaccctagtctccactcctccctgtctgctattctagttggacgaacagacgtaccacctatcgtacgttcggccgggacgagtcgacggcctaatccgagtccgtactttccgttttacggtccgttgggttcgccgaaggtaccgaaacgggtaaaacccggacggggacccgtaaccggtaccccccgtacgtaaggaacgtttccgggttaaacttccggttaaggtttcgggtaccgtaacctacggttacccgaaggttaaagttcggaaccgggtaaccgggggttccggggttaccccttaacggtcccgttagggttacgaacgggttgggtaccgttaacgggtcgtacgttaacggttccggtaacgggtaacgttaaacggttacctttaacccaccgttttaccgttaactaaacccggttagtaccgtaccggaacccggtaccggcccgttaccgggactacccggttacggtacgttaaaggttttctttaaccgtaaccgtttttaaattttaaccgttacgtaacggtaaacttaacgtttaacgtttaacgtttacccggtttaaacccggttaacccccggtttaagggggttacccgggttaacccgggttcccggggtaaacccggggtaaacggggtttaaccccgggtaaaggggttaaccggtaccgttaaccggttaaacccggggttactacggggtttacccgtcggtaacggtaaccccc

SEQ ID NO: 217123 - DNA, 809 bp, Homo sapiens
  misc_feature: GYAE6OF02JIQTE.1.34.D01.1.454.CMB.1.raw
  modified_base (100)..(100): a, c, t, g, unknown or other
  misc_feature (100)..(100): n is a, c, g, or t
  modified_base (148)..(148): a, c, t, g, unknown or other
  misc_feature (148)..(148): n is a, c, g, or t
tcagacgagtgcgtcacgaccggtgctcgatttagatcgtctgtgttgggtttggggagtcagaccctgtcaggacacagcatggacatgaggtccccgntcagctcctgggctcctgctgctctggctccaggtaccagctgtgacntccaattgacccagtcttaccatccctcctgtctgcatctagtggagtacagacgtccactagtcctacgttcggacccgggtacgacgttccaacgggtcccaattcccgaagccgtaacttttacgttacgtcccgttggttacgcgtacgaccgtaacgaaacccggtcggggaccgtaccgacccctcgaacgtacgtaccggtacgttaccttaagtcggttcgaccgtactacccgaagtacgtttcggacgtaaaggggttcccgggtaccctacgtaccgttaacgggttcctaggtcggacgtacggtacgtctacgttcgtagggacgaggtaaccttaccgtaaccgttcgtaaccgtaacgttacgtaccggtacgacgtaccgtcctacggtctaaccggtacccttaaggtaaaccttagttttacccggactttaaaacgtttacgttaaccgtttaacgttaaccgtaaacgttaacggttacgttttaaaccgtacccggttaacccgtttaacgggtaccgggttaaccggtttacccggggtaacccggttaccggggtaaaccctaaagggggttaccgttaaacggtacccgtaaaaccggtacccggtacggtttaacggtaccgttacggtaaccccg

SEQ ID NO: 217124 - DNA, 624 bp, Homo sapiens
  misc_feature: GYAE6OF02FO7PE.1.34.D01.1.454.CMB.1.raw
  modified_base (200)..(200): a, c, t, g, unknown or other
  misc_feature (200)..(200): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
  modified_base (576)..(576): a, c, t, g, unknown or other
  misc_feature (576)..(576): n is a, c, g, or t
  modified_base (585)..(588): a, c, t, g, unknown or other
  misc_feature (585)..(588): n is a, c, g, or t
  modified_base (590)..(590): a, c, t, g, unknown or other
  misc_feature (590)..(590): n is a, c, g, or t
  modified_base (592)..(594): a, c, t, g, unknown or other
  misc_feature (592)..(594): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
  modified_base (603)..(605): a, c, t, g, unknown or other
  misc_feature (603)..(605): n is a, c, g, or t
  modified_base (607)..(607): a, c, t, g, unknown or other
  misc_feature (607)..(607): n is a, c, g, or t
  modified_base (609)..(610): a, c, t, g, unknown or other
  misc_feature (609)..(610): n is a, c, g, or t
  modified_base (614)..(618): a, c, t, g, unknown or other
  misc_feature (614)..(618): n is a, c, g, or t
  modified_base (620)..(624): a, c, t, g, unknown or other
  misc_feature (620)..(624): n is a, c, g, or t
tcagacgagtgcgtcacgaccggtgctcgatttagatcgtctgtgttggggtttgggagtcaggccatcagcgattctttagcctggttgcagcagaaaccaggggcgagccctcagatcggtagtctatggtgcatccagattgcaaggtgggtcccatccaggttcagtgcagtgcactcgaggacagattacactcncacgtatcgagtcacgcctggaccagtccgtaggtaagttacttttcggacctttaaattttacttaccgtagtaccgaaacttacgttaatttacgttaaaccggtaccccgttaaggttccgggtaaccggtttccgggacggtaccgggggggtaccggttaaaggggttacgggtaagtaacccggtaaaccgtaacggttgggtaccggacggttacgacgtaacctacgttcgttaacggtcctttacgtacgttccccgtttcccgaccgtagttacccaggtaacccgtactacccgttccttacggtcggaaccgggtcggtacgacggaccggtacggacgtatagtaacggntacgancgatcancgtaacgcnnnncntnnngncgntgcnnngngnncgcnnnnngnnnnn

SEQ ID NO: 217125 - DNA, 573 bp, Homo sapiens
  misc_feature: GYAE6OF02FKL9X.1.34.D01.1.454.CMB.1.raw
  modified_base (142)..(142): a, c, t, g, unknown or other
  misc_feature (142)..(142): n is a, c, g, or t
  modified_base (226)..(226): a, c, t, g, unknown or other
  misc_feature (226)..(226): n is a, c, g, or t
  modified_base (294)..(294): a, c, t, g, unknown or other
  misc_feature (294)..(294): n is a, c, g, or t
  modified_base (311)..(311): a, c, t, g, unknown or other
  misc_feature (311)..(311): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (454)..(454): a, c, t, g, unknown or other
  misc_feature (454)..(454): n is a, c, g, or t
tcagacgagtgcgtcacgaccggtgctcgatttagatcgtctgtgttgggtttgggggtagtcagaccctgtcaggacacagcatggacatgagggtccccgctcagctctgggctcctgctgctctggctcccagtaccanctgtgacatccaattgacccagtctccatcctccctgtctgcatctattggagacagagtcctaccatctaaccttgcccgggngtagtcagggcccatcagcgattcttagccgttgtgtccagtcagaaaccgtgggcctacgcccctanagatcgtatctatggtnctataccagtattgcgaagggtcgggtcccagtcagggttccaaggttcggctaggtcgtacatcggnggtacagtnttacactcactactntcgatcacnccttgcacggtcctagagttattttcgactaattacttacgngtaactaagtagtactttagtaacttacccctaaggttacgaccttcggggtaaccgtacggggaacctaagggtaggaacctacgaaaccgtaccggttgtccggtaggttcgaaccg

SEQ ID NO: 217126 - DNA, 655 bp, Homo sapiens
  misc_feature: GYAE6OF02HROCV.1.34.D01.1.454.CMB.1.raw
  modified_base (198)..(198): a, c, t, g, unknown or other
  misc_feature (198)..(198): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (422)..(422): a, c, t, g, unknown or other
  misc_feature (422)..(422): n is a, c, g, or t
  modified_base (459)..(459): a, c, t, g, unknown or other
  misc_feature (459)..(459): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatccctcctgtctgcatctatgganacgagagtcaccatcacttcggccgggcgagtcgacggccatccgagtcgtatttctttagccttggttncgagcaagaaaccgngggaccgacgcccctgagtagtcgtagtctagtggcacactccagtagttggacgtacggggtcgggtacccagtccgtaggttcgtagtggcgtagtcgctagtcgtagggactagtacttactactcctactaactntacgagcacgtccaggccacgtcgttaagtaacgttnttttacggaactttaacttttactacgttacgtaacgttaaccgtaagtttaaccttaaccgttaacccggttacccgttacgggttaccggttaaccgggttacccggggaaccgggttaacggggaacccgttaaggggtaacgtaaccgtaacccggtaacggtaccgttcgggtacggtacctacggaaccc

SEQ ID NO: 217127 - DNA, 560 bp, Homo sapiens
  misc_feature: GYAE6OF02GRWOS.1.34.D01.1.454.CMB.1.raw
  modified_base (131)..(131): a, c, t, g, unknown or other
  misc_feature (131)..(131): n is a, c, g, or t
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (509)..(513): a, c, t, g, unknown or other
  misc_feature (509)..(513): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
  modified_base (531)..(532): a, c, t, g, unknown or other
  misc_feature (531)..(532): n is a, c, g, or t
  modified_base (534)..(536): a, c, t, g, unknown or other
  misc_feature (534)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (542)..(545): a, c, t, g, unknown or other
  misc_feature (542)..(545): n is a, c, g, or t
  modified_base (548)..(548): a, c, t, g, unknown or other
  misc_feature (548)..(548): n is a, c, g, or t
  modified_base (550)..(551): a, c, t, g, unknown or other
  misc_feature (550)..(551): n is a, c, g, or t
  modified_base (553)..(553): a, c, t, g, unknown or other
  misc_feature (553)..(553): n is a, c, g, or t
  modified_base (555)..(559): a, c, t, g, unknown or other
  misc_feature (555)..(559): n is a, c, g, or t
tcagacgagtgcgtcacgaccggtgctcgattagatcgtctgtgttgggtttgggagtcaggccatcagcgattctttagcctggttgcagcagaaaccagggcgagcccctcagatcgtagtctatggtncatccagattgcaaggtcggggtcccatccgaggttcagtggcagtgcatcgtgggacagattacactctcactatcagcacgcctgaccacgcctagaagtntttcgacttaatttattactgtacanagttattactaccgtaccctaggttacggtaccgtcggaccggaaggggaccgtaagggtaggtaacgtaccaaccggtacttggcgactacgaccaccctagttcttacgttaccttacgactttcccgtcccacttaacgttccgtacgaaccgaccttaccgtacggtcgtacggtaccgggcgggtcctacggtaaccgggaaccggtcgtaaacgtagtacgctaggactgacgnttacntacnnnnntacacgngtgngcgtncnncnnncngngnnnntananncncnnnnnc

SEQ ID NO: 217128 - DNA, 689 bp, Homo sapiens
  misc_feature: GYAE6OF02F3L5B.1.34.D01.1.454.CMB.1.raw
  modified_base (223)..(223): a, c, t, g, unknown or other
  misc_feature (223)..(223): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagctattcttagccttggttgcagcaagaaaccgagggcgacgcccctacagatcgtagtctagtggtcgctactccagtattgacgtaaaggggttcggggtacccacgttaccgtaacgggttcgagggtggacgtaggtcgtacgtaagttcggtaggggaacctaaggttaactttaaaccaccttacgtacctaacgttaactcgaacgtacgtaaccgtccctaggacctacgtacccgttaggtaagttactttttaggactttaaagtttacgtttactacgttaacctaaattaggtttaaactttacgtaaccggttaaccccttaagggtaccggttaaccgggttcgggtaacccggtaacgggggtaaacccgtaaggggttaacggaaaccgttaaccgaaaccggttaacggttcgggtaacgtcgtaccgtaacccg

SEQ ID NO: 217129 - DNA, 705 bp, Homo sapiens
  misc_feature: GYAE6OF02G6TO7.1.34.D01.1.454.CMB.1.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
tcagacgagtgcgtcacgaccggtgctcgatttagatcgtctgtgttggggtttgggggagtcagaccctgtcaggacacagcatggacatggagggtccccgctcagcctccgtggggctcctgctgcctcgtggcctcccaggtaccagtctgtgacactaccaattcgacccagtcctccactccctccctgtctgcatctagttgganacagngtccacatcacgttcggccgggagagtcgacggccatcgagtcgtatttacgtttacgccgttggttgaccgagacgaaacggaaaccggagggtaccgaccgtccccctagacgtacgttacggttacgtacctaggttcggtcgtaccaccgttaccgaaggttacgtttacgggaccgggtaacgggggtcccgggtacccacgttaccggtacgggtttaccgagggtcggactaggcgtaacgcgttcgggtagggaactagtaacttaccgtactcgtactaactactcgacgaccgagcctacggactaccggaccttaggtaaacgtttatttacgtacttaaagttttactacgtacgtaactaagttacttaactttacggtacccgtaccgtacggttacgtaccggttcggaacggaccgggttaaggaacggtacgggtaacctaccggaacgtagttacggtgccgtacacccg

SEQ ID NO: 217130 - DNA, 775 bp, Homo sapiens
  misc_feature: GYAE6OF02IETYH.1.34.D01.1.454.CMB.1.raw
  modified_base (184)..(184): a, c, t, g, unknown or other
  misc_feature (184)..(184): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccatccctcccgtntctgctattctattggatacagacgtcaccatccacgttggaccgggcagtcgacggccagtcagctatttcttacgcctggttgcagactaagaaaccgngggtacacnccccgtacagtactcgtagtctagttcggtcgcactctagtatcggtacggtaacgggtccgggtaccctagtacccggtaggttaccgtaggtaacggtcgtacggttcgtaccggtacgttccggttacggggaacctaacggtttaaccgtttaaacccgtaccggtttaaccccttaaccgtaaaccggttacttaaacccggtaaaccggtaccgttaaaccgggttcccgttaaccgggttacccgtaaaccggttacccggttaaacggttaaaccgtttaacgtttttaaccgggttaattttaaaacctttttttacggtaaaccgtttacgttaaacgttaacgttaaacgtttacttaaacgtaaccggtttacccgttacggtaccggttacggttacccggtaacgggaacggtacggtaaggtacggtaaccgtacgtaaccgtaagtcggttacgcgtactaaccg

SEQ ID NO: 217131 - DNA, 685 bp, Homo sapiens
  misc_feature: GYAE6OF02F9603.1.34.D01.1.454.CMB.1.raw
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
  modified_base (475)..(475): a, c, t, g, unknown or other
  misc_feature (475)..(475): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggcctcccaggtaccagctgtgacatccaattcgaccctagtcctccactcctccctgtcngcatctatgganacagngtcaccatcacgttggccggnaagtcaggcctatcgagtcgtatttacttacgccgttggttcacgacgacgaaacggaaaccgngggaccgtaaccggcccctagacgtacgtacgtagtcgtagttggcgtactcgtacagtagttcgaacggtacgggtcggtaccctagtcccgtagttcgaaggtgaccgtagtcgtacgtagtcggtacggaacagttactaacgtactctacgactacgtcgtaaccgcgtacgtacccgtncgaaccgttcgtacgttaaacgtttatttaccgaacttttaaactttcgttactacgtaacgtaacttaaggtttaacctaaaggtttaccccgttaaccgttagggttaccggttaacggttacccgggtaaacggtaaccgggtaaccgtaaggggttaacggaaccgttaaccggaacgttacgttacggcgtacggtactaacccg

SEQ ID NO: 217132 - DNA, 441 bp, Homo sapiens
  misc_feature: GYAE6OF02HZ3DK.1.34.D01.1.454.CMB.1.raw
  modified_base (258)..(258): a, c, t, g, unknown or other
  misc_feature (258)..(258): n is a, c, g, or t
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
  modified_base (427)..(441): a, c, t, g, unknown or other
  misc_feature (427)..(441): n is a, c, g, or t
tcagacgagtgcgtcacgaccggtgctcgatttagatcgtctgtgttggggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgccagcctagaagtattttgctaattttattactgtacaaacngttattagtacgtaccccctaggtggaccgttcggaccaagggggaccaagggtggaagtcgaaaccgaactgtggacttgacaccagttctcgtcttacacgttccttccccgccctccgtaccacgcaccttcgtactgggcncggggctggacacggccncatagnnnnnnnnnnnnnnn

SEQ ID NO: 217133 - DNA, 807 bp, Homo sapiens
  misc_feature: GYAE6OF02H5I16.1.34.D01.1.454.CMB.1.raw
  modified_base (536)..(536): a, c, t, g, unknown or other
  misc_feature (536)..(536): n is a, c, g, or t
  modified_base (547)..(547): a, c, t, g, unknown or other
  misc_feature (547)..(547): n is a, c, g, or t
tcagacgagtgcgtcacgaccggtgctcgatttagatcgtctgtgttgggtttgggggagtcagaccctgtcaggacacagcatggacatggacgggtcccccgctcagctccgtggggcctcctgctgctcgtggcctcccaggtaccacgcttgtacgacattacccgtaattaccggaccctagtcctccacttccctccctgtctgcctacttacgttagtaggacgtaaccgaggtactccaacctactccgtacgttcggccgggacacggtcgacggtaccagtcgaaggtcgtacgtttcgttacgtcgttggtcgcacgaacgtaacggaaccggcgggtaccgaccgacccccgtagacgtacgttacgacgtttacgtacggttcgggactaccgtactaacgtagtacgtaggaccggtacggggtacccggttcccagttaccgtagttaaccggtagtacggacgtaggtcgacttacgggtcggtaacggtagactaacttaccaccttccactacgtacncgacggaccgngtccgacggtctaaccgtacggttaacgttaacgttagtaaccgttaatttaaccgtttacttaaccggttaacgtaacgttaaaccgtttaacgtttaaaccgttaacccgttaacccggttacccgggtttaacgggttacccgggttaacccggtacccggggaaccgttaaaccggggaacgggttaaacgggtaaccgttaacccggtacggttaacccggtaccggttcggtaacgtacccgtaccgtacccgg

SEQ ID NO: 217134 - DNA, 744 bp, Homo sapiens
  misc_feature: GYAE6OF02I3B0O.1.34.D01.1.454.CMB.1.raw
  modified_base (182)..(182): a, c, t, g, unknown or other
  misc_feature (182)..(182): n is a, c, g, or t
  modified_base (365)..(365): a, c, t, g, unknown or other
  misc_feature (365)..(365): n is a, c, g, or t
tcagacgagtgcgtcacgaccggtgctcgatttagatcgtctgtgttgggtttgggcatggacatgagggtccccgctcagctccgtggggctcctgctgctctggctcccaggtaccagctgtgacatccaattcgacccagtcctccatccctccctgtctgcatctagttggagacagngtcaccatcacgttggccgggcgagtcgaggcctaatcgacgtcgtatttaccgtttacgccttggttgaccaggacaacggaaaccgaggggccgacgcccctgagactacgtagttctagtggtgcatccgagtagttgacgtagggttcgggacccagttccgtacgttgacggtgacgnggttacgctacgtcgtacggacgagtaactactacctctactactaacgtctaggacctacgtacccacgtaccgtacgtaccgttaaggtaaagtttacgtttacgttaacttttaattttaacgtttacgttacgttaaccttaagtaacgtttttaactttaaacggtaacccggtttacccgttacgggttacccgggttaaccggttccgggtacccggttaaacggggtaaccggtaagggttaaacgggaaccggtaaccccggtaaccgttaacggttccggtcggttaccggtaccgtaaccggtaacctaccgtttcggttaccggtttaccgtttaccgttaccctttccccgggttacccttaccgg

SEQ ID NO: 217135 - DNA, 621 bp, Homo sapiens
  misc_feature: GYAE6OF02IM02A.1.34.D01.1.454.CMB.1.raw
  modified_base (261)..(261): a, c, t, g, unknown or other
  misc_feature (261)..(261): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctcctgtctgcatctattggagacagagtcaaccatcacttcggccgggcgagtcaggccatcagcgtattcttagccgtggttncagcgaagaaaccgagggacgacgcccctagacgagtcgtagtccgtaagtggtgctacgtccaagtattgacgtaagggttccgggtcccagttcccgtaggttcaaggtggacgtagtcgactagtcggtagggacagtaattaccgtactctactactactcgacgacgtacgcctgaccacgccgttaagtaacttagtttacgacttaaagtttacttacgtactaactaagttacgttaattaacttaacccgtacccttaccggtacggtaccggttacggaaccggtaacgggaacgtaacgggttacgaaacgttaccgaaaccggtacgtacggtacggccgtagaaccg

SEQ ID NO: 217136 - DNA, 638 bp, Homo sapiens
  misc_feature: GYAE6OF02HXWRY.1.34.D01.1.454.CMB.1.raw
  modified_base (152)..(152): a, c, t, g, unknown or other
  misc_feature (152)..(152): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (292)..(292): a, c, t, g, unknown or other
  misc_feature (292)..(292): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacntccaattgacccagtctccatcctccctgtctgcatctatgganacagngtcaccatcacttcggccgggcgagtcacggccatcgagcgtatttcgttagcctggttcgcagacaagaaaccgagggccgacgcccctnacgtatcgtagtctagtggtcgctactaccgagtacttggacgtaagggttcgggtcccaacgtccgtaggttcaggtggacgtaggtgctaagtccggtagggactacgtaatttaccgactccgtactaactactcgaacgctacggtcctagcctacgtacgtacgtaaagttactttacggtatttaaacgtttacttactacgtaactaaccgtaagttttaacgttaacgttaacccgttacccgttagggttacggtaccggtttacggaccgggaacgggtaacgtaagggtacgtaacggtacccgtaacggtacgttggtacgtccgtcgtaaccc

SEQ ID NO: 217137 - DNA, 522 bp, Homo sapiens
  misc_feature: GYAE6OF02GF67A.1.34.D01.1.454.CMB.1.raw
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggngagtcaggccatcagcgattctttagcctggttncagcagaaaccagggcagcccctcagatcgtagtctatggtgcatccagattgacaaggtcgggtacccatccaggttcaggtggcagtgcatcgtgggacagtattacatctcactatcagcacgcctgcagcctagatatttcgattaatttatactgtacaactagtaattanacgttaacccgtagttcggtacgttcgggccgtaggggaaccaaggttaggaacgttaccaaaccgggtaactggtacggtcctagacccg

SEQ ID NO: 217138 - DNA, 747 bp, Homo sapiens
  misc_feature: GYAE6OF02GR8AF.1.34.D01.1.454.CMB.1.raw
  modified_base (351)..(351): a, c, t, g, unknown or other
  misc_feature (351)..(351): n is a, c, g, or t
  modified_base (730)..(730): a, c, t, g, unknown or other
  misc_feature (730)..(730): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattcgacccagtctccatccctccctgtctgcatctagtggagacagagtcaccatctacgttcggccgggcgacggtcgacggccatcgagcgtatttctttacgccgttgggttcgacgacgaccgaaacgaaccggacggggaccgaccgtcccctacgtagtacgttacggtacggtctaggtcgggtcncgtactaccgagtacgtacggacggtacggggtcgggtaccctacgttccgacgggtttcgagggtcggacgtagggtacgcgtacgttacggtgggaacctaggtaacctttaccgaccttcctaacctacgttctacgacgtcgtaacgtccgttacgaccgtacgtacgtagttaaacgttgttttaccgtaactttaaacgtttttccgtacggtacttaaacctaacgttttaatttaaaccgttaccgtttaaccccgtaacccgggtttacggtaccggggttacccggttaaccggggaccgggtaaacggggtaacccgtaaggggtacccgggtaaacgttaccgaacccgggttagttccggggtaancccggttacggaacccc

SEQ ID NO: 217139 - DNA, 697 bp, Homo sapiens
  misc_feature: GYAE6OF02FSKAT.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatccctccctgtctgcatctattggagacagagtcaccatcacgttggccgggcgagtcacggccatcgagcgattcttacgcctggttgcagcagaaaccgagggcgacgcccctcagatcgtagtctatggtgcatccgagtattcgacgtaagggtcgggtacccagttacccgtggttcaggtcggacgtaggtcgactacgtcggtaggggactagtactttaaccacctttcgtacctaacttactacgacgaccgacggtcccgtgaccgtacgtccgttaggtaaacgtttagttttacggacttaaatttttacgttaacctttaggtaaccttaaacgtaagtttaaactttaaccgttaaccggttaacccccgttaagggttaccgggttaccggttaccgggacccgggtaacggggaaccgtaaacgggtacgggtaaccgttacccgtaacccggtaacggttcggtacggtacgtccggaccttaaccgtacttccgttacgttccgttactacctttccccggtacccctaccg

SEQ ID NO: 217140 - DNA, 790 bp, Homo sapiens
  misc_feature: GYAE6OF02H0A4G.1.34.D01.1.454.CMB.1.raw
  modified_base (128)..(128): a, c, t, g, unknown or other
  misc_feature (128)..(128): n is a, c, g, or t
  modified_base (144)..(144): a, c, t, g, unknown or other
  misc_feature (144)..(144): n is a, c, g, or t
  modified_base (309)..(309): a, c, t, g, unknown or other
  misc_feature (309)..(309): n is a, c, g, or t
  modified_base (550)..(550): a, c, t, g, unknown or other
  misc_feature (550)..(550): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctntggctcccaggtaccngctgtgacataccaattcgaccctagtcctccatccctccgtgtctgcatctagtggagacgagacgtcaaccactctacgttcggccgggtacgacgtcgacggtccactcgagtcgtactttccgtttacgccgttgggtcacacggtacaacggaacccggngggacccgacgtccccgttagaacgtcgtaccggtagttaccgtagtcggtacgacctacgtaccggagttacgttacggacggtacggggttccgggtacccaagtcccggtaggtcgtacggtgaccgtgtcgacgttacgtcgtacgggtactaacgtacttaccgtaccgttctaacgattacgccgtaacgtcgactacccgtaggacccgtacggtaccgttaagttaacgtttntttaacccgaacttttaaagttttcccgttaacgttacgtaaccgttaacgttaaacggttttaactttaaccgggtaacccgtttaaccccggtttaacgggttaccgggttaaccccggggttacccgggaacccgggttaaccggggggttacctaaacgggggtttaaaccggacggttaaccccgttaacgggtacccgggtttagggtaccccgggtcttacccgtaaaccggg

SEQ ID NO: 217141 - DNA, 738 bp, Homo sapiens
  misc_feature: GYAE6OF02H4QWE.1.34.D01.1.454.CMB.1.raw
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
tcagacgagtgcgtcacgaccggtgctcgatttagatcgtctgtgttgggtttagggggagtcagaccctgtcaggacacagcatggacatgagggtccccgctcagctcctggggctcctgctgacctcgtggcctcccgaggtaccagcgtgtgacataccgaattcggacccagtcctaccactccctccgttgtactgctactcttaagtggagacagactcaccatacctacgttcggaccggggtcaggtacgacggccaatacgacgcgttacttacttaacgtcgtggttacncgagacgaacgaaccgacgggtccgacgacccccgtanacgtacttcgtaacgtcgtatcgggtactctaactaccgtagtacgtcgacggtaacggggtcgggttaacccaggttccgtaacgggttcctgggtacggtacgtacggtacgtacgtaacgtccggttacgggtaaacctacggttaactaaccggttaccttaccgtaacgtaaccggttaacttaccgaacgtacgtaaccgttaccggtaacgtcgtaaccgtacccggtaaagtttacggttacttaccggtaaagttacttttaacgttaccggtactaacgtacgttaacgttactaaccgtacgtaacccggttcgtacgggtaccgtacggaacgaccgggtggaaacgttggaccgttacgaacgtaccggtgtacgtcaccgtaccg

SEQ ID NO: 217142 - DNA, 507 bp, Homo sapiens
  misc_feature: GYAE6OF02HVQCM.1.34.D01.1.454.CMB.1.raw
  modified_base (205)..(205): a, c, t, g, unknown or other
  misc_feature (205)..(205): n is a, c, g, or t
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
  modified_base (469)..(507): a, c, t, g, unknown or other
  misc_feature (469)..(507): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaagggtggggtcccatccgaggttcagtggcagtgcatcgtgggacagtattacactccncactatcagcagcctgcacgcctagagtattttgactaatttattactgtacaactagttaatactacgttacccctaggtggaccgttccggccggacgggggaaccaaggggttacggaaagtaccgaaaccgtaacgttggtacgggctacgcaacctntcctgtcttcaccttccctcccctccgtcctaccnccggcctactcccgttcctgggaccggtcgggtccgtaggaccgaacgggtcgactaagtaggcagnnnnnnnnnnnnnnnnnnnnnnnnnnnnnnnnnnnnnnn

SEQ ID NO: 217143 - DNA, 932 bp, Homo sapiens
  misc_feature: GYAE6OF02F8V5M.1.34.D01.1.454.CMB.1.raw
  modified_base (240)..(240): a, c, t, g, unknown or other
  misc_feature (240)..(240): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctccgagtaccagctgtacgacatccaattcgacccagtctccatccctcctgtctgctatcttattggacgaacagacgtaccacctacgtctacgttcggcccgggntacgtcgacggccctatacgacggtctacgtttctttagccgttgggttacgacaacggaccgtaacggtaaaaaccggcggggaccgaacccgtccccgtacggtaacggtagttccgggtaaagttccgtaacggttcggtcgtaccgtaacttccggtaggttaagtaccgggaccggttaaacgggggttccgggttaacccctaaggttccccggtaaccgggttacgtaacggggtcggttaccggtagggttaccgtaaccgtacggtttacccggtaacgggaacgttaaaccggtaaccgtttaaacccgtttaaaccggttacccccttaaccgttaaacccgtttaacgttaccgggaaccgttaacccggttaccgggtacccgttacgggttaaacccgtaccggttaaccgtaaacgggttaaacgtttaccggttttaaccggttaaacgtttaaacttttaacgtttaccgttaacgttaaccgttaacgttaacgtttaaaccttaaacgggtttaaccccgtttaacccgggttaaccgggtttacgttaaccgggttacccgggttaacccggggtaacgggttaacccggtaacgggggttaaccgtaacgttaaaccggggtaaccgttaaaccgggtttaggttaccggtacccgggtactaaccccggg

SEQ ID NO: 217144 - DNA, 602 bp, Homo sapiens
  misc_feature: GYAE6OF02G81HJ.1.34.D01.1.454.CMB.1.raw
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatccagcgtattctttagcctggttgcagcaagaaaccgagggacgacgcccctacgagactcgtagtcctagtcggtncgtatccagtattggcgtaagggtcggtccacgtccgtaggttcagtcggcgtagtgcgatccgngggaactagacttaccgactctactacgtatacgagctacgccttaggctacggtactagtaagttagttttacacttaaattttacttacgttactacgaagtttagttaagttaaactaccgtaccgttaacggtcggttaccggttacggaacggtaccggggtaacggtaagggtaacgaacgtaccgtaaccggtaacggtggtacggcctaggtaaccc

SEQ ID NO: 217145 - DNA, 764 bp, Homo sapiens
  misc_feature: GYAE6OF02FOKRB.1.34.D01.1.454.CMB.1.raw
  modified_base (574)..(574): a, c, t, g, unknown or other
  misc_feature (574)..(574): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctcgtggctcccaggtaccagctgtgacatccaattcgacccagtctccactcctcctgtctgcatctatggagtcagacgtcacagtcacgttcggaccgggctagtcacggaccctatccgaaggtcgtatttcgttacgtccttggttcgacgacgtaccgaaacggaaacccggaggggaccgaccggacccccttacgacgtacgttacggtaacgtctagtggtcgactactccaagtacttacggacgtaacggggtcgggtaccctaacgttaccggtaggtttaacgaggtacgggtacctaggtccgtaacgtacgttaccgggtacgggaaactaggacctttaaccgacttaccgtcctaaactccggtacgaacgtcacccgtgtacgaactccggtaagtaaccgttgttttaaccgactttaatttaccgttaanaccggttaactaaaccggttagttaacgtttaacccgtaaaccggtttaccccgtaagggttccggttaaacgggttacccggccggggtaaaaccggggtaacctaacgggggtaaaccgttaaaccggtaaaccccgtaaacgggtttacgtaacgggtcccggtacctaaccggttacccgtaaccg

SEQ ID NO: 217146 - DNA, 705 bp, Homo sapiens
  misc_feature: GYAE6OF02HDQ5I.1.34.D01.1.454.CMB.1.raw
  modified_base (346)..(346): a, c, t, g, unknown or other
  misc_feature (346)..(346): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagtagtcaccatacctacttggccgggtcgagtcacggccatcagcgtatttcttagccttggttcgcagtacaacggtaaaacccgaggggaccgtacgccccgttcgaaggtacgtcggtaagtctagtggtgccactccagtnttcgacgtaggggtccgggtacccacgtcgtacggttctaggtcggtacaggtcgaccgtaggttacggtacgggtactaacgggttacctacggtactaccgtactactaacgtacgcgtacgtccggtaccgacgtaaccgcggtccgttaaagtttaacgtttcggtaacgtttacttttaaacgtttaaccttacgttaccgtaactaacggtttaagtttaaccgtttaaccggtaacccgttacgttacccggggttacgggtacccgttaccggggaacgggtaaccggtaacgggttaaggtaccgggtaacaaccgttacggtacgtcggtaccggtctaccgtaacccg

SEQ ID NO: 217147 - DNA, 853 bp, Homo sapiens
  misc_feature: GYAE6OF02GEVTX.1.34.D01.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
tcagacgagtgcgtcacgaccggtgctcgatttagatcgtctgtgtttgggtttgggcatggacatgagggtccccgctcagctcctggggctcctgctgctctggctcccaggtaccagctgtgacatccaattgacccagtctccatcctccctgtctgcatctagttggagacagagtccaccatctacttcggccggggngagtcgacggccatcgagcgtatttcgttagccttggtncagacagaaaccgngggccgacgcccctnagactcggtagtcgttagtggtcgactacgtccgagtacgttcggaccggtaacgggggttcggggttaccccaagttcccggtaacgggtttccgaacgggttcgggacgtacggtcggtacgttacgttcgggtacggggtaactaaggttactttaaccgacctttacctacctaacttacgtacgaacgaccgtaccggtcccgtacggaacccgacggttacccggttaaggttaaacgttttaacgtttttaccgaaccttttaaatttttaaccgttaacgttacggttaaaccctaacgttaagtttaacgttttaaaccgttacccggtttaaaccccccggtttagggtttacccgggtttaaccgggtttacccgggggtaaccccgggtaaacgggggttaaaacccgggtaaagggggtttaaccgggtaaaacccgttaacccgggtaaaccccggttaagggttccgggttaccgggtaccgttaaccggaacccttaccgtttaacgttcccgttttacgtttcccgtttaccgttaccgttttccccgttaccccggttaaccc

SEQ ID NO: 217148 - DNA, 766 bp, Homo sapiens
  misc_feature: GYAE6OF02GM0V0.1.34.D01.1.454.CMB.1.raw
  modified_base (760)..(760): a, c, t, g, unknown or other
  misc_feature (760)..(760): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctaggctcccgaggtaccagctgtgacataccaattcgacccagtcctccactcctcccgtgtcctgcacgttcttagtagggacacaggacgtccaacctatccacgttcggaccggggacgaagtccgacggaccaatacgagtacggtatttaccgtttacgccgttggtcgacacgtaccgaaacgaaacggacggggacaccgtaccctacgaagtacttacggagttcgtagttgggtactacagttccgaagtacgttcggaaccggtaacgggtttccgggaccctaagttaccggaacggttacggtaagtacgggactagggttaccacggtatttacgggacgggtaacttaacggtaactttaaccgtaccgttacctaccgttaacttaaaccgtacgtacggaccgttaccggaccgttaccgaccggtaacgtccggtaaaggtaagttacgttttaccgaagtttaaacgtttacttaccgtacgttaactaacgttaacgttaacttaccggtaaaccctttaccgggttacgacgggttaccgtacgggaccgggtaaacgggtaccgaaggttacggtaagtaacccggtacgtaccgtacgtacggtaccgtanaacccg

SEQ ID NO: 217149 - DNA, 568 bp, Homo sapiens
  misc_feature: GYAE6OF02GYF8L.1.34.D01.1.454.CMB.1.raw
  modified_base (175)..(175): a, c, t, g, unknown or other
  misc_feature (175)..(175): n is a, c, g, or t
  modified_base (200)..(200): a, c, t, g, unknown or other
  misc_feature (200)..(200): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (432)..(432): a, c, t, g, unknown or other
  misc_feature (432)..(432): n is a, c, g, or t
tcagacgagtgcgtcacgaccggtgctcgatttagatcgtctgtgttgggtttggccatggacatgagggtccccgctcagctccgtggggctcctgctgctctggctcccaggtaccagctgtgacatccaattgacccagtctccatcctccctgtctgctatctattggaancagtagtcaccatcacttgccgggnagtcaggccatcagcgatttccttagccgtggttgcaggcaagaaaccgngggcagacccctnagtntcgtagttcatggtgcacnccagattgctaagggtcgggtcccaatccaaggttccaaggtcgaccgagtgctatcgtgggacagtataccgactcgtcacgtactcagtcagccctgcgtacncgngtaagtagtttgaaccttattttcgtactgtaacctanagtttaacttataccggttaaccctagggtacgtaccgttacgggcgaaacgggtcctaaaggtccgtagtaccgacggtactacggtcggctacggccacctgttaccgcttcttacgtacttccctacccggac

SEQ ID NO: 217150 - DNA, 764 bp, Homo sapiens
  misc_feature: GYAE6OF02JS3BX.1.34.D01.1.454.CMB.1.raw
  modified_base (102)..(102): a, c, t, g, unknown or other
  misc_feature (102)..(102): n is a, c, g, or t
  modified_base (321)..(321): a, c, t, g, unknown or other
  misc_feature (321)..(321): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
  modified_base (476)..(476): a, c, t, g, unknown or other
  misc_feature (476)..(476): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtagacatccaattgaccccagtcctccgactcccttcccgtgtcctgtccattctaagttcggaagaccaggacttccaacccgatcctacgttcggacccggggacaagttccaacggccattcgacgcgtactttcgttagccttggttcggacagtaccgtagaaacccggngggacgtaccggcccctanacggtacgtacgtaggtccttaagtcggtaanccgtaattccgaagttattcgggacgtaaacggggttccgggtaccctacttaccggtcgggttaactaggtccggtacgacggttcgaacctgtttaaccggngggtaacctaggtaacttaccgtaaccgttccttaactaaccgttagtaccgtacgaccgtaacgtccgtacggtaccgtacgtaccggtaagttaaacggtttactttaacgttaaccgtttaattttaccggttaccgtttacggtaacccttaagttacgtttaacttacggtttaaacctaccggtttaccgtacgtacggttcccggaaacggtacgggtaaccttaacggggtaccttaacgggacctaaccggtacgttaggaccgttcgtacgtaacccg

SEQ ID NO: 217151 - DNA, 624 bp, Homo sapiens
  misc_feature: GYAE6OF02FUSOL.1.34.D01.1.454.CMB.1.raw
  modified_base (224)..(224): a, c, t, g, unknown or other
  misc_feature (224)..(224): n is a, c, g, or t
  modified_base (328)..(328): a, c, t, g, unknown or other
  misc_feature (328)..(328): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagacgtcaccatcacgttgccgggnagtcaggccatcagcgattctttagcctggttgcagcagaaaccagggcgacgccctcagatcgtacgtctatggtgcatccagattgacgaggtcgggtccanccaggttcagtggcagtgcatcgtgggacagtactttaacacgtctacacttactcgtacgactacggaccctggtcctacggcccttaggtaaacgtaagtttttacggaactttaaagtttactttaactacgttacctaaaccgttaagttaactttaaacgtacgttaacccctacgggtacgggttaacccggttccgggtacccgtaacgggggaaaccgttaacggggtaacggtaaacggtaccggtaaccggtaaccgtagggttaccggtaccgttacggtaaccc

SEQ ID NO: 217152 - DNA, 658 bp, Homo sapiens
  misc_feature: GYAE6OF02GJ5OF.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattgagacagagtcaccatcacttggccgggcgagtcaggccatcagcgtattctttagccttggttgcagcaagaaaccgagggcgacgcccctcagatcgtagtctatggtgcatccagattgcgaaggtcggggtcccagtccaggttcaggtggcgtagtcgctactcgtcgggaacagtacttacacgttctctaactactaccaacgcacgtcccgtcgacgtacggtacccgttagtaaagttagttttacggaaccttttaaaatttttacttaaccgttcgttaaacctaacttaacgtttaactttaacgttaaccccgttacccggttaacggttaccggggttaaccgttccggggtaccggtaacgggggtaacccgaaaggggtacggtaacgtaccgaaccggttacgttacgggtcggtaccgtacgtacctaccgtacttaccgttcgtttacctctacctttcctccgttacccg

SEQ ID NO: 217153 - DNA, 839 bp, Homo sapiens
  misc_feature: GYAE6OF02FIDYE.1.34.D01.1.454.CMB.1.raw
  modified_base (148)..(148): a, c, t, g, unknown or other
  misc_feature (148)..(148): n is a, c, g, or t
tcagacgagtgcgtcacgaccggtgctcgatttagatcgtctgtgttgggtttgggggagtcagacctgtcaggacacagcatggacatgacgggtccccgctcagctccgtgggctcctgctgctctggctccaggtaccagctgtnacatccaattcgacccagtctccactccctcctgtctgctatctagttggacacagacgtccaccatcgtaccgttcggcccgggacgtacggtccacggtcctatcgacggtaccgttactttacgttttaccgccgtttgggttcgaccgaaggtacccgaaacggaaaacccggacggggacccgtaccgcccccgtaacgaacgtacgttacggttacggttaccttaaggttcggggttacacgttaacgttacccgtaacggtttacggttacgggtaacggttaaccggggggttccgggttaacccctacggttaccggtaacgggtttaccgaaggggtccggacgtacgggttcgtacccgtacgggttccggtaacggggtaacctaacggtttaaaccgtttaccgtacccttaacgttaaccctaccgttaacccgtacgaacccgtaccggtacccgtaccgtcggtaccgacggttacccgttaagaacgttttacgttaacttaaccgtttaagtttaaccgtttaacgtaccgttaaccgtaacgttaacggttaactttaccggttaccgtaaccccgttaggttaccggtaccggtttcccgggaacgggtacgggaaacctaggggtaacaccgggtaacctaaccggtacggtcgtacgtacgtccgacc

SEQ ID NO: 217154 - DNA, 861 bp, Homo sapiens
  misc_feature: GYAE6OF02JI2DZ.1.34.D01.1.454.CMB.1.raw
  modified_base (141)..(141): a, c, t, g, unknown or other
  misc_feature (141)..(141): n is a, c, g, or t
  modified_base (205)..(205): a, c, t, g, unknown or other
  misc_feature (205)..(205): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctccaggtaccngctgtgacatccaattgacccagtcctccactccctcccgtgtcctgcatctattggagacagngtcacctatcacgttggaccgggcagtccaggccatccagcgtatttactttagccgttggttcgctacgcaacggaaaacccgacggggacgaccggtccccccttagaacgtacggtaccggttaaggtccttaacggttcggttaggacctaacgttaccgaaggttacgttcggtaccggtaacgggggttccggggtacccctacggtttacccggtaaggggtttaccgaacgggttcgggtccgtaaacgggttacggtacccgtaaagtttcccgggtacgggtaaaccgtaacggttaaccgtttaaccggtaaccgtttacccttaacccggtaaactttaaccggttacgaacggttacccgaaccgggtcccttaacggacccgtaacgggttaccggtaacgttaaacggttttaacgtttttacggaaccctttaatttttaacccggtttacttacggttaacccttaaagttacgttttaacgttaaaccggtttaaccctacccggttttaacgggccgtttaaccgggggttcccgaaccggggtaaaccggggttacccgtaaaggggttaacggtaaacccgttaacccggtaaaccggtacggttacgggtaccgttaccggtcccggtaacccg

SEQ ID NO: 217155 - DNA, 792 bp, Homo sapiens
  misc_feature: GYAE6OF02F2NQ2.1.34.D01.1.454.CMB.1.raw
  modified_base (101)..(101): a, c, t, g, unknown or other
  misc_feature (101)..(101): n is a, c, g, or t
  modified_base (126)..(126): a, c, t, g, unknown or other
  misc_feature (126)..(126): n is a, c, g, or t
tcagacgagtgcgtcacgaccggtgctcgatttagatcgtctgtgttgggtttgggggagtcagaccctgtcaggacacagcatggacatgaggtccccgntcagctccgtgggctcctgctgctntggctccaggtccagcgtgtgacatccaaattcgacccagtcctccacttcctccgtgtctgactatctagtggaagcgagacgtcaacctatccacgttcggccgggtcgtagtaccgacggccagtccgagtccgtaatttccgttagcccgttggttcacacggtaccaaggtaaaccgcgggccgtacccgtaccctagaacgtacgttacgtacttcgtaacgtgggtccaactacgtaaccgaggttaccgtacggtaagaacggggttccggttaccctacgttaccggtagttacgtacggtacgtagacggttcgaccgttacgtaccggtaggtaaaccgtattaacgttaaccgtactttacaaccgttaacgtacgttacgacgttacggccgtaccgtagtacccgtacgtacgttaacggtaaccgtttattaaccgtaagttttaaagttaaccgttaaccgttacgtaaaaccttagttaaagggtttacccttaccgggttaaacccgttacccgggttaacggtaccgggttacccgggttaacggaaccgggttaaaccggggtaaccgttaaaccggggttacgtaaaccggttaacccggtaaccgtttacgggttaacccggcggtaccgttacgaacccccgg

SEQ ID NO: 217156 - DNA, 817 bp, Homo sapiens
  misc_feature: GYAE6OF02FXE8Z.1.34.D01.1.454.CMB.1.raw
  modified_base (198)..(198): a, c, t, g, unknown or other
  misc_feature (198)..(198): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttgggggagtcagaccctgtcaggacacagcatggacatgagggtccacgctcagctcctggggctcctgctgctctggctcccaggtaccagctgtgacatccaattgacccagtctccatccctccctgtctgcatctattgganacagagtcaccatcacttggccgggcagtcaggccatcagcgattctttagccttggttgcagacaacgaaaccgagggccgacgtcccctacgacgacgttcgtagtccttagtggngcactccaagtattggacgtaagggtccggggtacccacgtccgtaggtttcgaacggtggcgaggttcgactacggttcggtagggactaaggttacttaactaccttcctacctaacctagtaccacgtaccgaacgtccgtacgaccgaccgtaccgttaaggtaaaccgttttagttttaaccggttaacctttaaacgttttttaacgtttacccgtttaaacggttaacccgttaaaacgttaacggttttaaaccgttttaaacgttaaaccccgggttttaacccccgtttacggggtttaaaccggggttaccccggggtttttaacccgggggaaccccggggttaaaacccggggggggttaaaccccgggttaaaacggggggtttaaacgggggttaaaaccccgggtttaaccccgggtaaaaaaccccggggttttaacccgggttaaccgggggtttacccggggttaccggttaaacccccggg

SEQ ID NO: 217157 - DNA, 801 bp, Homo sapiens
  misc_feature: GYAE6OF02F3UY4.1.34.D01.1.454.CMB.1.raw
  modified_base (205)..(205): a, c, t, g, unknown or other
  misc_feature (205)..(205): n is a, c, g, or t
tcagacgagtgcgtcacgaccggtgctcgatttagatcgtctgtgttggggtttgggggagtcagaccctgtcaggacacagcatggacatgacgggtccccgctcagctccgtggggcctcctgctgctctggctcccaggtaccagctgtgacataccaattcgacccgagtctccatccctccctgtctgcatctatggaanacagacgtcaccatcacgtcggccggacgagtcacggccatcgagcgtattctttacgccgttggttacgcgtaacgacgaaacggtaaaccgcggggaccgaccgtcccctaacggacgtacgttaccggtagttacttaggtcgggtcacgtacctaccgtagtacgtacggaacggtacggggtacccggtaccctacgtccgtagttacggaaggttcggacgtacgtgaccgtacgtcgggtaccggtaactacggtactttaaccgtacccttacggtactaactaccgtacgaacgtaccggctaccgttggaccgtcgttaacccgggtagttaacggttttatttacgttaacgttttaaacgtttaaccgttacgtaagttaaaccccggttaaattaaccgggttttaaacctttaaccgggtttaacccctaaacccgggtttaccgggtaccgggttaaacccggggtttcccgggaaaccggggttaaccgggggttaaaccgtacgggggttaaaaccggtaaccggtaacccccgttaaagggttcggttaaccgggtcggtaccgttaacggtacccgg

SEQ ID NO: 217158 - DNA, 703 bp, Homo sapiens
  misc_feature: GYAE6OF02F2OC4.1.34.D01.1.454.CMB.1.raw
  modified_base (435)..(435): a, c, t, g, unknown or other
  misc_feature (435)..(435): n is a, c, g, or t
tcagacgagtgcgtcacgaccggtgctcgatttagatcgtctgtgttgggtttgggggagtcagaccctgtcaggacacagcatggacatgagggtccccgctcagctccgtggggcttcctgctgctctggctccaggtaccagctgtgacatccaattcgacccagtctccactcctccctgtctgctatctagttggagacagacgtcacctatacctacgttcggccggggacgtaacggtcgaacggtccctataccgacggtcgtaacttttccgtttacgccgttgggttacgcacgacgaacgaaaaccggcggggaccgaccgccccgtacaggacgttacggtagttacgtagtcgggtacacgtaactaccgtagtagttcggacggtacgggttcggtccaacgtccgtaggttcgaggcganagtcgactaggtcgtaggactacgtacttactaacttccgtactacgtaactccggaacgaccgtacgtcccgtagacccgtacggttaccgttaagtaaagtttcctttacgtaaacgtttaactttaccgttactacgtactaaacgttagttaacttacggaacccttacgttcggtacggtaccgtacggaacggtaccggtacggtaaggtaccggtaacgtacccggtaacgttacggtacggtcgtaccgttacgtacccg

SEQ ID NO: 217159 - DNA, 850 bp, Homo sapiens
  misc_feature: GYAE6OF02HN75R.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtgggctcctgctgctctggctcccaggtaccagctgtgacactcctaattcgacccagtcctccactccctcctgtctgctatctagttggagacagacgtaccacctactccgtacgttcggccgggacgtacgtacgacggacctacgtcgacgacgttactttcgtttaacgtccgttggttacgacgtaacgacgtaaacggaaacccggacgggacccggtaccgtcccccgtacgtaacggtacgtttaaccggttacgttaccgttaacggttacgggtacgtaccgtaaccgttaccgtacggttacgttacggtaccgggttaacgggggtacccgggttaccctaacgttaccggttacgtttaccgggggggggtacttacgggcgtacggtcgtacgtacggtacggtacgggtaacgtacgttaacgttaccgtacttacctactaccgttaacgtacgtacgaccgtacgtccggtacacgtacgtaccgttaaggttaacgtttaacgtttaacgttactttaaacgttttacgtaccgttaccgtaacttaacggttacgtttaaacgttaccgtaacccgtttaccggttaccggtacccggttaccgggtacccggtaaccggggtaaccggggttaacggtaacgggttaaccggtaacccgtttaacccggaaccggttaaccgggttacgggtacgtaccggttaccgtaaccccgg

SEQ ID NO: 217160 - DNA, 651 bp, Homo sapiens
  misc_feature: GYAE6OF02GNHI1.1.34.D01.1.454.CMB.1.raw
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattcgtttagcctggttgcagcaagaaacgagggacgacgcccctacgagatcgtagtctatggncatccagtattgacgaaggtcgggtccacgtcctaggttcaaggtggactagtcgtcaagttcggagggaacaaggtaatttaacccgactttacctaccgtaaccttatccgaacgcctaacggtaccctgggaacctacgggtacccttagtaaagtttcgtttttagaaccgttttaaatttttacgttaaccgtagttaaccaaaacgttagtttaacttaaacttaaccgtaacccccggttaaggttaccgtaccggtaccgggtacccgaaggggaacccgtaagggttacggaacgtacccggtaaaccggaacgttggtacgggtccgttagaacccg

SEQ ID NO: 217161 - DNA, 750 bp, Homo sapiens
  misc_feature: GYAE6OF02HJD44.1.34.D01.1.454.CMB.1.raw
tcagacgagtgcgtcacgaccggtgctcgatttagatcgtctgtgttgggtttgggggagtcagaccctgtcaggacacagcatggacatggagggtccccgctcagctcctggggctcctgctgctctggctcccaggtaccagtctgtgacatccaattgaaccagtctccatccctccctgtctgcatctagttggagacagagtcaccatcacgttgaccgggcgagtcgaggccatcagcgattctttagcctggttgcagcaacgaaaccgagggccgacgcccctagacgacgtacgtacgtctagtggtcgacatcgagtattggacgtaacgggtcggtcccagtccctaaggttcacggtggcctaggtcgtcaagttccgtagggtaacctaggtacttacctaaccttcgtacctaacgtacttcgaacgaccgtacgtccctacgtaccgacgtacccgttaggtaaagtttacgtttttacggaactttaaaactttttacgtttaaccgttaccgttaccgtaaaacgttagtttaacctttaaaacggttaacccgttttaacccccggttaagggtttacccggttaaacccggggttttcccgggtaaacccgggtaaccggggggtttaaacccgtaaaacgggggtttaccgggaaaaccgggtttaaccccgtaaaccccggggtaaacgttttacccggggaaggttacccggtaccgttaaccccgg

SEQ ID NO: 217162 - DNA, 680 bp, Homo sapiens
  misc_feature: GYAE6OF02FF65O.1.34.D01.1.454.CMB.1.raw
  modified_base (103)..(103): a, c, t, g, unknown or other
  misc_feature (103)..(103): n is a, c, g, or t
  modified_base (201)..(201): a, c, t, g, unknown or other
  misc_feature (201)..(201): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (319)..(319): a, c, t, g, unknown or other
  misc_feature (319)..(319): n is a, c, g, or t
  modified_base (409)..(409): a, c, t, g, unknown or other
  misc_feature (409)..(409): n is a, c, g, or t
  modified_base (534)..(534): a, c, t, g, unknown or other
  misc_feature (534)..(534): n is a, c, g, or t
tcagacgagtgcgtcacgaccggtgctcgatttagatcgtctgtgttgggtttgggggagtcagaccctgtcaggacacagcatggacatgacgggtccccgntcagctcctgggctcctgctgctctcggcctcccgaggtaccagcctgtcgactactccgaattcgaccctagtcctaccactccctcctgtctgctntctgtgacacagactccacntctaccgttcggccggtgagtcgcgtccatcgngtctattcgttacgccgttgtcaccgagtacgaaccgaaccggtcgggccaccgccctagtaacngttaccggtattcgtaggttcgactaccagtaccgtagtacgttacggaccgggtaggtcccggacctacgtacgtaggtaccaggtcgntacggtcgttaccgacgtaccgggtacaacgtactaccttacgacgttaccaactagttaccagtaccgtaccgacacggtcacgtacgtaaccgttaagaccttttagtctaaactttttaacncgtttaacctacgaaaccgttaagttaacgttaacttaaaccgttcccgtaaacgggtcttacggccggttacccgaacgggaaccgttaaacgggtaaggtccgtaacggtaaccgttcgaaggtttcgacgtacgtcctaaccg

SEQ ID NO: 217163 - DNA, 645 bp, Homo sapiens
  misc_feature: GYAE6OF02G66U2.1.34.D01.1.454.CMB.1.raw
  modified_base (77)..(77): a, c, t, g, unknown or other
  misc_feature (77)..(77): n is a, c, g, or t
  modified_base (163)..(163): a, c, t, g, unknown or other
  misc_feature (163)..(163): n is a, c, g, or t
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (323)..(323): a, c, t, g, unknown or other
  misc_feature (323)..(323): n is a, c, g, or t
  modified_base (443)..(443): a, c, t, g, unknown or other
  misc_feature (443)..(443): n is a, c, g, or t
  modified_base (475)..(475): a, c, t, g, unknown or other
  misc_feature (475)..(475): n is a, c, g, or t
  modified_base (508)..(508): a, c, t, g, unknown or other
  misc_feature (508)..(508): n is a, c, g, or t
  modified_base (589)..(589): a, c, t, g, unknown or other
  misc_feature (589)..(589): n is a, c, g, or t
  modified_base (595)..(595): a, c, t, g, unknown or other
  misc_feature (595)..(595): n is a, c, g, or t
  modified_base (602)..(602): a, c, t, g, unknown or other
  misc_feature (602)..(602): n is a, c, g, or t
  modified_base (612)..(612): a, c, t, g, unknown or other
  misc_feature (612)..(612): n is a, c, g, or t
tcagacgagtgcgtcacgaccggtgctcgatttagatcgtctgtgttgggtttgggcatggacatgagggtccccgntcagctcctggggctcctgctgctctggctccaggtaccagctgtgacatccaattcgacccagtcctccatccctccctgtcctnctattctagttaggagaacagtacgtccacctatcacgttggccgggntacgtcaggcctancgagcgtatttccttagccgttggttacncgtacacgaacgaaaccgnggggacctaaccggcccctagagtacgttcgtacgttcgtagtgggtacnctaccgtacaggtagtttgaccggtaacggggtcccgggttacccaattcccgggtagttacgtaaggtggtacaggttcacgtacgttacggcggtaactagtaactccgtactactanacggttactcagtaccacgttacgacgttacncgttacgtaagtaactttcgttataacgttttnttacgtctagtactagtagttactactccgtaacgttagtggtaccgtcggacgtacggacgtaggtaccgataccagtanagggtntaccgtnaaccccgttntactgtacctcgtactaccttcccgactaacgg

SEQ ID NO: 217164 - DNA, 710 bp, Homo sapiens
  misc_feature: GYAE6OF02HBV8C.1.34.D01.1.454.CMB.1.raw
  modified_base (126)..(126): a, c, t, g, unknown or other
  misc_feature (126)..(126): n is a, c, g, or t
  modified_base (701)..(701): a, c, t, g, unknown or other
  misc_feature (701)..(701): n is a, c, g, or t
tcagacgagtgcgtcacgaccggtgctcgatttagatcgtctgtgttgggtttgggggagtcagaccctgtcaggacacagcatggacatgagggtccccgctcagctcgtgggctcctgctgctntcggctcccaggtaccagtctgtcacataccaattcgaccagtctccactcctcctgtctgctatcttagtggagacagtacgtcaccatcacgttcggaccgggcgtagtcgacggccaagtcagtacgtatttctttagtccgttggttcgaccgtacgacgaacggaaacggcgggaccgaaccgtcccccgagtaagtacgttacgtacgttcgtaggttcggtcgtacacgttcgaacgtacgtcggacgtaacggggttccggtaacccgacgttccgtacggttaccgtaaggtcggtaacggtcgtacgacgttacgtacggtaacgggttaaacgttaacgttaccaccttactaacctaacttaacgtacaccggtcgaaccgtccgtcgtaccgtaacgtacgttaaagtaacgtttacgtttaacgtaactttaagttactagttactaacgtaattacgttattaacgtaccgttaaccgttcgtacgtacgttccggaacggtaccgggaacgtacgggtaggtaaccgtaacgtaacggacgttgggtacctacggtacncccgtaacg

SEQ ID NO: 217165 - DNA, 511 bp, Homo sapiens
  misc_feature: GYAE6OF02IB100.1.34.D01.1.454.CMB.1.raw
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (431)..(431): a, c, t, g, unknown or other
  misc_feature (431)..(431): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (477)..(478): a, c, t, g, unknown or other
  misc_feature (477)..(478): n is a, c, g, or t
  modified_base (480)..(511): a, c, t, g, unknown or other
  misc_feature (480)..(511): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagaatcgtagtctatggtgcatccagattgcaaggtggggtcccatccaggttcagtggcagtgcatcgtggggacagatttacactctcatatcagcagtcctgcagcctagaagtattttgactaaatttttattactgttacaactagttaacttagtacgttacccctaggtggacggtttccggccagggggaccctaagggtggtaacgtccaaaccgtacgtgggtacggcctcgccaccnttctcgtcttacncgttcctccccgactactcgtacgacggtcctacgttcgtgtcgcgggccgggtntagggccgtaacgggccgtcgtagtacggcagtcntacnancgtanncnnnnnnnnnnnnnnnnnnnnnnnnnnnnnnnn

SEQ ID NO: 217166 - DNA, 458 bp, Homo sapiens
  misc_feature: GYAE6OF02FK6A4.1.34.D01.1.454.CMB.1.raw
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (425)..(458): a, c, t, g, unknown or other
  misc_feature (425)..(458): n is a, c, g, or t
tcagacgagtgcgtcacgaccggtgctcgatttagatcgtctgtgttgggtttgggaatcaggccatcagcgattctttagcctggttgcagcagaaaccagggcgagccccctcagatcgtagtctatggtgcatccagattgcaaggtgggtcccatccaggttcagtggcagtgcatctgggacagattacactcacactatccagcagcctgcagcctgaactatttgactaattttatactgtacaactagtattatacgtaccccctagtggacttcggccgaggggacctaaggtggaacgtcaaccgatgtgctgcacatctntcttcatcctcccncactctagaccgctaccgtacgtcagtacggcgggtctagggccgaaagggccgacctaaaggtacgntctacngcagcnnnnnnnnnnnnnnnnnnnnnnnnnnnnnnnnnn

SEQ ID NO: 217167 - DNA, 774 bp, Homo sapiens
  misc_feature: GYAE6OF02HQDUB.1.34.D01.1.454.CMB.1.raw
  modified_base (203)..(203): a, c, t, g, unknown or other
  misc_feature (203)..(203): n is a, c, g, or t
tcagacgagtgcgtcacgaccggtgctcgatttagatcgtctgtgttgggtttgggggagtcagaccctgtcaggacacagcatggacatgagggtccccgctcagctccgtggggcctcctgctgctctggctcccgaggtaccagctgtgacatccaattcgaccctagtctccatccctcctgtctgctatctagtgganacgagacgtcaccatcctacttcggccggggacgagtcgacggtccagtcgagtctagttttaccgtttagccgttggttcgacgtagacgaacggaaacccggaggggaccgaccgtccccgtacgaagtaacgtaccggttaaggttcctttaaggtcgggtctacctaacgtaccaaggtacgttggaccggtaaagggggttccgggtacccacgtttaccgagggtttacgagggtacggacggtaagttcggactacgttaccggtacgggtaactacggtaacttaccctaccttacccttaacgtaccgttaacgtcgaacgcgtaaccggcctacggaccgtacgtcgtaacggttaaacgttactttacgttaacttaaactttacgtttaacgtacggtaacaaagtttaacgttaactttaaccgtaaaccgtttacccgtacggtacgggttacggtttaaccggggcccggtaaaggggtaacccgtaaggggtaaccgggtaaccttaacccggtaaacccggtaggttccgggtaacgtacgggtcccttaaccg

SEQ ID NO: 217168 - DNA, 962 bp, Homo sapiens
  misc_feature: GYAE6OF02GCWYX.1.34.D01.1.454.CMB.1.raw
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
  modified_base (648)..(648): a, c, t, g, unknown or other
  misc_feature (648)..(648): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctcgtcggcctccaggtaccagctgtagacatacctaattcggaccctagtcctccatccctcctntcngctatctagtgganacgagactcaccatcacgttcggccgggtactaggacctacggccaatcgaagtccgtatttccgtttagcgttgggttanaccgtagaccgaaacggaaccggtacggggaccgtacccgtccccgtacaagtacgttaccggttacggttctagggttcggtagcctaacgtaccgtaggttaacttacgggacggttaaaggggggttcccgggtacccctaagtttaaccccgggttagggtttaccggtaacggttacgggtacgtaacggggtcctacgttaaaccgggtcggggttaaccgggtaaccttaaacgggtttaaacctttacccgaacccgttttgaaaaccccttaacgttacccgttacggaaacccggttccgtaaccccgggtcttacccggaaaccggttaccgtaacccgggtttaanaaacgggtttttaccgtttttaacccgtaaacgtttttaaacgttttaacctaaacccgggttactttaaaacccggttaaacttttaggggtttaaaacccttttaccccggtaaaacggttttcccccgggttaaacgggggttacgggttacccccgggttaaacccggggttccgggggaaaaacccggggggttttaacccgtaaacggggggtttacgttaaaaaccccccggggggttaaaaacccttacggggtttaaacccgggtttacgggtaaccgggttaccccctacgggttaaaaccccg

SEQ ID NO: 217169 - DNA, 754 bp, Homo sapiens
  misc_feature: GYAE6OF02G6P1L.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacataccaattcgacccagtctccatcctctctgtctgctattcgtagttggactacgagacgtaccaccattccacgttcggccggcgagtccgaacggcctagtcgtaacgtcgtacgtttcgttacgtcgttacggttgacgtagactaaaccggaaccgacgggccgaccgtaccccgtacgagtacgttcgtagtacgtacgtgtcacgtacgtaccgagttacgtagacggtaggttccgggtaccacggttaccgacggtttacgcggtacgtcgtagtcgtacgtacgtaccggtaggaacgtacgtaaagttacccgtacgtacctacgttaacctacgttaaccacgcccgaacggtccttacgaccgtaccgactttaacggtaagtttacgtttaacgtacgttttaaacttttacgtaacgttaccggtaaaccttaaacgttaaacgtttaccgttaaccggtttaacctttaaccccgggtacggttacggttacccgggttaacccgggaccgggttaacgggtaacccgttagggtaaacccgttaacggtacccgttaaacccgtagtccgggtagtacccgtacgg

SEQ ID NO: 217170 - DNA, 875 bp, Homo sapiens
  misc_feature: GYAE6OF02HF5P3.1.34.D01.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctcgtggctcccaggtaccagctgtgacactccaattcgaccctagtcctccactccctcctgttctgactatacttagttggacgacagacgtcaccgatctacgttcggcgggcgagtcgacgccgatcgacgcgttacttcgttacgtccggttggttnacgacgacgaaacgaaaccggtcgggaccgacccgccccgtagacgtacgtacgtagtacgtagtcggtacgacctacgtactaggtcgttacggaaccggttaaggggttcccggtacccctacggttaccgtacgggttaccggtaacgggtcgggacgtaggtacgaaccgttacgggtaccggtacgggaaacgttaacgggttaaacctttacccgttaaccgttacccgtttaacccgtaacgtttaccgaccgttaaccggacgtacccggttcccggtaacggaccgtaacccgggtacgtttaaggttaaaccgttttcgtttaaacggttaacctttttaaatttttaaccccgttaaggttaaaccgtttaaacccgtaaagttttaaccgttttaaaacccggtttaacctttaacccggggttaacccgttttaccggggttaccgggtttaacccggtttacccggggaacccggggtaaaccgggttaacgggttaaccgtaaggggtaaccccgttaaaccggtcccgggttaagggttcccggggtaacgggtacccttaggtaaccccgg

SEQ ID NO: 217171 - DNA, 758 bp, Homo sapiens
  misc_feature: GYAE6OF02G7P2W.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacataccaattcgaccctagtcctccactccctccctgtctgctatctagttggagacgagtacgtacacctatcctacgttcgggccgggacgacgtccgacggaccagtacgacgtccgtattttaccgtttacggtccgttaggtttcgacctaacgaccgtaacggaaaaccgacggggaccgaccgcccccgtacgacggtaacgtacggttacgttacgtaggttggtcgtacacttaccgaagttagtcggacggtaacggggtccgggtacccacggtaccggtacggttacgtacggtcggtaacgtacggttcgtacgtacgttaccgggagggtaacgtaacgttaacgttaacccgtacttaccgtacccgtaaacttaccgtaccgaacgttccaacgtccgtacggctaccgaccggttagtaaacgttcgtttaactaacgtttaaatttccgttaattacgtaacgaacgttaagtttactaaacttacccggtaaccgttacggttacggtaccgttaccgggaacggtaaccgggtaaacgacgggtaacgttaacgaaccgtaacggtacgtggtcgtacgtcgtaaccg

SEQ ID NO: 217172 - DNA, 561 bp, Homo sapiens
  misc_feature: GYAE6OF02GLEET.1.34.D01.1.454.CMB.1.raw
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
tcagacgagtgcgtcacgaccggtgctcgatttagatcgtctgtgttgggtttgggggagtcagaccctgtcaggacacagcatggacatgagggtccccgctcagctcctggggcttctgctgctctggctcccaggtaccagctgtgacatccaattgacccagtctccatcctccctgtctgcatctattggagacagagtcaccatcacttgccgggcagtcaggccatcagcgattcttagcctggtncagcagaaccgagggcgacgcccctcagatcgtagtctatggtncatccagtatgcaagggtcgggtccagtccgagttcgagtggcagtgactatcgtagggacagacttacactctacactactcacggtacacgccttagcgagtccctagtaacgtattttgacttaatttacttacgtgtaacctaacgtattaattacgttaacctacccgttacggtacggtacggttccgggaccgtaacggggtacctaagggtacggtaagttaccgaacggtaccgttggtaccggtctagtacccg

SEQ ID NO: 217173 - DNA, 914 bp, Homo sapiens
  misc_feature: GYAE6OF02HAZ7G.1.34.D01.1.454.CMB.1.raw
  modified_base (102)..(102): a, c, t, g, unknown or other
  misc_feature (102)..(102): n is a, c, g, or t
  modified_base (107)..(107): a, c, t, g, unknown or other
  misc_feature (107)..(107): n is a, c, g, or t
  modified_base (121)..(121): a, c, t, g, unknown or other
  misc_feature (121)..(121): n is a, c, g, or t
  modified_base (124)..(124): a, c, t, g, unknown or other
  misc_feature (124)..(124): n is a, c, g, or t
  modified_base (150)..(150): a, c, t, g, unknown or other
  misc_feature (150)..(150): n is a, c, g, or t
  modified_base (420)..(420): a, c, t, g, unknown or other
  misc_feature (420)..(420): n is a, c, g, or t
  modified_base (578)..(578): a, c, t, g, unknown or other
  misc_feature (578)..(578): n is a, c, g, or t
tcagacgagtgcgtcacgaccggtgctcgatttagatcgtctgtggttgggtttgggggatcagaccctgtcaggacacagcatggacattgagggtccccntcacnctcggcgtcctcgntcncgtctgcgtacccacggtaccgtacncgtacgtgactacgtaccttaacttacgacccgtacgtcgtacctacgtccttccctcggtctgactaacgtcttaagttgggacgaaccagtacgaccacctaccgtactaccgttggacccgggtcggaacttcaaccgggacgtaccttagtacggaacccgttagtttacgttttaaccgccggtaaccgggttgtaccgaaaccggtaccgtaaacggtaaaccccgaaggggtccgaaaaccggtcccccccttagtaaaacgnggttaacccgttcggttaaccggttaacgtcgggtttacggaaactacccgtaaccgtaagggtacttttaacggcccggaaaaaccgggggttcggggtaaaacccccgcttaaccgggtaggttacccggttagtaacgggtccggtaggttaacncccgtaacggtacccgttaaaggggaccctaagttaaaccgtaccgtaacttacccgtacgttaacgtaacgtacgtaacgtacgtaccgtaacgtccgagtaacgtaccgtacggtaacgttaagttcttaccgttaaactttagttaaaaccgttgaaacgttaaacccgttagttaaccgtttaacggttaacccgttaaccgttaccgtaccggggttaccgtacccggtaaggggtaccccgtaaagggttaaaccgggttaggtaaacccggttaacccgttaacgggtaacccgttaacgtccgggtaacgtccgtacccgtaaaccgg

SEQ ID NO: 217174 - DNA, 724 bp, Homo sapiens
  misc_feature: GYAE6OF02GH0H2.1.34.D01.1.454.CMB.1.raw
  modified_base (592)..(592): a, c, t, g, unknown or other
  misc_feature (592)..(592): n is a, c, g, or t
  modified_base (628)..(628): a, c, t, g, unknown or other
  misc_feature (628)..(628): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatcgtaggacagtattacactactcaacttatcagacagcctagacacgcctagaagtacttttagactaaatttattactgtactaacaagttaattaactacgtaaccccctaggtaggaccgtttacgggccctaagggggaacccctaaaggggtacgtaaacggtacctaaacccggaaacgttcggttacgggcctacggtacctaaaccctagtccgtttacggtacctttacgaaacctttcctttacccccggaccccttaccgttacccaaccggttccaaccgtttccggtaccgtttacgggaaccggttacccgggggtactacgggaaccgtaaacgggtccggaaccgtaaacttacgggacttagaccgagtacgtacgaagcctaagtcaaccggttnaccgtagtacgaacgtacacgttagaacgtacgtanacgtacgtacgacgtacgttacgtaacgtacgtacgtacgtaacgtaacgtacgtaccgtaaccgtaaccgtaccgtacgtaacgtacgactaacg

SEQ ID NO: 217175 - DNA, 739 bp, Homo sapiens
  misc_feature: GYAE6OF02IQCG3.1.34.D01.1.454.CMB.1.raw
  modified_base (353)..(353): a, c, t, g, unknown or other
  misc_feature (353)..(353): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtagacatccaattcgacccagtctccatcctcctgtctgcatctagtggagacagagtacaccatctacgttcggccggggacgagtaccgacggccatccgagcgtatttctttacgtccgtggttcgcgagaccaaacggaaaccgaggggaccgacgcccccttagacgttacgtacggttacgttacgttacgtcgggtacnccgaacgtccgtagtattacggtaccggtacgggtccgggtaccctagtacccgttaggttacgtaggtcggtacgagtcgctacggtcgaacgggtacgtagtaacttacctaccgttacctactaacttatacgacgtaccgtacggtcctacggtaccgtaccgtaccggtaaagttaacggttactttacggttaacttaacttttacgttaacgtacgtaaccgtaaacgttacgtttaaactttacgtaaccgttacccgtaacgggttacggttaccgggttaccgggtaaccgggtaacggggtaaccggtaaggggtaacggtaaaccggtaccggtaaaccgttacggtacgggtaacggtccgtaacgtaccccg

SEQ ID NO: 217176 - DNA, 683 bp, Homo sapiens
  misc_feature: GYAE6OF02FH1FB.1.34.D01.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctagttggagacagagtcaccatcacttggccggagagtcaggtccatcgagcgtattctttagccgttggttcgacaggtcaacgaaaccagggcacgtccctnagactcgtagtcctagtcggtcactatccagttactggacgtaacgggttcgggacccctatccgaaggtttcaaggtgacgtagtcgtacgcttcggtacgggacaggtaacttaaccgacttacgtacctaacgttacacgtacgcgtaccgcgtacggcacgtaccgttaacggtaagtttaacgttttacgtaacttaacgttttaacttactagttaacaacctagtttaactttaacgttaaaccgttaccccttaaggttaccggtaccgggttaccgaaccgggaaccggggtaaaccgtaaacgggtaacggtaaccgttaaccgacccgtaaacgtcggttacggccgtacgaccctacgtcgttaccgttcttacgttccctaacttcccgttacccctacccg

SEQ ID NO: 217177 - DNA, 639 bp, Homo sapiens
  misc_feature: GYAE6OF02G5CDY.1.34.D01.1.454.CMB.1.raw
  modified_base (208)..(208): a, c, t, g, unknown or other
  misc_feature (208)..(208): n is a, c, g, or t
  modified_base (275)..(275): a, c, t, g, unknown or other
  misc_feature (275)..(275): n is a, c, g, or t
  modified_base (295)..(295): a, c, t, g, unknown or other
  misc_feature (295)..(295): n is a, c, g, or t
tcagacgagtgcgtcacgaccggtgctcgatttagatcgtctgtgttgggtttgggggagtcagaccctgtcaggacacagcatggacatgagggtccccgctcagctctgggctcctgctgctctggctcccaggtaccagctggtagacataccctaagttcgaaccccagtcctccactccctccctgtctgctatctattgganacagatcacatcacgttggccggcgagtcaggcctagtcagcgtatttcgttacgtccgttggttcncgtacgacgaacgaaaccgngggaccgaccgccccgtacgagtacgttacgtacgtctagtcggtcacctagtccagtagtcgaggtacggtcgggtccctagtcgtaggttcagtcggacagtgtacagtcgacgggtacgagtacgtactactactcgtaactacgtacacggtcacgtccgtagcgaacgttcgtaaagtacgtttatttagtaacgtttaatttaccttatccgtaattaacgtagtttaacttaacgtacccgttaccgtacgttacgggtacccgttcggaaaccgggtacgggtacgtaacgggtaacgacgtaacccgtacgtacggttggacgtactacggtaac

SEQ ID NO: 217178 - DNA, 685 bp, Homo sapiens
  misc_feature: GYAE6OF02GGBY5.1.34.D01.1.454.CMB.1.raw
  modified_base (104)..(104): a, c, t, g, unknown or other
  misc_feature (104)..(104): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
tcagacgagtgcgtcacgaccggtgctcgatttagatcgtctgtgttgggtttggggggagtcagaccctgtcaggacacagcatggacatggagggtccccgntcagctcctggggctcctgctgctctggctcccaggtaccagcttgtgacatccaattgacccagttctccatcctccctgtctgcatctatgganacagatcacntctactggccgganagtcaggccatcagtcgtattcttagcttggttgacagacaagaaaccgagggcgaaccgcccctagaagacgttacggtacggtactagtggtctacactacctaagtacgttagacgtaaggggtaccgggtaccctaagtacccggtagggttacctaaggtcggacgtaacggtacggtactaacgtccggttaacggggtaactaacgtaacgttaaccgtaacttaccgtaaccttaacgtacttacacggtacctaactcccgtagaccgaacgtccgtagtaacgttaacgtttagtaacgttaactttacttacgttacgtaacctaaacgttagtttaactaacgttaccgttaaccccggtgttaccgggtaaccgttaccggaacggtacggtaacggacggtaacgtaacgtaacgtaaccgtaacgtggtacggttacgtacgtacc

SEQ ID NO: 217179 - DNA, 709 bp, Homo sapiens
  misc_feature: GYAE6OF02IFWQT.1.34.D01.1.454.CMB.1.raw
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (464)..(464): a, c, t, g, unknown or other
  misc_feature (464)..(464): n is a, c, g, or t
tcagacgagtgcgtcacgaccggtgctcgatttagatcgtctgtgttgggtttgggggatcagaccctgtcaggacacagcatggacatgagggtccccgctcagctcctgggctcctgctgctctggctcccaggtaccagctgtgacatccaattgacccagtctccatcctcctgtctgcatctatggagacagagtcacatccacgttcggccggtgagtcaggccagtcagcgtatttcttacgccttggtncgagacaacgaaccgnggggtaccgacgcccccgtacgaacggtagttaccggtagttctaggtgggtacgtactacgtaccgtaagtacgtttaggaccggtaaagggggtccgggtacccctaagttcccggtaagggtttccagggttacggacgtaggtcgacgtagttccggtagggactagtactactactctacaacttntacgacgtcgacgtcctaggaccgtacgtacgtaacggttaagtttactttacgaacgttttaaacttttacgtaccgtacgtaactaacgttaactttaacgttaacgttaacccgtaacccgggttacggttaccgggttaccggttaccgggacggtaaccgggggtaaacctaaggggttaacgtaaccggtaccggaaacccgtttaagggtccggtaacggtcccgtaccggtaacccg

SEQ ID NO: 217180 - DNA, 700 bp, Homo sapiens
  misc_feature: GYAE6OF02F5867.1.34.D01.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (260)..(260): a, c, t, g, unknown or other
  misc_feature (260)..(260): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccattccctccctgtctgctatctattggganacagagtcaccntcactggccgggnagtcaggccatcagcgattcttagcctggttcnctaggacaacggaaaccgagggccgacgtcccctgaacgtactcgtagtctagtggtgcactcagtattggcgtaaggggttcggtaccctacgtccgtaggttacgtaggtcggctaggtcgacctagttcggtacggggtaacagggttaaccttaacctcctttccgtacgtacctttaataccggtaacgccgtaacgcccgttaggccgtaccgtactacggtaaacgtttgttttacggaacttttaaacggtttacttacggtttagtaaccctaagtttaacgtttaacgtttaactaacccgggttaaccccgttacggtacgggtttacccggttaccgggtaacgggtaaccggggtaaacgtaacggggtaacggtaaccgttaacccggtaaaccggtacggttcggtacggacccgttacgacccg

SEQ ID NO: 217181 - DNA, 782 bp, Homo sapiens
  misc_feature: GYAE6OF02HGGWS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatccctcctgtctgcattctattgggacacgagacgtcaacctattcctacgttcggccggggtcgacggttccgaggtccctaatccgaagtccgttaactttcgttttacgccgttaggttcgacgtaacggaacctaaacggaaaacccggacggggaccggtaccgtacccccgtacgaacgtacgttaccggtacgttacgttaacgtcggtacgtacctactaccgtaagtactttacggacggtaaacggggtccgggtacctacgtaccggttacggttacgaacggtcggaccgtagtcgtactaggtaccggtagggaactaacggtaacttaaccgtacgtcctaaccgtaacttacgtacgacgtaccgtaacgtcccgtacgtaccgtaacgtacccggttaagtaacggtttagtttaaccgtaaacgttttaaagtttacctttaacggtacgttaaccgtaaacgttacgtttaaactttaaccggttacccttaacccgttaggtaccgggtaaccggttacccggaacggtaaacgggaacgtacggtaacggaaaccgtacgtaacccgagttcggtcgttcctaagtac

SEQ ID NO: 217182 - DNA, 939 bp, Homo sapiens
  misc_feature: GYAE6OF02F693K.1.34.D01.1.454.CMB.1.raw
tcagacgagtgcgtcacgaccggtgctcgatttagatcgtctgtgttgggtttggggagtcagaccctgtcatgacacagcatggacatgacgggtccccgctcagctcctggggctcctgctgctctggcctcccaggtaccagctgtgactactccgaattcgaccctagtcctccattccctcctgtctgctatctagttggatacagacgtccacctatacctacgttcggacccgggtcgtacggtacgaccggtaccctaagtccgacggtccggttaacttttccgtttacggtccgttcgggtttacgaccgtaacggtaccaaacgggaaaccccggtacggggaccgtacccggtccccccgtaagtaacggtaacgtttacccggttaacgttaccgttaaggttacgggtccgtaccgttaaccgttcccgtaaggtacgtttaccgggaacggttaaccggggttcccgggtaacccctacggttcccgttaacgggtttaccgtaacgggttcggtaaccgtcggttaaccggtaccgttacgggttacccgggtttaaacgggaaccttaaacggtttaacccgtttaacccgttaaccgttcccgttaaacgtacccgttactaacggtaccgtaccgtaccggtaccgtacgtaccgtaccggtaaccgttaagttaacggtttactttaacggtaacctttaaacgttttacccgttaacgttacgttaaaccgtaacgttaagtttaaacgtttaaccgttaacccgtttaacccccggttaggttaacccgggttacccggtttaaacccgggtacccgggtaaaaccggggttaaccggttaaacgggttaaaccgggaaccgtttaacccggtaaaccgggttaaccgttaccgggtaccggtacccgttaacccgg

SEQ ID NO: 217183 - DNA, 884 bp, Homo sapiens
  misc_feature: GYAE6OF02F6Q2K.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacataccaattcgacccagtcctccatcctccctgtctgcatctattggagacagtactccaaccatccacttcggcccgggcgacgtcaaggcccaatccgaagtcgtaatttcgtttacgcccgtttaggttcgacctaggacaacggaaaacccggaggggaccggaccgtacccccgtagaaggtaacgttccggttaagttccgttaagtcggggttacgacctaacgttacccgtaaggtaagtttaccggaaccggttaaacgggggttccgggggttaccccctaaaggttacccggttaacgggtttaccggtaaggtcggggtaccgtaaacggttcggaacctaacggttttcccgggaacgggggtaaaccttaacgggttaaactttaaacctacccgtttaccgttaaccgtaacctttaacgacctaacggtaccgtaaccgccgttaacggcctaacgggtacccgttaaaggtaaaccgtttatttttacggtaaacgttttaaacttttaacggttttaacctacggttaaaccgtaaaacgtttaccgtttaaaatttaaccggttaaacccgttaaccccggtttaacgggttcgggttaaccggtttaccgggacccggggtaaacggggtaaccgggtaaacggggttaacggtaacgtaacccggtaaaccgttaaccggtacgggttaaccggtccggtaacgtaaccccg

SEQ ID NO: 217184 - DNA, 581 bp, Homo sapiens
  misc_feature: GYAE6OF02IB2OT.1.34.D01.1.454.CMB.1.raw
  modified_base (102)..(102): a, c, t, g, unknown or other
  misc_feature (102)..(102): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (461)..(461): a, c, t, g, unknown or other
  misc_feature (461)..(461): n is a, c, g, or t
  modified_base (567)..(567): a, c, t, g, unknown or other
  misc_feature (567)..(567): n is a, c, g, or t
  modified_base (576)..(576): a, c, t, g, unknown or other
  misc_feature (576)..(576): n is a, c, g, or t
tcagacgagtgcgtcacgaccggtgctcgatttagatcgtctgtgttgggtttgggggagtcagaccctgtcaggacacagcatggacatgagggtccccgntcagctccgtgggctcctgctgctctggctcccaggtaccagctgtgacatccaattcgacccagtcctccatccctccctgtctgcatcgtagtggagacagacgtcaccatccgacttcggccgggcagtcacggccagtcagtcgtattcttagtccgtggttgctagccgaagaaaccgngggccgacgccccgtanagtacgttcgtagtcgtagtggcactactcgtagtagtgacgtagggtcggtcccagtccgtagtcgaaggtgacgtagtcgactagtcgtagggactagtaactactacgtacgtctaactctacgagacacggtcctgctacgccgtagtaacgtntttacgacttaaagtttctacgtactaactaacgtatttaacgtacttaaccgtacccgtagtcggtacgtccggtaacgacggtactaggtgtaacgacgacgtncggcgtacngtacc

SEQ ID NO: 217185 - DNA, 665 bp, Homo sapiens
  misc_feature: GYAE6OF02HPYVR.1.34.D01.1.454.CMB.1.raw
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (398)..(398): a, c, t, g, unknown or other
  misc_feature (398)..(398): n is a, c, g, or t
  modified_base (522)..(522): a, c, t, g, unknown or other
  misc_feature (522)..(522): n is a, c, g, or t
  modified_base (534)..(534): a, c, t, g, unknown or other
  misc_feature (534)..(534): n is a, c, g, or t
tcagacgagtgcgtcacgaccggtgctcgatttagatcgtctgtgttgggtttgggtagtcgaggccatcagcgattctttagcctggttgcagcagaaaccagggcgagcccctcagatcgtagtctatggtgcatccagattgcaagggtgggtcccatccaggttcagtggcagtgcatcgngggacagattacactcncactatcgagcacgcctgacacgactaggaaacttagttttagaccttaaaattttacttactcgtaactaaacgtagttaatttaacaccggttaccccctaaggtcggtacggtcccggaaccgtaggggaacctaagggtacgaacgtacctaaccggacttgggtacggtctacgcctaaacctgtccgttnttaccttacgaattcccgttccccgctaacgttcgtaacgtaaaccgccaaccgtttcgtacgcggtaagggtcccggccgttacgggaaccggtaacgggtccgtaaccgtagttaaaccggntcgactcggacncgcgtaagcccgtaacgtagctacgacgtacgacgtacgtacgtacgtacgtacgtcgacgacgtacgtacgtagtacgtacgtacgtacgtagtacgacgtaccgacgtcgacgacgtacgtagtagtac

SEQ ID NO: 217186 - DNA, 497 bp, Homo sapiens
  misc_feature: GYAE6OF02FZQL4.1.34.D01.1.454.CMB.1.raw
  modified_base (204)..(204): a, c, t, g, unknown or other
  misc_feature (204)..(204): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (458)..(464): a, c, t, g, unknown or other
  misc_feature (458)..(464): n is a, c, g, or t
  modified_base (466)..(497): a, c, t, g, unknown or other
  misc_feature (466)..(497): n is a, c, g, or t
tcagacgagtgcgtcacgaccggtgctcgattagatcgtctgtgttgggtttgggagtcaggccatcagcgattctttagcctggttgcagcagaaaccaggggcgagcccctcagatcgtagtctatggtgcataccaaattgcaagggtggggtcccatccaggttcaggtggcagtgcatcgtgggacagattacactctnactatcacgcagtcctgccagcctaggaagtattttgacttaatttattactgtacaacagttattaactacgttaccccctaggtggcgtttccggaccgtagggggaacccaaggggtggaacgtaccgaaccgtaatggtgctcgaccacgtatctgtacctcgaccttcccgttcccacccttaaccgtcacccgtctaaccttcgtcgaggaccgggtcggcgtcgacgacggctagatgcngtcngcnnnnnnngnnnnnnnnnnnnnnnnnnnnnnnnnnnnnnnn

SEQ ID NO: 217187 - DNA, 796 bp, Homo sapiens
  misc_feature: GYAE6OF02GXTVW.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacataccaattcgacccagtcctccactccctccctagtctgctattctagttggaagacgagactcacctatcctacgttcggccgggtacgacggtaccacggcctatccgagtctagtttccttacgtccgttggttagaccgtaagtacccgaaacggtaaacccgacgggggaccctacccggcccccgtacgaacggtactttaccggtaacggttaccgttaaggtgggtaccgtctaaccgtacggtaggttaccgtcggaccgggtaaacggggttccgggtccctaacgttccggttaggttaccggtacgtagggcgttaaacggtcggtactaccggtagttacgggtaacgtacgtactaccgtacctaccttacgtaactcgtacacggtacaccggtcccgtgaccgtaccgtacggttaagttacgtttacgttaggtacctttaagttttaaccgtccgtttaaacgtacgttaacgtacgttttaacgttaaacgttaaccggtttaaccccgttgggtttacccgggtaccgtttaccggggaacccgggttaggtaaaccgggtacgggttaacggttaaaccgaccggttaaccgtcggtacgggttccggtagtcccggtaaccg

SEQ ID NO: 217188 - DNA, 921 bp, Homo sapiens
  misc_feature: GYAE6OF02FNE16.1.34.D01.1.454.CMB.1.raw
  modified_base (104)..(104): a, c, t, g, unknown or other
  misc_feature (104)..(104): n is a, c, g, or t
  modified_base (215)..(215): a, c, t, g, unknown or other
  misc_feature (215)..(215): n is a, c, g, or t
tcagacgagtgcgtcacgaccggtgctcgatttagatcgtctgtgttggggtttggggggagtcagaccctgtcaggacacagcatggacatgagggtccccgntcagctcctggggctcctgctgctctggctcccaggtacccagctgtgacatccaattcgacccagtcctccatccctccctgtctgcatctatggagacagagtccaccntcctacttcggaccgggcgtaggtcgacggcctatcgaggccgtaatttcctttacgtccgttgggttcgcaacgaccgtaaaggaaaaccccggagggtacccggacccgtaccccccgtacgaacggtaaccgtttcgttaaaccggtttacgttagggttacgggtccgtaacctaactttacccgtaacggtaacggttttaccgaaccgggtaaacgggggtcccgggggtaacccctacggtaccccgggttacggtttaccgtagggtacgggtacgtaaggtcgtacgtaaccggttcgggtacggggtaaccgtaaggtaaccctttaacccgtacccttttaccgtacccgttaaacccttaaccggttaacaccgggtaaccttaccccggggaccccttttacggaacccggtaaccgggttaccgtttaaagggtaaaactttttaccggtttttaaccgtaaacgtttttaaatttttaacgtttaaacccgtttacgttttaaaacggtaaaacctttaacgggttttaaactttaaacccgtttaaaccccgggtttaaaccccgtttacggggtacccggttaacggggttaccggggtacccggtaaaccggggtaacgtaaacggggttaccggtaaaccgaaccgttaaccggtaaacgttggtaaccggttcgtaccggtaaccc

SEQ ID NO: 217189 - DNA, 895 bp, Homo sapiens
  misc_feature: GYAE6OF02IAWSP.1.34.D01.1.454.CMB.1.raw
  modified_base (887)..(887): a, c, t, g, unknown or other
  misc_feature (887)..(887): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctcgtggctcccaggtaccagtctgtgacatccaattcgacccagtcctcatcctcctgtctgcatctagttggatacagtacgtcacctatccgtacttcgggcccgggtacgaagtcgaacggccctaagtccgaggtcgtacgttttacctttacggtcccttaggggttcgaccgtaggaccgaacggtaaaacccgagggggtcccaaacggtcccccccgttagaacggtacgttaccggttaacgttccttaaggttgggttacgactaacgtcccgtaaggtcttcgggacgtaaacgggggttccggggtcccctaagttacccggtacgggttacgaacgggttcggtaccggtacgggttacgtacgtaccggtttacggtacgggggtaactaaccgggtttaactttaacccgtaccgttttacccgttaaaccgtaacccgtttaacgttaaccggacggttaaaccccgtccggtttaacccggtaccgggtacccgtaacggtttaaccccggttaaagggtttaaaacccgttttaggttttacccggttaactttttaaacgtttttacccgtttaagttaaaccggttaccgttaaacttaaacgggtttaactttaacccgttaaaccgggtttaccccggttacgtttaccgggttaaccgggtttacggcccgggttaaacggggaaccgtaacggggttacggtaacgtaaccggtaccgtaacggtggtacgtacggngtaacccg

SEQ ID NO: 217190 - DNA, 622 bp, Homo sapiens
  misc_feature: GYAE6OF02F4M9G.1.34.D01.1.454.CMB.1.raw
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
  modified_base (615)..(615): a, c, t, g, unknown or other
  misc_feature (615)..(615): n is a, c, g, or t
tcagacgagtgcgtcacgaccggtgctcgatttagatcgtctgtgtttgggtttgggggagtcagaccctgtcaggacacagcatggacatgacgggtcccccgctcagctccgtggggctcctgctgctctggctcccaggtaccagctgtgacactaccaattcgaccctagtcctaccactccctcccttgtctgctatctagttggagacgagacgtccaacctatactacgttcggcccgggcgagtcgacggccatcgagtctatttcgttagccgttggttncagacgaaggaaaccgngggccgaccgcccctgagtcgtacgtagtctagtcggtcacactccagtattgacggtaaggttccggtaccagttccgtaggttcaggtcggctagtcgatacgtcgtgggaactagtacttactctctctacttntacgacgtcncgtcgtacgcctacgtcgtaagtacgtttagtttactactttaatttacttacgtacgtaataccttagttaacttacgttacccgttaccgtacggtcgtacggtaccggacggtaacgggtaccgtaaggtacgaacgtaccgacggtagcggtacggtnacgtacc

SEQ ID NO: 217191 - DNA, 756 bp, Homo sapiens
  misc_feature: GYAE6OF02GL8TE.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctactggctccgaggtaccagctgtgacatccaattcgaccagtctccatcctcctgtctgacactctagttggagacagacgtaccaaccatctacgttcggccggagtacgtcgacggtcctaagtcgaggtacgttacgtttccgtttaacggccgttacgggttcgaccgtaacgtacgaaacggtaaaccggacggggaccgtaccgtaccccctagtacggtaacttaccggttaacgttccgtaacggttcggttgacccgtaactaccgtaagtacgttcgggaaccggtaacggggttccgggtacccctaacggtaccggttacggttacgtaacgggttcggacggttaggtacgacgtacgttacggaggaacgtagttaacgttaaccctacgttcctaacttactacgtacgactcgaaccggtccaggacctacggtacttaagggaacttagtttaacgagttttaaacttacgttagtaacgttaactaacgttagttaaccgtttaaccttaaccggttaaccgtagggtacggttacccgtgggaaccggttaacgggactaagggacccgtaagtaaccggtaccgtaggtggtccgtaccgtaggtaaccc

SEQ ID NO: 217192 - DNA, 573 bp, Homo sapiens
  misc_feature: GYAE6OF02HUWR4.1.34.D01.1.454.CMB.1.raw
  modified_base (257)..(257): a, c, t, g, unknown or other
  misc_feature (257)..(257): n is a, c, g, or t
  modified_base (284)..(284): a, c, t, g, unknown or other
  misc_feature (284)..(284): n is a, c, g, or t
  modified_base (392)..(392): a, c, t, g, unknown or other
  misc_feature (392)..(392): n is a, c, g, or t
  modified_base (565)..(565): a, c, t, g, unknown or other
  misc_feature (565)..(565): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttgccgggcagtcaggccatcagcgtattcttagcctggttncagcagaaaccagggcgacgcccctanagactcgtagtctagtggtgcatccgagtattggacgtaagggtcgggtcccagtccgaggttcaggtggacagtcgcatcgaggactagacttacactctactactntacacgctagcctgcacgtctagtaagttactttagacttaattttacgtacttacgtaactaacgtattaaacttagtaacccgttaaccccgtaggttcggtaccggttacgggaccgtacggggtaacgtaaggtacggaacgtaccgaaccggtagtcggtaggtaccnggtaaccc

SEQ ID NO: 217193 - DNA, 804 bp, Homo sapiens
  misc_feature: GYAE6OF02F5VDD.1.34.D01.1.454.CMB.1.raw
  modified_base (218)..(218): a, c, t, g, unknown or other
  misc_feature (218)..(218): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtcctccatccctccctgtctgcatctattggagacagagtcacatcacgttcggccgggcgacgtcgacggcctancgagcgtattcttacgccttggttcgcagcaacgaaaccgacgggcgacgccctacaggtactacggtagtcttagtggtcggactaacgtccgaagtacgtttacggacggtaaaggggtccggggttaacccacgttaccggtacgggttacgtacggttcggccgtaaggttcgaccgtagttccgggtaggggtaacctaaggttaccttaaccgacctttacctaccctaaacgttataccgacgacctaaccggtccgtgtacccgacggttaccgtaaagggtaactttacgttttacggaactttaactttttaacgttactacccgtttacaaacgtttaacgtttaactttaaaccgttacccggtaaaccccgtttagggtaacgggttaccgggttaacccgggaccggtaaccgggggttaaaccgaacgggggttaaacgtaaaccggtaccggtaaaacccgttacgggtacggggttactaaccggttacgtaaccccgtaacgggttctacgggtttttaacccgtcttttaaccccggtaaccggtttcccccttaaccccgggtacc

SEQ ID NO: 217194 - DNA, 725 bp, Homo sapiens
  misc_feature: GYAE6OF02I2NW7.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagacgtcaccatctacgtggccgggcgtagtccaggccatccgagcgtattctttacgtccgttggttgcagcgaacgaaaaccgagggcgaccgcccctagacgtagttacggtagtctagtggtcgcactccagtagttacgaggtaacgggtcgggtcctagtaccgtacggttacgaggtgacgtagtgtactaagttcgtaggggaactagtaacttaacctctacgtacgtacttacgtacgcgacttacccggccttaggcccgtaacggtaccgttaaggtaacgttttagttttaaccggtaacttttaaagttttaccttaacggttcgttaaacgttaaaccgttagtttaaacgtttaaaccgttaacccgttaacccggttgggtacccgggttttaccgggtacccgggtaaacccggggtaaaccggggttaccggaaacgggttaacgggtaaccgttaaccccgtaaacgggttaacgttcgggtacggttaccgttaccggaacccg

SEQ ID NO: 217195 - DNA, 791 bp, Homo sapiens
  misc_feature: GYAE6OF02JKUJT.1.34.D01.1.454.CMB.1.raw
  modified_base (141)..(141): a, c, t, g, unknown or other
  misc_feature (141)..(141): n is a, c, g, or t
tcagacgagtgcgtcacgaccggtgctcgatttagatcgtctgtgttgggtttgggggagtcagacctgtcaggacacagcatggacatgaggtcccgctcagctcctgggctcctgctgctctggctccaggtaccagcngtgacatccaattcgacccagtctccatccctacccgtgtacctgctatcctagttggacgacagacgtcaccatctacgttgcccgggtcagcctacggccctaagtccgagtaccgtacttcgttacgccgtgggttaacgtccgagacccaaaggaaacccgtagggggtaccctaccggtaacccccgttcggaaacgtacgttcccggttaagttccgttacgtacggggttcctacctacgtaacccgtaactaaggtttaccgacgttaacgggggtcgggtaacccctacgttacccggtacgggttacaaacggggtcgggttaacctcgggtaccgtacgaacgtttcccggttaagggggaaccctacgtaaacggttaccctaaaccctcgttaacccgggtaaacgttactaccggtaagtaccgtacccggtacctcggtaccgtaccgttaccgtcgtaaacgttatccgttaacgtttaccgttaacttacgtaccgtagtaacgttactaacgttacgttaacggtccccgttaaggtacgtaccggttacggaccggtaaccgggtagttaaccgggtaccggtaaccggttaaccaaccggtacggtacgtaacgggtcgtaactacccgg

SEQ ID NO: 217196 - DNA, 688 bp, Homo sapiens
  misc_feature: GYAE6OF02HVGBU.1.34.D01.1.454.CMB.1.raw
  modified_base (103)..(103): a, c, t, g, unknown or other
  misc_feature (103)..(103): n is a, c, g, or t
  modified_base (127)..(127): a, c, t, g, unknown or other
  misc_feature (127)..(127): n is a, c, g, or t
  modified_base (672)..(672): a, c, t, g, unknown or other
  misc_feature (672)..(672): n is a, c, g, or t
  modified_base (683)..(683): a, c, t, g, unknown or other
  misc_feature (683)..(683): n is a, c, g, or t
tcagacgagtgcgtcacgaccggtgctcgatttagatcgtctgtgttgggtttgggggagtcagaccctgtcaggacacagcatggacatgacgggtccccgntcagctcctgggctcctgctgctntggctcccaggtaccagctgtgacatccaattcgacccagtcctccatccctcctgtctgcattcttagtggacgacgagataccacctatcgtacgttcggccgggacgagtacgacggccagtcagtcgtatttcttacgtccgttggttacgctacgacgaaacggtaaaacccggaggggacccgtaacccgtccccgtacgaaggtacgttaccggttaggtaccgttaagtcgggttacacctacgtaccgagtagtttaccggaggtaaacggggtccgggtaccccaacgttaccggtaggtttacgaaggtcgcggtaggtcgtcgtaacgtcggtaggaacgtacgtttaactaccctacgtttccgtaaacattacgacgacgacgtacgtcccgtagaaccgtactactacggttaatttcggtttaaaccgaatttacttttaacctagtttcgaaacgtttaactaagttaacttacgtaaccgtaccgtacggtcgtaccgtacggacgtacggacagggtacagtaacncgtatgtccgnactac

SEQ ID NO: 217197 - DNA, 755 bp, Homo sapiens
  misc_feature: GYAE6OF02F2DIC.1.34.D01.1.454.CMB.1.raw
  modified_base (269)..(269): a, c, t, g, unknown or other
  misc_feature (269)..(269): n is a, c, g, or t
tcagacgagtgcgtcacgaccggtgctcgatttagatcgtctgtgttgggtttgggcatggacatgagggtccccgctcatctcctggggctcctgctgctctggctcccaggtaccagctgtgacatccaaattcggaccctagtactccacgtccctccctgtctcgcaattctattcggagacagtacgtcaacctatcgacttcgggccgggagtacgtacgacggcccagtccagtccgtactttctttacgccgttggttacnctagacaacggaaaccgacgggcgaaccgtcccctagtaaggacgtaccgttacgtaccgttagtcggttacgactactaccgagtacgttcggacgtaacggggtccgggttaccctacggtacccgtaggttaccgtaggtacgacgtacgtcgtaacttagtccggttaggaccttaaggtacctaaacgtaccgtactccgtaaacgttacctacgacgtaccgtacgccttaacggtcgaacgtttacccgtaagggtaacgtttacgtttaacggtaaacctttaacgtttaacgtttctacggtttaaacccaaaggtttactaacgtttactaaaccgttccgtaaggttcgaccggttcgaaccggtaacgggtacgtaacggtcgtaaacgtaaccggtaaccgaacgttacggcggttaccgaggtaacctaccggtgttacttccggttaccacttacccgttctaccccgtac

SEQ ID NO: 217198 - DNA, 928 bp, Homo sapiens
  misc_feature: GYAE6OF02HT13N.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccgaggtaccagctgtgacatcctaattcgaccctagtctccatccctcctgtctcgctatctagttggagacgagtacacgactactaccgtcggtccgggaccgggtacgtacgtcgaccgtacactacgagtcttacgtttacgtaccgcgttcggtacgagtaccgaacggtaaaccggaaccgggcggggtaccgacccccgtacccgtagaacggttaccggttacgttacggttactacgggttcgggacctcctaacgttaccgtaaggtacgtacgggtaacggtaccgggggttaccgtacccttacggtacggttacggttacggtacggtacggttacggtacggttactaacgggttaccgttaggggtaaaccgtaccggttaaaaccgtttacccttaacccgtttacccgtaaacccgtttcggaaaaccctttcgtaaacccgggtataacccggttacccggtactacccgggttaacccggtccgttaaaccgtttaaacgggttaacttttacggtttaacccgttaaagtttttaaccctttaacggttaccctaaccggtaaaccttaacggttttaacctttaaacccggtaaccgtttaacccccgggttaaccggttagggggtttacccctacgggggttaaccccgggtaaacccggggtacgggtttaaaccgggggtaaccgggtaaacccgggtttaacccgaaccggggtttaaaccccgttacgggtaccggggttaaccgtacccctaggtaaacccccg

SEQ ID NO: 217199 - DNA, 610 bp, Homo sapiens
  misc_feature: GYAE6OF02G804M.1.34.D01.1.454.CMB.1.raw
  modified_base (113)..(113): a, c, t, g, unknown or other
  misc_feature (113)..(113): n is a, c, g, or t
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (567)..(568): a, c, t, g, unknown or other
  misc_feature (567)..(568): n is a, c, g, or t
  modified_base (570)..(570): a, c, t, g, unknown or other
  misc_feature (570)..(570): n is a, c, g, or t
  modified_base (572)..(573): a, c, t, g, unknown or other
  misc_feature (572)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (600)..(601): a, c, t, g, unknown or other
  misc_feature (600)..(601): n is a, c, g, or t
  modified_base (604)..(605): a, c, t, g, unknown or other
  misc_feature (604)..(605): n is a, c, g, or t
  modified_base (607)..(607): a, c, t, g, unknown or other
  misc_feature (607)..(607): n is a, c, g, or t
tcagacgagtgcgtcacgaccggtgctcgatttagatcgtctgtgttgggttgggagtcaggccatcagcgattctttagcctggttgcagcagaaaccagggcgagcccctnagatcgtagtcatggtgcatccagattgcaaggtgggtcccatccaggttcagtggcngtgcatcgtgggacagtattaacnctcncactatcacgcacgcctgcctagcctagtaagtagttttnactaattttacgttaacctgttaaccaaacgtattaattacgttaaccgtaccccgttaaggttcggtaccggttccggcccggtaacgggggacctaaggggtacggaaaccgttccgaaacccgtaacgtgggttcgtaactcggtaccaccgttagtccgttacggttaccttacgtaccttcccgtttccccctccctttcccgttaacgccctaaccggttccgtacgtcgggtaacgccgggggttcctacgggtaccggaacggtccccgggtactaagtaaccggcgatccgngngcngncgngntgntgncgcgcncgnngngnngngngngtgngcgnctgcncngngcgnngcnngngcg

SEQ ID NO: 217200 - DNA, 855 bp, Homo sapiens
  misc_feature: GYAE6OF02F6HDV.1.34.D01.1.454.CMB.1.raw
  modified_base (144)..(144): a, c, t, g, unknown or other
  misc_feature (144)..(144): n is a, c, g, or t
  modified_base (203)..(203): a, c, t, g, unknown or other
  misc_feature (203)..(203): n is a, c, g, or t
  modified_base (811)..(811): a, c, t, g, unknown or other
  misc_feature (811)..(811): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctcgtggctcccaggtaccngtctgtgacatccaattgacccagtctcctatcctccctgtactgctatctagttgganagagactccaacatctaacgttcggccggggacgtacgtaccggacggaccctaagtccaggtaccgtacttttaccgtttaacggcccgtttggggttacgaccgtaccggaaccgtaaaccggggaaaaacccgttgggggaacccgtaccgtaccccccgttaggaacgtaactccggggtttacttacgttaacggtttcgggaaccgtcgttaaacctccgttaaagtgggttaacgtacgggttaaacggggtccgggtccctaaacgtttccccggtagggtttacccaaggggtttcccgggaagtaacggtttggaaccccgtttattacccgggggtaccgttaagaacggttaactttaacccgtaaccggttacttaaccggtaacctttacgggactaaccggtaccacggaccgttaccggaacgtccgttaaccgtaaggttaacggtttaaccgttttaccggtattttaaaaccgttttataccgttaaccgtaaccgttaaacgtaacttacgtttaacgtttaacccggtaacgttaccggttagggttaacccggttcggaaccggtaacgggtactaaccgggttanaaccgggtaacctcggtaaaggtcggtacgtacgaccgttaccg

SEQ ID NO: 217201 - DNA, 633 bp, Homo sapiens
  misc_feature: GYAE6OF02HIIX2.1.34.D01.1.454.CMB.1.raw
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagatcaccatccacttgccgggcgagtcaggccatcagcgattcttagcctggttcgcagcaagaaaccgagggccgagccccctcagacgtcgtagtcctagtggtnactatccagtagttgacgaagggtcgggtaccccagtccgtaggttcaggtcggacagtgactntcggtagggcagtattaccnctcctcaactntcacgacacggcctaggcctacgtcccgttaggtaaagttacttttcgaaccttaaatttttaccgttaacgtttacgttaacgaacttaagtttactttaaacgttaacccggttaacccgttacgggtacggtaccggtttcccgggaccggtaacggggtaaccgaaggggttaacggtaaccggtaccgtaacccggtattaccgggttaacggcctaaccgtcccgg

SEQ ID NO: 217202 - DNA, 683 bp, Homo sapiens
  misc_feature: GYAE6OF02FVXZU.1.34.D01.1.454.CMB.1.raw
  modified_base (218)..(218): a, c, t, g, unknown or other
  misc_feature (218)..(218): n is a, c, g, or t
  modified_base (533)..(533): a, c, t, g, unknown or other
  misc_feature (533)..(533): n is a, c, g, or t
  modified_base (600)..(600): a, c, t, g, unknown or other
  misc_feature (600)..(600): n is a, c, g, or t
tcagacgagtgcgtcacgaccggtgctcgatttagatcgtctgtgttgggtttgggagtcgaggccatcagcgattctttagcctggttgcagcagaaaccagggcgagccctcagatcgtagtctatggtgcatccagattgcaaggtggggtcccatccgaggttcagtggcagtgcatctgggacagattacactctcgactatcagcagcctgnagcctgaaggtattttggactaagtttacttactgtactaacgtaggtaatttactagttaaccccctaggttcgaccggttggtacccgaagggggtaaccccaaagggtacggggaagttaaccgaaaaccggtaactacggttacgcggttacgccaaccccggtaattccgttgttacccgttacctacgttacccttccccgtaccccttaccgtcgtaaaccgcccgtaaacctcgggtttacctaccgggtaggtacccgggcgtacggggttccgaaaggggttccgccgggaaactttagggaccncggtagtaccacgtctacgagccgtatcggactacgtcacgacggtcgaattcgggaattccgacgngtacgtacgtacgtcgacgtacgtacgtccgtccgtacgtacgtaccggacgtacgacgtacctacgtacgtaccgtactacg

SEQ ID NO: 217203 - DNA, 835 bp, Homo sapiens
  misc_feature: GYAE6OF02FQRT1.1.34.D01.1.454.CMB.1.raw
  modified_base (504)..(504): a, c, t, g, unknown or other
  misc_feature (504)..(504): n is a, c, g, or t
  modified_base (806)..(806): a, c, t, g, unknown or other
  misc_feature (806)..(806): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtcctcatccctccctgtctgcatctattgggagacagacgtcaccatctacgttcggccgggcgagtcgacggccatcgacgtcgtactttctttacggccgtttgggttcgcgtaacgaccgtaaacggaaacccggaaggggccgtaaccccggtaccccctaagaacggttacgtaccggttaacgtcgttaacggttcggggtactacctacgtaaccggagttaacgttcggaaccgggtaacggggttccggggtacccctaagttaccggtaaggtttccgaggttccggagtacgtacgtactacgtcggaggtaactacggtaccttacgactttacctaacgtaccgttacnccgaacgacccggtatcccgtacgacgtaccgggttactaccgggttaaagtttacgtttacgtaaccgttttaaacttttacgttaaccgggtactaaaccgtttaaacgttacgtttaaaccggttttaaccggaaccccgggttttaaccccgtaggggttacccggttaccccgggtttacgggaacccggtaaacggggggtttaacccaaggggttaaccgtaaccgtaccgttaaccgaacgggttcgtacgggtacctacggtacccgtataccggttacgttccgtttaaccnccgtttacccttcccgtaccccttcccgg

SEQ ID NO: 217204 - DNA, 623 bp, Homo sapiens
  misc_feature: GYAE6OF02IY8XA.1.34.D01.1.454.CMB.1.raw
  modified_base (172)..(172): a, c, t, g, unknown or other
  misc_feature (172)..(172): n is a, c, g, or t
tcagacgagtgcgtcacgaccggtgctcgatttagatcgtctgtgttgggtttgggggagtcagaccctgtcaggacacagcatggacatgagggtccccgctcagctccctggggcctcctgctgctctcggctccccaggtaccagcctgtgacatccgaattcgacccngtctccatcctccctgtctgcatctatggagacagacgtcaccatcacttgccgggcgagtcaggccatcagcgattcttagccgttggttcgcagcaacgaaaaccgaggggccgaacgcccccgtacgaagtagtccgtaagtcgtaacgtggtagtaaatcccaaggtattggacgtaaagggtccgggggttacccagtcccgtaagggttccaaggtggacctaggtggctatcgtaaggggaccaagtaacttacacctctacgaactactcgtagcaacgccgtgccaagtcctaggaagttagtttacaacttaatttacttacgtgtaacaaagtagttaatttaacgtaacgttaaccctagttacgtaccgttcggaccgtaagggaaccgtaagggtacgaacgtacgtaaccgtacgtagtacggactcgactaaccg

SEQ ID NO: 217205 - DNA, 765 bp, Homo sapiens
  misc_feature: GYAE6OF02JYAQ5.1.34.D01.1.454.CMB.1.raw
  modified_base (591)..(591): a, c, t, g, unknown or other
  misc_feature (591)..(591): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacagagtcaccatcacttggccgggcgagtcgaggccatcagctattcgttagccttggttacgctacgacgaacgaaaccgtaggggaccgaacgcccccgtagtacgaacgttcgttaacggtacgttaagtcgggttacgaccgtaacgttaccggtaacgtaacgtttacggggaaccggtaaacggggggttacccgggggttacccctaaccgggtttaaccggttacgggtttacccgaagggttaccggggtactaacgggtacgaacgttaccgtaccgggttaaggggacctaaggttaaacttacctaccgttactacctaacgttacgttaccacggacgtaacggtccttaggaccaaggttccggtaagtaaacggttnttttcggaaaacctttatttttaaacgtcttaacgtaaccaaacggtttaatttaaacgttaacgttaaccgtacccgttaaggtcggttaaccggttccggaacgggtaacgggtaccggaaagggttacgaaccggtacgaaaccgtaggttacgtcggtacacgtaacccg

SEQ ID NO: 217206 - DNA, 691 bp, Homo sapiens
  misc_feature: GYAE6OF02JI2NG.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatcctccctgtctgcatctagttggagacagagtccaccatcacgttcggccgggcgagtcgacggaccatcgacgcgtatttccgttacgccttggttcgcacgcaacggaaaccgcgggacgaccgcccctacgagtacgttaccgtagtctagtggtactcacgtaccagtacgttcgacggtaacgggttcgggtacccacgttaccgtacggttacgaggtcggacgtacgtcgacttacgtcggtacgggacgtacgtaccttacgtacctctaactactacgtcacgtctacgccgtagacctacggaccgtaggtaactttcgtttacgaactttaacgttttaagttcccgtaattaccgtaaactttaagtttaactttaaccgtaacccgtttacccgtacggttacgggttaccggtccgggtaaccggaacgggtaaaccggttaggggtaaccgtaacgttaaaccggtaacccgtagggttcgtacggtccgtacgtaacccg

SEQ ID NO: 217207 - DNA, 719 bp, Homo sapiens
  misc_feature: GYAE6OF02JW41O.1.34.D01.1.454.CMB.1.raw
  modified_base (420)..(420): a, c, t, g, unknown or other
  misc_feature (420)..(420): n is a, c, g, or t
tcagacgagtgcgtcacgaccggtgctcgatttagatcgtctgtgttgggtttgggcatggacatgaggtcccgctcagctcctgggctcctgctgctctggctcccaggtacccagctgtgacatccaattgacccagtctccatccctccctgtctgcagttctagtggacgacagagtcaccatcacttgccgggactagtccaggccatccagtcgattcgtttagcctggttgaccagccgaagaaccgagggcgtaaccgccctacgaacgattacgtagtcctaagtcggttagccagttaccgagtacgttggacgtaagggttccggggtacccctaacggtttaccgaacgggtttacctagggtacggtacgttacggttaccgcgttagttaccggttccggggaaanaccggtaagttttaccgacctttaccgtctaaccgttaacgtccgagtcccgtaacgtccgtacgccgtacgtaccgtagtaaacgtacgtttagaaccttaaacgtttaagttaccgttagtactaacgttaacgtacgtttaacgttaccgttaaccccgtagtaccggttaccgggtacgtaccgggtacgggtaacgtacggtacggaacgttacgaccgtaacgtcggtaacgtcgtacgtactaccgtacgttacgttaccgttacttaccgtacttaccgtaccgtaacccg

SEQ ID NO: 217208 - DNA, 676 bp, Homo sapiens
  misc_feature: GYAE6OF02FVQ0Q.1.34.D01.1.454.CMB.1.raw
  modified_base (212)..(212): a, c, t, g, unknown or other
  misc_feature (212)..(212): n is a, c, g, or t
  modified_base (454)..(454): a, c, t, g, unknown or other
  misc_feature (454)..(454): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagttggagacagagtccaaccntacacgttcggccgggcgagtaccgacggccatccgagtccgtattcgtttagccttggttgacagaccgaacgaaaccggacgggaccgacgcccctacgaagacgttacgtacgttactacgttaggcgaccaactccaagtagttaggaccggttaaggggtccgggttacccctagttacccgtaacgggttacagggtcggacgtaggtgacctagtcggtaggacgagtacttacncttacgactacgtactcacgaccgtcgccgtggcacggtaccgttaagaacgttatttacggaatttaaacgtttacgttacgttacgtaacctaattaacgtttaacttacgttaacccgttaccgttacgccgggttaaccgtcccgggtaaccggtacggtaaccggtaggtacggtaaacgaccgtaaccggtagttacggacggtactcgtaacccg

SEQ ID NO: 217209 - DNA, 715 bp, Homo sapiens
  misc_feature: GYAE6OF02FYV79.1.34.D01.1.454.CMB.1.raw
  modified_base (102)..(102): a, c, t, g, unknown or other
  misc_feature (102)..(102): n is a, c, g, or t
  modified_base (126)..(126): a, c, t, g, unknown or other
  misc_feature (126)..(126): n is a, c, g, or t
  modified_base (295)..(295): a, c, t, g, unknown or other
  misc_feature (295)..(295): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctntcggctcccaggtaccagctgtgacatccaattcgacccagtctccatcctcctgtctgctatctatggagaacagagtccaccagttacacgttcggccgggacgtacgtcgacggccagtacgagccgtatttcgtttacgccgttggttcgcagcaacgaaaccgngggacgaccgcccctagacggtacgtcggtacgtactaagtgggtcacctagtaccgtagtagttcggaccgtaaggggttccgggtaccctacgttccgtaagggtttaccagggtcgggtacgtacgggtcgacgtcgttacggtacggggaactaaggttcctttaaaccgccttaccgttaacctacttacgtaccgagaccacggtcctacgggctacgtacgtaggtacgtttacgtttacgaactttaatttactacgttaactacgtaactttaagttaactttaacttaccgttaaccccgtagggttccgtttacgggtcccggtaaccgggtacgggtaacccggttaagggtaccggtaaccgttaacccggaacgtttaaccgggtggttaccggtgccggtaaccc

SEQ ID NO: 217210 - DNA, 720 bp, Homo sapiens
  misc_feature: GYAE6OF02H81KI.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccgaggtacccagctgtagaccatccaattcgacccagtcctccatccctccctgtctgcacttcgttagttggaacgtacagtacgtcaacctatcctacgttcggaccgggacgtagtccgacggaccatcgacgtcgtaactttcttacggtccgttggttcgacgacgacgaacggaaaccgacgggtaccgacgtcccccagacgtacgtacgtacgtcttacgtggtcgtacgtactaccgagtagtacgacggtacggggtaccgggtaccctagttaccgtaggttacgtaggtcggacgtgtacgcttacgtacggtacgggtactaacggttacttaacctacccgttactactaaacctactacgccgtacgtacgtccgtagaccgtacgtaccgtacgttaagttacgttacgtaacgtttaactttaacgttcttaacgtaactaacgtatttaaacgttaactacccggtttaaccgtaccggtacggtaaccgttacgggacggtaaccgggacggtaacgggttaacgtaacggtacctaacggtaccggtggtacgtacgtcgaaccg

SEQ ID NO: 217211 - DNA, 456 bp, Homo sapiens
  misc_feature: GYAE6OF02HB9BC.1.34.D01.1.454.CMB.1.raw
  modified_base (132)..(132): a, c, t, g, unknown or other
  misc_feature (132)..(132): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (421)..(423): a, c, t, g, unknown or other
  misc_feature (421)..(423): n is a, c, g, or t
  modified_base (425)..(456): a, c, t, g, unknown or other
  misc_feature (425)..(456): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtncatccagattgcaaggtggggcccatccaggttcaggtggcagtgcatcgtgggacagtattacactctcactatcagcagcctgcacgcctagagtattttgactaattttatactgtcaaatgtattatacgtacccctagtggaccgttcggcgaggggaaccaggtggtaacgtcaaccgtaatggtgcngcacgntctgtccttcnctcccttccgctatcgtagacncngttcgtcnggacgtcggntcggctaaggcctanacgttagctcgatcntancgnnnannnnnnnnnnnnnnnnnnnnnnnnnnnnnnnn

SEQ ID NO: 217212 - DNA, 772 bp, Homo sapiens
  misc_feature: GYAE6OF02FO2TB.1.34.D01.1.454.CMB.1.raw
  modified_base (462)..(462): a, c, t, g, unknown or other
  misc_feature (462)..(462): n is a, c, g, or t
tcagacgagtgcgtcacgaccggtgctcgatttagatcgtctgtgttggggtttgggggagtcagaccctgtcaggacacagcatggacatggagggtccccgctcagctccgtggggctcctgctgctctggctcccaggtaccagctgtgacatacctaattcgacccagtcctccactccctccctgtctgcatctagtggagacagagtaccaccactccgtacgttcggccgggcgtacgtacctacgggcctaagtcgacgacgttatttacgttacggtccgttggtgtacacggactaacggaaaccggacggggccgtaaccgcccctaggaacgtacgttacggtacgtacgtagttgggtctactactaccgagtagttagacggtacggggtcgggtacccacgtccgtaggttgtacggtcggacgtagtcgtctaggtcggtaggtanacgtactactactactacgtactacggtcacggtactaccgtaccgtcgtacgtaccggtacggtaaacgtaaaggtttcgtttaacggtaacgtttaaacttttaacgttaccgtacgttaaacctaaggtttaaacgttaactttaaacccggttcccgtaaacccccgggtttagggtaccgggttaacccgggtttacccgggaaccggggtaaaccggggtacgggtaaaccgggggttaagttaaacccggtaacccggttaaccggtaaccgggttcggtaccggttaccgtacgtaaccccg

SEQ ID NO: 217213 - DNA, 806 bp, Homo sapiens
  misc_feature: GYAE6OF02HV2JT.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattcgaccagtctccatccctcctgtctagcatctagttggagacgagacgtccacctactacctacgttcggccgggtacgagtccgaggccaagtccgagtcgtaattttccgtttaacggccgttgggttacgcgaacgacgtaaacgaaaccgacggggccgaccgccccctagacgtactacggttaggtctaagtggtcgcctacgtccgagtagtacggcggtaacggggttccgggtaccctaccgtccggtaacggtttcggaggttccgggacgtacggtacgtaccgtacggttaccggtacgggtaacgtaacggtttaacctttaacccggtaaccctttcccgtaaccctaacgttaaccgtacgaaccgtacgtaccgtaccccggttaacggacccgtacggtacccgttaaagggttacttttaacggtttcgtaaccgttttaaagttttacccgttaacgttaccgttaagtaaacgtttaacgtttaaccgttaaccttacccggtttacccggtaacgggtccgggttaacccgtttaccggggacgggtaaccgggtaacggtaagggtaccggtaaccggttaaccgaaaccggttcgttacgggttaccggtactaccgtaaccg

SEQ ID NO: 217214 - DNA, 655 bp, Homo sapiens
  misc_feature: GYAE6OF02JN8B0.1.34.D01.1.454.CMB.1.raw
  modified_base (540)..(540): a, c, t, g, unknown or other
  misc_feature (540)..(540): n is a, c, g, or t
  modified_base (602)..(602): a, c, t, g, unknown or other
  misc_feature (602)..(602): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtcggggtcccatccgaggttcagtggcagtgcatcgtgggacagattacactctacactatcgagctagacctggacgtctagtaagtattttcgactaattttacttactgttacaacgtacgtattataccgtacccctagtcggtacgttcggcgaacggggtaacctagggtacggaacgttaccgaaccggtaacgtcggttaccggggacttaccggaccgtaaccgtaccttcggttacgtcctttactaccgtttccgttacccgacgttactccggtaacggaaacctcgtaaccgtttcgacgtgggtaaccggtcggggtcctacggggaccgtaacggtccggttactaaacggttaggctacgggactacgttcgacgnggttcaaccgtgtaccgacgtgaccgattcgggatcctaggccgtacggcacgcgtcgtacngtcgtcgtcgtcgtcgtacgtcgtatacgtacgtacgtacgtcgtctcgtgtc

SEQ ID NO: 217215 - DNA, 787 bp, Homo sapiens
  misc_feature: GYAE6OF02HQLY1.1.34.D01.1.454.CMB.1.raw
  modified_base (681)..(681): a, c, t, g, unknown or other
  misc_feature (681)..(681): n is a, c, g, or t
tcagacgagtgcgtcacgaccggtgctcgatttagatcgtctgtgttgggtttgggagtcaggccatcagcgattcttagcctggttgcagcagaaaccagggcgacgcccctcgagatcgtagtctatggtgacatccagtattgctaagggtcgggtcccagtccgaggttcaggtggcagtgctatcgtgggacagtagttaccacttctactacttagacgacggctaaccggtcctagggactaaccgtaccgtaaggtaaacgggtttaccttttacggaaacctttaaacgtttttaacgtttaaccccgtaggtaaacctaaaaccgttaaggtttaaactttaaccggttaaaccccggttaacccccgttaaggggtaaccgggtaccggtttacccgggaaaccggtaacgggggtaaacccgtaaggggtaccgggtaaaacctccgtaaaccggtaaccgttggtacggtaccctaggaccctaaccgtagtttctcgttacttacgtaccgttcccgtcccccgttacctgtacccgaccggtccttacgttcggtaccgtagggacccgggttacgggacgttcggaaccgtacgggtacgtactaaggtcggtacacgtacgatgtagatacacgcgtatacgcttacggaccgtagttaccganacgtacgtacgtacgtacgtacgtaacgtacgtacggtacgtacgtacgacgtacgtacggtacgtacgtacgacgtacgtacgtacgtacgttacgtacgtacgg

SEQ ID NO: 217216 - DNA, 939 bp, Homo sapiens
  misc_feature: GYAE6OF02FWX1A.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgaccctagtctccacttccctccctgtctgactacttcttagttagggagaaccgaggtaactccaacctaacttcctaaccggtttcgggaccccgggggtacggtacggttaccggacgggtacccctaacttacccggaaggtaccggttaactttttaccggtttttaccgggtccccgtttggggtttcgaccggtaacggacccgaaaaccgggtaaaaaccgggacggggggacccggtaacccggtccccccgttaacggaacggttacgtttaccgggtttaacgttacgtttaacgggtacgggttacggaccttaacgttacccgaaggttacgttacgggtaacgggttaacgggggttcccgggttacccctaaccggttccgtacggttacggtcgggtacggtaccgtaggtcgtacgttaccgggtggtaacgggtaaccgtagttaaccgttacctaccgttacctaccgtaacttaccgtaccgaaccgtccgtaaccgtccgttacgacccgtaccgaacggtttaagtaagttttacgttttaccgttaaacgttttaaactttaccggtttaaccgtttacgtaacgttaaccgttaagtttaacctttaacccggttaaccgttaacccccggttaggttaccggggtaacccggtttaccggggtacgggtaaaccgggttaacgtaaaccggggttaacggtaaccgtaacccgttaacgggtaccgttaggggtacctaccggtcgtaacccg

SEQ ID NO: 217217 - DNA, 676 bp, Homo sapiens
  misc_feature: GYAE6OF02IQUKA.1.34.D01.1.454.CMB.1.raw
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (539)..(539): a, c, t, g, unknown or other
  misc_feature (539)..(539): n is a, c, g, or t
  modified_base (567)..(567): a, c, t, g, unknown or other
  misc_feature (567)..(567): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctcgtgctcccaggtaccagctgtagacatccaattcgacccagtcctccactccctccctntcngcattactagttaggacgaacagtacgtacaccgtactcctaacgttcgggccgggtacgacgtaccgacgaccgactacgagtacgttacgtttacttacggtccttcggttacgcgaacgacggaaacgaaaccggacggaccggaccgtcccctagtacgaacgtcgttacgtacgttagcggtacgacgactacgacgttagtacggacgtaacgggtcggtacctaacgtccgttaggtaacgtcggtacggtacgtagtcacgtagtccggtaggaccagtactacgtactcgttacaacttgtaccgagactctcgacgtacgtaccgtacgtaataacgttntacgtaaacttaatttactagtcgtaanaacgttagtaacttacgtaccgtaaccgttggtacgtacgttcggaaccggtacggtaaccgtaaggtcgtaaaccggtacaacggttcacggtacgcgtaccctacgg

SEQ ID NO: 217218 - DNA, 783 bp, Homo sapiens
  misc_feature: GYAE6OF02HO40H.1.34.D01.1.454.CMB.1.raw
  modified_base (145)..(145): a, c, t, g, unknown or other
  misc_feature (145)..(145): n is a, c, g, or t
tcagacgagtgcgtcacgaccggtgctcgatttagatcgtctgtgttgggtttgggggagtcagaccctgtcaggacacagcatggacatgagggtccccgctcagctccgtggggcctcctgctgctctggctcccaggtaccngctgtgacatccaattcgacccagtcctccactccctccctgtctgccattctagttggacgtaacgagtacgtccaacctactcctacgttcggaccgggtcgaagtccgacggccctatacgacgtcgttaactttccgtttacggccgttggttacggccaaggtaaccgaaaccggaaaaccggcgggggaccgaaccccggtcccccctaacgtacggtacgtttacccggttaagttacgtttagggtcggtactacctaactaccggtaagttacgttaggaaccggtagggggtttacccgggtacccttaaccgtccgggttacggtactacgggtcgggtacgtacgtcgtacgtaacggttcggtaacgggaaccttaaggtacttaccgtaccgttacctaaccttaacgtacctcgtaaaccgcgaaccgtccgtacgaccgtacggtaccgtttaagtaagttacgttttacgaactttaattttacttacgtacgtaactacgtttaattacgttactaacccgttaaccgttggtaccgtcggttaacccggtcgggaaccgggtacgtaaggttacggaaccgtaccggtaaccggtacgtcggtacgtcgtaccgtaccg

SEQ ID NO: 217219 - DNA, 738 bp, Homo sapiens
  misc_feature: GYAE6OF02F8QEK.1.34.D01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
  modified_base (376)..(376): a, c, t, g, unknown or other
  misc_feature (376)..(376): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatccctccctgtctgcatctattgganacagacgtcaccatcacgttggccgggnagtcaggccatcgagccgtatttcttagccttggttcgcagacaagaaaccgagggcacgcccctanagactcggtacgtctagtaggtcgcagtccgaagtagttcgacgaacgggtcgggtacccagtccgtaggttcgaggtcggngtagtgaccgtagttcggtagggaactacggtaacttacaccttactacctaacttacgtacgacgtccgtacgcccgttacggaccgtacgtaccgttaaaggttaacgtttaacgttttacggaaacttttaaacgtttttaacggttaaccgttacggttaacctaaaacggtttaagtttaacctttaaacggttaaacccggttaaccccgtttaacgggttaccgggttaccggttaaccggggacccgggttaaaaccgggggtaaccggttaaacggggttaaccggtaaaaccgttaacccggtaaaccgggttaaaccgttcgggtaaccggtaccggttacgtaaaccccg

SEQ ID NO: 217220 - DNA, 669 bp, Homo sapiens
  misc_feature: GYAE6OF02FQYYA.1.34.D01.1.454.CMB.1.raw
  modified_base (209)..(209): a, c, t, g, unknown or other
  misc_feature (209)..(209): n is a, c, g, or t
  modified_base (442)..(442): a, c, t, g, unknown or other
  misc_feature (442)..(442): n is a, c, g, or t
  modified_base (553)..(553): a, c, t, g, unknown or other
  misc_feature (553)..(553): n is a, c, g, or t
  modified_base (561)..(561): a, c, t, g, unknown or other
  misc_feature (561)..(561): n is a, c, g, or t
  modified_base (596)..(596): a, c, t, g, unknown or other
  misc_feature (596)..(596): n is a, c, g, or t
  modified_base (636)..(636): a, c, t, g, unknown or other
  misc_feature (636)..(636): n is a, c, g, or t
tcagacgagtgcgtcacgaccggtgctcgatttagatcgtctgtgttgggtttgggagtcaggccatcagcgattctttagcctgttgcagcagaaaccagggcgagcccctcagatcgtagtctatggtgcatccagtattgcaagggtggggtcccatccgaggttcagtggcagtgcatcgtgggacagattacactctcgactancgagcagcctaggcacgtcctagaagttactttaggacttaagtttttattaacgtcgttaacaactagtttaactttaacgtaccgttaaccccgtacggttacgggttaccgtttcgggacccgacgggggaaccgtaagggtaggtaacgtaccgtaaaccgacggttagtcggaccgtgaccctaacctagttacgtcgttcgtttacctaacgttcccggttaccccncgtacgttacgtaaccggtaaaccgcttaaccgttccgtacgtacgggtacgggtaccggggctttaacgggacccgaagggtaccgtacttaacggttacggatcgtccncggtaacncgtacacgagagtcgtctctactacgacgacacgnacacgacgtgtagacgtactagtacgtacggtacgtacgngtacgtagtacgagacgagtgtctacgtggtcg

SEQ ID NO: 217221 - DNA, 678 bp, Homo sapiens
  misc_feature: GYAE6OF02GOI3F.1.34.D01.1.454.CMB.1.raw
  modified_base (185)..(185): a, c, t, g, unknown or other
  misc_feature (185)..(185): n is a, c, g, or t
  modified_base (197)..(197): a, c, t, g, unknown or other
  misc_feature (197)..(197): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtcngcatctatgganacagagtcaccatcacttggccgggcgagtcaggccatcagcgtattcttagcctggttgcagcaagaaaccngggcacgcccctnagtatcgtagtctagtggtgacactcgaagtagttagaccgtaagggttcgggtaccctagtcccgtaagggttccaggtcggacaggtcgcgtacgtcggtagggaaccgaggtacttaccgaccttctacgactactcgagtcacgtccgtgccgtagtcccgttaagacgtttaagttttcgaacctttaatttacgttacgtttaccgtaacttaaccgttaaacgtttaacttaaccgttaacccgtaacccgtttaaccgggtcgggttaacccggttcggggtaacccggtaaacgggggtaacccggtaagggggttacgaaaacccgggttacccgtaaaccgggtaccgtttacggggttacggtaccggttaacgtaaccccgg

SEQ ID NO: 217222 - DNA, 645 bp, Homo sapiens
  misc_feature: GYAE6OF02INJ6U.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctcctggggctcctgctgctctggctccaggtaccagctgtgacatccaattcgacccagtctccatcctccctgtctgacattctagttggagacagacgtcaccatcacgttggccgggcgagtcaggccatccagcgtatttcgtttacgccgtggttgcagacgaagaaaccgagggccgacgcccctagagattcggtatcgtagtggcgacactacagtattcggacgtagggtcgggtacccagtccgtaggtacaggtgacggtagttcgacgattcggtacgggaactacggtacttaaccgtacttacctacgtaacctatccgaacgtcgaacggtcctacggccgtacgtacctaaggtactttaacgtttgtaacttaacgtttttatcgttaacgtacgtaagttaagtttaacttaacggttacccgtacccgttagggtaccggttaccggtcgggaacgtaacggggtaactacgggtaacggtaacgtaccgaacggttagacgggtgacgtcgtacccg

SEQ ID NO: 217223 - DNA, 891 bp, Homo sapiens
  misc_feature: GYAE6OF02HRPAI.1.34.D01.1.454.CMB.1.raw
tcagacgagtgcgtcacgaccggtgctcgatttagatcgtctgtgttgggtttgggcatggacatgagggtccccgctcagctccgtggggctcctgctgctctggctccaggtaccagctggtgacactacctaattcgacccagtctaccactcccttccctgtcctgcatcttagtgggagacagtacgtccaacctactccacgttcggccgggacgagtacgacggccaagtacgaggtctactttacgttacggccttgggttcgcgacgaccgaaacgggaaaccggacggggccgtaccgacccccgtagacgttacggtacggtacgttcgtagtcggtgtacctacgtaccgtaagtacgttacgggacgtaacggggtccgggtaccctagtccgtaaggttcgtaggtcggactaggtcgaaccgtagtaccgggtaggtaactaaccgttaacgttaacctaccgttaccgttaaccggtaacttacggtaccgtaaccggtccgtaacggtacccggtcggtaacgggaacccgggttaacggtttaaacgggttaacgtttttaaaccggtttacggtaaaaccgtttttaaaccgtttaaaccgttaccggttttaagaaacccggtttaaacctacggttttaaacgtttaaccgggtttaaccccgttaaacccgggtttaccggggtaccgggttaacccggggttacccgggtaacggggtaaaccggggtaccgggttaaacggtaaacgggtaaccggtaaccccgtaacggggtcgttacggggtacccggtacggttaccgacctaaccgttacgttccgtttacgtcccgtttaaccgacccctttacccccgtacccgttacccc

SEQ ID NO: 217224 - DNA, 672 bp, Homo sapiens
  misc_feature: GYAE6OF02G3POY.1.34.D01.1.454.CMB.1.raw
  modified_base (512)..(512): a, c, t, g, unknown or other
  misc_feature (512)..(512): n is a, c, g, or t
  modified_base (540)..(540): a, c, t, g, unknown or other
  misc_feature (540)..(540): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccactccctccctgtctgcatctagttggagacagagtcaaccatccgcttcggccgggcgagtcgacggccatcacgcgtatttcttagtcgttggttcgcagcaagaaaccgaggggccgaccgcccctacgagtactcggttacgtcgtagttcgggtcgacctactacccgaagttacgttacggacgttaacgggggttccggggtacccctaacgttcccggtaggtttaccgaggttcggacgtacggtacggtctacggtccgggtaggggtaactaacggttaacttaccctaccgttacctaccgaacgtactcgaacgcgtacgtacccgngaccaggtcctagaaacgtttcgtttanaacctttaatttcgttaacgtcgtaaacctaagttaagttacttaacctacccgttacccgtagtcggtaccggttcggacggacggtaccggaaggtacgtacgtacgacggtagtcggtcggtacagacc

SEQ ID NO: 217225 - DNA, 713 bp, Homo sapiens
  misc_feature: GYAE6OF02FLZYZ.1.34.D01.1.454.CMB.1.raw
  modified_base (196)..(196): a, c, t, g, unknown or other
  misc_feature (196)..(196): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtccaaccatcacgttggcccggggcgtagtcgaggccatccagcgtattcgtttacgccgttggttgcagcaagaaaccgagggcacgaccccgtnacgactcggtaatctagtggtacgctagtccaggtattgcgtaaaggggtccgggtaccctaacggtccgtaagggttcgtaagggttcggaccgtaggtggacctaacgttcggtacgggaactaggtacgttaaccctacgttaccctacgtaacttaactcgtaacgtccgaacggtcccttaggaccgtaaccgtccgtaagggtaaacgtttattttaccggtaagtttaaactttttacgttacttacgttaaccgaaacgttacgtttaaactttaccgttaacgttaaccccgttaggtttacggtacccggtttacccggggaacggttaccggggtaaaccggtaagggtacggaaaccggttacccgaaacgggttacgtacgggttggtaccgtagtacccgg

SEQ ID NO: 217226 - DNA, 753 bp, Homo sapiens
  misc_feature: GYAE6OF02I0R0L.1.34.D01.1.454.CMB.1.raw
  modified_base (197)..(197): a, c, t, g, unknown or other
  misc_feature (197)..(197): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatccacttggccgggcagtcaggccatcagcgattcttagcctggttgcagcagaaaccngggcgacgcccctnagatcgtagtctagtggtgcatccagtattgacgtaagggtcgggggtacccagttccgaaggttcgaaggttcggaccaaggttgacctaaggtccgtaggggacctaaggtacttaaccgtacttcctactactagttaccacggtacctacggtcccgttcgcgtacgtcccggttaagtaacgttacttttcggaaacctttaagtttttaccgttaaacgttccgtttaaccgtaaacggtttaaaccgtttacgttttaaaccgttaacccgggttttaacccccgttacggggttacccgggttaaccgggttttacccgggggtaaccccgggttaaccggggggggtaaacccgtttaaacggggggtaccgggttaaacccggggttaacccgttaaaacccccggggttaaccggttacggggttacccggggttacccggttaccgggtaacccccggg

SEQ ID NO: 217227 - DNA, 862 bp, Homo sapiens
  misc_feature: GYAE6OF02JIU2K.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacataccaattcgacccagtcctccactccctcctgtctgctattctaagttggaacgacgaggtactaccaccgtactcctacgttccgggccgggcgtaacggtcgacggacctaagtcgaacgtcgtaactttccgtttaacggtcccgttgggtttacgccgaaggtaccgaaaaccggtaaaccggacgggggaccccggtaaccgtaccccccttaggaacggtaacttccgggttaacttaccgtaggttcggtagtaccacgttccgtaacgtagttacgacggtacggggtaccgggtaccacgtacgtaggtttacacggttcggtacgtacgtacggactaacgtcggtaacgggtaactagggttaaaccttaccgtaaccgttaccgtaaacttaccgtaaacgttcggaactaccgggtaccgtacccggttaggacccggttaaccgtacggtaaagtttaacgttaccgtttacgttaaacggttaaacttttaaccgttaccgtttaacggtaaaccttaaaccggttaaactttaaacggttttaaacccgtacccgggttaacccgttaacgggttaccggttaaccccgggtttaaccgggaacccggttaaccggggtaaccgggtaaacgggttaaccggttacccgtaaacgaacccgggttacgtacgggtccgtaccgtactaacccgg

SEQ ID NO: 217228 - DNA, 726 bp, Homo sapiens
  misc_feature: GYAE6OF02JS2FB.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctcggctcccaggtaccagctgtgacactccaattcgaaccctgtcctccactcccctcccttcgtcctgtactacttcttagttgggaacgactacggaacgtccaaccctacttcctaaccgttcggcccggggtacgacgttaccggacggtacctacgtccgaacgtacggttactttaccgtttacgttccgttcgggttacgcgtaacggacgtaacggaaccgacggggccgtaaccgcccgtagacgtacgttcggtacgttcgtacgtacgggtctacgtaccaacgtacggttacgtcggtaaccggtacggggaccgggttcccgtaaccgttccggtacgggtttaacgtagggtacggtcgtacgtccgactacggtcggtacgggtaatacggtaactacctacgttctacgacttatcgaatccacgctacgctacgtcgagttaaactgtttacactttaattacgttctagttaacgtaacttattacgtattaaccgttcgtaacgtacggtcctacggaaccgggtcggaactaacgggtagtaaaccgtacccggtatacggtgtcgacggttaccacgg

SEQ ID NO: 217229 - DNA, 682 bp, Homo sapiens
  misc_feature: GYAE6OF02HY8CR.1.34.D01.1.454.CMB.1.raw
  modified_base (191)..(191): a, c, t, g, unknown or other
  misc_feature (191)..(191): n is a, c, g, or t
  modified_base (259)..(259): a, c, t, g, unknown or other
  misc_feature (259)..(259): n is a, c, g, or t
  modified_base (427)..(427): a, c, t, g, unknown or other
  misc_feature (427)..(427): n is a, c, g, or t
tcagacgagtgcgtcacgaccggtgctcgatttagatcgtctgtgttgggtttgggcatggacatgagggtccccgctcagctcctgggggctcctgctgctctggctccccaggtaccagctgtgacatccaattgacccagtcctccatcctccctgtctgcatctattggagacagtagtcaccatcncttcggccgggcgagtccaggccatcagcgtatttcttacgccgttggttcgcagcaagtaaacccgngggtccgaccgcccctcaggtactcggtagttctagtggtgacctactccgtaagtgttacggaccggtaacgggggtccgggtaccctacgttcccggtaaggtttcgaggttcgggactaggtcgctagtcgtagggactagtacgttacactcgtacaaacttanccgacgtacaccgcctggaccgtacgtaccgtagtaacgtttagttacgaattttaaactttacttacgttacgtaactaacgttaacttactttaaccgtacccttacccggtacggttaccgggttacccgtcgggaccggtaacgggtaccgtaaagggtacgtaaccgtaacgtaccgtaacggtcggtacggtcgtacgtaccaccgtagttcgtaccggttccttacctctttaccccgttcccctccc

SEQ ID NO: 217230 - DNA, 731 bp, Homo sapiens
  misc_feature: GYAE6OF02JECIB.1.34.D01.1.454.CMB.1.raw
  modified_base (306)..(306): a, c, t, g, unknown or other
  misc_feature (306)..(306): n is a, c, g, or t
  modified_base (724)..(724): a, c, t, g, unknown or other
  misc_feature (724)..(724): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccactcctccctgtctgctatctattggacacagtacgtaccacctatctacgttcggaccgggtcagtcgacggtccataccgagctatttccgtttacggccttgggtcacgtacgacctaaagtaaacccggngggacccgtaccgtcccctgaacgtacgttacgttaacggtctaggtcgggtctaccgtaactccgtaagtaactttcgggacgtaaacggggttccgggtacccacggtttacccggtaggtttacgacggtagggtacctaagggtcgtacgtaccgttacggtacgggtaacgtaaccggttaaccgttaacctaccgttacctaacgttaaccgtaaacgttcgggaaacctccggtaacccgtacccggttggaacccgtacggttaaccgttacgggtaaaattttccgtttaacggttaactttaaaccgttttaggttacctacggttaaccaacgttagttaacttacgtaccgtacttacggtacgtacgtcggaaccggtagacgtaggagactacgacttaggcgncgatacg

SEQ ID NO: 217231 - DNA, 739 bp, Homo sapiens
  misc_feature: GYAE6OF02I12FC.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctccaggtaccagctgtgacatccaattgacccagtctccatcctccctgtctgctattctaattcggaagacagtacgtaccaccaattccgaccgttggcccggggtacgaacggtccacggtccacgtcgagtcgttaacgtttcgtttacggtccgttaggttcacgaacgaacgaacggaaccggacgggacccgaccgtacccctcgaacgtagttacgtagtcgttacgtcggtacacgacctacgagtacgttacggtacggttaacgggtccggtaccgtacgtaccggtacggttcgtaacggcggtacgtacgtacgtacgtacggttacgacgggttaacctaagaccgtttaacctcccgtaacgtttactaccgttaaacgtcctaaacggtccctaacggtcctaaacgggtcccttagggaaccgtttagtttaacgtactttaagtttacttaacgtttagttacctaagttacgaaactttagtaactttacccgtacgttaccgtacggttaccggacggttacgggacgtaacgggtacgaacgttacggtaacgtaaccgttacgggacgtaggtacggctacggtac

SEQ ID NO: 217232 - DNA, 731 bp, Homo sapiens
  misc_feature: GYAE6OF02HI6ZW.1.34.D01.1.454.CMB.1.raw
  modified_base (339)..(339): a, c, t, g, unknown or other
  misc_feature (339)..(339): n is a, c, g, or t
  modified_base (713)..(713): a, c, t, g, unknown or other
  misc_feature (713)..(713): n is a, c, g, or t
  modified_base (723)..(723): a, c, t, g, unknown or other
  misc_feature (723)..(723): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacactaccaattcgacccagtcctccaatcctcctgtcctgcatctatggagacagagtcacatcacttggccggagagtcgacggtccatcagcgtactttacgttagtaccttggtagcctagaccgtaagaaaccgagggacctaccgtccccgtagacgacgttcgtacggtactacgttacggngaccgtacgtccgaagtactttagggaccggtaaagggttaccggggtacccctaaggttaccggtagggtttacgaacgggttcgaccggttaagtccgtacgtacgttaccggtagggtactaacggtactaacccgtacttacctaccgtaataacttacgacgtacacggtaccgtaccgtacgtaccgaacgttaggtaaacttacgtttaataactttaatttacgtaacgttacgtaacgtaaaccttaaggtttaaagttacctaaacccgttaccgttaaacgggtaccgtttaccggaccgggtaaccggtaaccgggggaactaacgggttaggtaaccgttaacccaaccgtcggttaacgnggttacccgngtaacccg

SEQ ID NO: 217233 - DNA, 725 bp, Homo sapiens
  misc_feature: GYAE6OF02JD8YH.1.34.D01.1.454.CMB.1.raw
  modified_base (236)..(236): a, c, t, g, unknown or other
  misc_feature (236)..(236): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtcctccatcctccctgtctgcatctattggagacagagtcaccatcacttggccgggcgagcacggccatcagcgtatttctttagccttggttncagcaagaaaccgagggccgacgcccctcagacttcgtagtctagtcggtgcacgtccagtattcggacgtaaggggtcgggtaccctagtccgtacgggttcgaggttcggactacggtgtaccacgttcggtaggggaactaaggtaactttacgacctttcgtaccgtaacctacgtacgacgtccgacgtaccttcggactaccgtcgtaagggttaaacttgttttaccgtaagtttaaactttttacgttacgacttaaccaagttaaacggttttatttaaccgtaaccgtttaaccccgtaggtttacggttaccggggttacccgggaccgggtaaaccgggtaaacggtacgggtttaaacgaggtttaaccccgaacgggtttacgaccggggttcgttacggtacgtaacccggtaaccttaaggttcccgtttacgtttaccttcccgttatttacccccggttacccggtaaccg

SEQ ID NO: 217234 - DNA, 691 bp, Homo sapiens
  misc_feature: GYAE6OF02FRLEA.1.34.D01.1.454.CMB.1.raw
  modified_base (102)..(102): a, c, t, g, unknown or other
  misc_feature (102)..(102): n is a, c, g, or t
  modified_base (290)..(290): a, c, t, g, unknown or other
  misc_feature (290)..(290): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctcgtggcctcccgaggtacccagctgtgaccatccgaattcgacccagtctccatcctccctgtctgcatctatggagacagactacacctatctacgttcggaccggagacgtcacggaccatcagtcgtattcttacgcgttgtcgacagccaagtaaaccgngggccaccgtccctagtagactcgtagtcgtagtcggtcgactactccgaagtatcggacggtaacgggtcggtaccctagtccgtggttcgaagtcggacacgggtcacgtacgttacggcgggtaactacggttaacttccaacctttcccgtaagtaccgtttacgtacccgtagcccgttacgcccgttaggaccgacgtcgttaggttaaactttggttaaccgtaacgtttaagttttacgtacgttacgaaccgttaagttacgtttaaacttaccggtaaaccggtttccgacggtttacggtcccggttaccggtaacggaaccggggttacgtaaaggttacccggaacgttacccgaaccggttacgtgggacgttaccgtagtaacccg

SEQ ID NO: 217235 - DNA, 668 bp, Homo sapiens
  misc_feature: GYAE6OF02GSR16.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccgaattcgacccagtctccatcctccctgtctacgcattctagttggaacgacagtactaccacatcgacttggccggacagtcacggacctagtccaaggtctactttcgttacgccgttggttacgctacgcgaaacggaaaaccgcgggtaccgaaccgccccgtagaacgtacgtacggtaacgttctaacgttggtaccgactaacgttcccgagtacttcggaacgtaacgggtcggttacccaacgttcgagtttaccgacggtacggcaggttcaccgtagtcccggtaggtacctacggtaattaaacccgtcttaccgtacttaccgtaacgtctacgacgaccgccttagaccgacgtaccgtgtaaacgtttgtttaacgactttaactttacgttacttacgtaactaacgtagttacttaactacccgttacgttacgtacggtacgttacgaccggtaggacgtaacggatacggacaccgtgttaagcgttagcgtaac

SEQ ID NO: 217236 - DNA, 719 bp, Homo sapiens
  misc_feature: GYAE6OF02GX85T.1.34.D01.1.454.CMB.1.raw
  modified_base (147)..(147): a, c, t, g, unknown or other
  misc_feature (147)..(147): n is a, c, g, or t
  modified_base (211)..(211): a, c, t, g, unknown or other
  misc_feature (211)..(211): n is a, c, g, or t
  modified_base (584)..(584): a, c, t, g, unknown or other
  misc_feature (584)..(584): n is a, c, g, or t
tcagacgagtgcgtcacgaccggtgctcgatttagatcgtctgtgttgggtttgggggagtcagaccctgtcaggacacagcagtggacatggacgggtccccgctcagctccgtgggcctcctgctgctctggcctccaggtaccngctgtgacactaccgtaattcgaccctagtcctccactccctccctgtctgctatctagtgganacagacgtccacgtatctacgtcggaccgggacgtagtaccgaggcctagtaccgagtacggtactttacgtttacggaccgttggtttacgaccgtaaggcgaaaccggtaaacccgacggggtacccgaaccccggtaccccgtacgaaaggttaccgttaccggttacgttacgtaggtcggtacgacctaacgtacgaaggttacgtacggaacggtacggggttaccggtaccgtacgtaccggtaggtacgtacggcgtacgacggtagtcgtaacgtcggtacggacaaggttactacctaccgtactacgtactcgtacaacggctacgtcgtaccgcgtacgtacgttaacgtagttacgttanaacgtttaacgtttaacgtcgtaactagtaactatttacggttaacttacgacgttagtaccgtcggtaccgtacgggaaccggtaggtaacgtaacggtactaaccgaacggtacgcggttacgagttccgaac

SEQ ID NO: 217237 - DNA, 840 bp, Homo sapiens
  misc_feature: GYAE6OF02G0D2J.1.34.D01.1.454.CMB.1.raw
  modified_base (205)..(205): a, c, t, g, unknown or other
  misc_feature (205)..(205): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggcctcccgaggtaccagctgtgacataccaattcgacccagtcctaccactccctccctgtctgcatctatgganacgagagtccaacctaatctacgttcggaccgggacgtacgtaccgacggaccacgtcagacgttactttaccgttacgtccgttaggttacgcaacgaacgtaaacggaaaacccggagggggtacccgacccggtaccccctgtaaaccggtaacttacggtaacgttaccttaggtacggtacgacctaacgtacgtaaggtattacggacggttaacggggtcgggtacccctacgttacggtaacgggttacgaacggttcgggactaacgggtcgtacccgtaaggttcgggacgggtaaactaaggttaaccgttaaaccctaccttaccggtaaccctaacctaaagttccaaacggtccgaaccgtacccgtagacccgtaacgtccgttaacggtaaacgttacgttttaacgaacgtttaaacgtttaaacttaacggttaacgtaaccttaaacgtaaagttttaaaccgttaaccgttaaacccggttaaaccccgttgggttaacccgggtaaccggttacccgggtaacccgggaaaccggggtaccggtaaagggttacggtaaaccggtaaacccgtaaccggtaacggttacggttaccgggtactaacggtacccg

SEQ ID NO: 217238 - DNA, 637 bp, Homo sapiens
  misc_feature: GYAE6OF02JIK1J.1.34.D01.1.454.CMB.1.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (584)..(584): a, c, t, g, unknown or other
  misc_feature (584)..(584): n is a, c, g, or t
  modified_base (589)..(589): a, c, t, g, unknown or other
  misc_feature (589)..(589): n is a, c, g, or t
  modified_base (592)..(598): a, c, t, g, unknown or other
  misc_feature (592)..(598): n is a, c, g, or t
  modified_base (600)..(600): a, c, t, g, unknown or other
  misc_feature (600)..(600): n is a, c, g, or t
  modified_base (602)..(603): a, c, t, g, unknown or other
  misc_feature (602)..(603): n is a, c, g, or t
  modified_base (606)..(606): a, c, t, g, unknown or other
  misc_feature (606)..(606): n is a, c, g, or t
  modified_base (608)..(610): a, c, t, g, unknown or other
  misc_feature (608)..(610): n is a, c, g, or t
  modified_base (612)..(612): a, c, t, g, unknown or other
  misc_feature (612)..(612): n is a, c, g, or t
  modified_base (614)..(615): a, c, t, g, unknown or other
  misc_feature (614)..(615): n is a, c, g, or t
  modified_base (617)..(617): a, c, t, g, unknown or other
  misc_feature (617)..(617): n is a, c, g, or t
  modified_base (620)..(620): a, c, t, g, unknown or other
  misc_feature (620)..(620): n is a, c, g, or t
  modified_base (622)..(637): a, c, t, g, unknown or other
  misc_feature (622)..(637): n is a, c, g, or t
tcagacgagtgcgtcacgaccggtgctcgatttagatcgtctgtgttgggtttgggagtcaggccatcagcgattcttagcctggttgcagcagaaaccaggcgagcccctcagatcgtagtctatggtcgcactccagatttgcgaaggtcggggtcccatccaggttcaggtcggcagtgcatccgnggacagattaccactctcatacncgagcagtcctgaccgagtcctagtaaggtacttttaggaacttaagtttacttacttcggtaaccaaccgtaattacgtttactaaccgttacccgttacggtacggaacgtttccgggaaccgtaagggggttaacccgaaagggttacgggaaaccgtaaacccggtaacccggtaacgttaacgggtacggccttacgggaaccaaaccgttaaccgtcgttaccgttactttaccccgacgttccccggttttaacccggattaaccctcgggttaacaacccgggcccttacgttacccgtttagaccggaacggggtttccccggaagccgggaaaccgtggaaccccgtaagtagtacgcgtcngaacngcnnnnnnncnannacncnnncncnncngcncnnnnnnnnnnnnnnnn

SEQ ID NO: 217239 - DNA, 734 bp, Homo sapiens
  misc_feature: GYAE6OF02IOXAL.1.34.D01.1.454.CMB.1.raw
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacctatcacgttcggccgggcgagtcgaggccatcgacgtcgtattctttacgtccgttggttcgcacgacaagaaaccgngggccgaccgcccctanagacgtcgtagtctagtcgggtacncatccgtagtnttagacggtaggggtccggtaccctacgtcgtaggttcaggtcgacgtagtcgacgtagtacggtacgggtacctagtaactttacacgttacctactaacgttactacgtacgaccgtacgtcctacggtacgtacggtaccgttaggtaaacgtttatttaccggtaacgttttaaaccttttacgttaaccttacgttaaccgaaacgtttacgttaaacgtttaaacgtaaccccggttttacccggttaacgggttaccggggttaacccggttttcccggggaacccgggttaaccggggtaaaccgggttaacgggtaacgggtaacccggttaaaccggtaacccgggtaacggttacgggttaccggtaccgttaccgtaacccg

SEQ ID NO: 217240 - DNA, 679 bp, Homo sapiens
  misc_feature: GYAE6OF02FOJKV.1.34.D01.1.454.CMB.1.raw
  modified_base (280)..(280): a, c, t, g, unknown or other
  misc_feature (280)..(280): n is a, c, g, or t
  modified_base (319)..(319): a, c, t, g, unknown or other
  misc_feature (319)..(319): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctagttggagacagagtccaccatcacttcggccgggcgacgtcgaggccatcgagcgtattctttagccgttggtgcagcaacgaaccgngggccgaccgcccctgagagttcggtagtctagtcggtnccatccagtagttgacgtaagggtcgggtacccagtccgtaggttcgaggtcggcgtagtcgactacgtcggtagggaactagtaactttaaccgaccttcgtaactaacgtactacgactccgacgtcctacggcctacggtacctaaggtaaacgtttcgttttacgaacttttaaatttacttacgtttacgttaactaacgttaaacgtttaactttacgttaacccggttaaccccgttagggttaccgggttacccgggttaccgggaaccggtaaccggggtaaaccgtaacggggtacggtaaaccgtaaccggtaaccgggtaacgtcgggtacggttccgacggtacccg

SEQ ID NO: 217241 - DNA, 852 bp, Homo sapiens
  misc_feature: GYAE6OF02IG7OD.1.34.D01.1.454.CMB.1.raw
tcagacgagtgcgtcacgaccggtgctcgatttagatcgtctgtgttgggttggggagtcagaccctgtcaggacacagcatggacatgagggtccccgctcagctcctgggctcctgctgctctggctcccgagtaccagtctgtgactatccaaattcgaacccagtcctaccacgtccctcccgtgtcttgctactctagtggacgacgagacgtcaccactacgtacgttcggaccgggcgaacggttcacggtacccagttaccgaagtaccggttaagtttacgtttaacggtcccgttagggtttcgaccgtaacggtaacaaaccgggtaaaaaccgacgggggacccggtaacccgtaccccccgtaaagtaaccgaccgtttacgggtaacgttacccgtttaaaggtcgggttaacggtcctaaccggttacccgtaagggtaactttcgggaacggtaaacggggttcccgggggttaacccctaacggttacccgtaaggggtttccaaggggttaacggtaccggtaacgtaccggtaccgtacgggtttaaccggtacggggtaacgtaaacgggttaacgttaaccctaaccggttacctaacgttaaaccgtcggtaaaccgacggggtacctacggggtcctaaccgtacgtacgtacgttacgggaagtttaacttcggtaacttaaggtttaccttaagcgttaaacaacggttacttaacgttaacgtacccgtttaacccgagttaccgggttactaccgggggtaacgaacggtaccgtaaggtaacggacgttaaccgtaacggtaccaggttacgtccgataacccg

SEQ ID NO: 217242 - DNA, 565 bp, Homo sapiens
  misc_feature: GYAE6OF02ILXXN.1.34.D01.1.454.CMB.1.raw
  modified_base (524)..(525): a, c, t, g, unknown or other
  misc_feature (524)..(525): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (536)..(537): a, c, t, g, unknown or other
  misc_feature (536)..(537): n is a, c, g, or t
  modified_base (539)..(565): a, c, t, g, unknown or other
  misc_feature (539)..(565): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcacgcctgcacggcctggaaactattttcgacttaaattttaattacctgttaccaactagttaattattaaccgtacccctaagttcggtaccgttcggaccgaacgggggaacccaggggtagggaacgtaccgaaaccgtaacgtcggtaggctcggactaaccgagttctcgttcgttacctacttcccgttaccccgtacctacgtccgtacgaaccgtctacctttccggtccgtacgggtaccggccggggtaccgtcgggaaccgtaaacggggccgttaacaaccggttgccgagcgatcgtacgnngngngncgntnngnnnnnnnnnnnnnnnnnnnnnnnnnnn

SEQ ID NO: 217243 - DNA, 606 bp, Homo sapiens
  misc_feature: GYAE6OF02H35L8.1.34.D01.1.454.CMB.1.raw
  modified_base (101)..(101): a, c, t, g, unknown or other
  misc_feature (101)..(101): n is a, c, g, or t
  modified_base (299)..(299): a, c, t, g, unknown or other
  misc_feature (299)..(299): n is a, c, g, or t
  modified_base (470)..(470): a, c, t, g, unknown or other
  misc_feature (470)..(470): n is a, c, g, or t
tcagacgagtgcgtcacgaccggtgctcgatttagatcgtctgtgttgggtttgggggagtcagaccctgtcaggacacagcatggacatgagggtcccgntcagctcctgggctcctgctgctctggctcccaggtaccagctgtgacatccaattgacccagtctccatcctcctgtctgcatctagtggagacagacgtcaccagtcacgttggccgggcgagtcacggccatcgagtcgtattctttagcctggttgctagacgaacgaaaccgagggaccgacgacccccgtanagtactcgtacgtctagtggtcgactacgtccgagtacttacggacgtaacggggttcgggtcccagttaccgtaggttcgaggtggacgtagtcgctacgtcgtacgggactaacgtactacgtactcctacgtactagtcagcacgtactcgactagacctagtaattntttagacttaatttatacgtgtaacaacttagttaactaacttaccgtacccgttaggtacggttaccgtacggacggtaacgggaacgtaaggtacgaacgttaccgaacgtacgtacggtcgaccgtgtaaccg

SEQ ID NO: 217244 - DNA, 608 bp, Homo sapiens
  misc_feature: GYAE6OF02FG1YZ.1.34.D01.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (293)..(293): a, c, t, g, unknown or other
  misc_feature (293)..(293): n is a, c, g, or t
  modified_base (454)..(454): a, c, t, g, unknown or other
  misc_feature (454)..(454): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattcgacccagtcctccatcctccctgtctgcatctagttgganacagagtccaccatccacgttcggccgggngagtcaggccatcagcgattctttagccttggtcgcagcacgaaaccgagggcacgcccctnagactcgtatctatggtcgcacttccagtatttgacgtaaggggtcggggtacccagttcccgaggtttcgaggttcggctaggtcgactacgtcgtgggaacaggtactacgactcgtacactataccagccagccttgcacgtctaagaagttgtttanactttaatttacttacgtagtacctaagtagttaattacgtaaccgttaccccgttaggtacggtaccgttacgggaccggtaacggggaaccgtaaaggggtgaaaccggttcgaaaacccggttacgtacgggtacgtaccgtagtaacccg

SEQ ID NO: 217245 - DNA, 730 bp, Homo sapiens
  misc_feature: GYAE6OF02F6VGB.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacataccaattcgacccagttcctccatccctcctgtctgctatctagtggagacagagtccaccatccacttcggccggcgtaagtccgacggccaatccgaaggccgtacgtttccgtttagcccggttgggttacgtacaggacctaaacggaaaccggacggggtccgaaccgtcccctacgagtacgtcgttagtcttagtggtgactagtccgagtatcgacggtaggggtcggtacctactcgtaggttcaggtggactagtgacgtagtcggtacgggaatacgtaacttccgaacttcttactacgtacctagaccgacgtacgtcccgtcgacggtaccgtaccggttaaggtaaacctttaggttttaccggttaactttaacgtttaacgtttaccgtacgttaacgtaaccgttaagtttaaacgtttaccgtaacccgttaaccccgttagggttaccggttacccggtaccggtaaccggggtaaccggggtaaaccgtacggggtaacggttaaccgggtaacccgttaaccggtacggttaccggtaacggccttacggacccg

SEQ ID NO: 217246 - DNA, 764 bp, Homo sapiens
  misc_feature: GYAE6OF02IBQV2.1.34.D01.1.454.CMB.1.raw
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (523)..(523): a, c, t, g, unknown or other
  misc_feature (523)..(523): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctcgtggcctcccaggtaccagctgtgacatccaaattcgacccagtcctccacttccctccctgtctcgctacttcttagttggacacgagtaccgtacacctactccgtacgttcgggaccgggacgtacgtcgacgcctatcgacgtcgttacttcgttttacgccgttgggttcncgtacgaccaacgggaaaccgngggacccgtaccgccccgtagtagacgttcgtagtcgtagtggtacgctacgtacgagttcgtggaccggtagggtccggtacctcgtacggtagtcgtaggcgactgacgtcagcgtaggctacgtaacttacaccgttcctacgtaactacgtacgcgtacacgttcgacgacgtcgtcttaacggttaacgtttnttaaccgttaagttttaaccgttttacgttaaccggtattaaacccgttaaggtttaacgtttacttaaaccgtttaaccccggggttacccgtttaacggggttaccggtcccgggtttacccgggtaaaccgggtaaccgggtaacgggttaaaccgggttaacccggtttaaacggtaaaccccgttaaccggggttaaccggttcgggttaacccgttacgaccccggttaacccgg

SEQ ID NO: 217247 - DNA, 786 bp, Homo sapiens
  misc_feature: GYAE6OF02JW7NC.1.34.D01.1.454.CMB.1.raw
  modified_base (356)..(356): a, c, t, g, unknown or other
  misc_feature (356)..(356): n is a, c, g, or t
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtaccagctgtgacatccaattcgaccctgtctccattccctcctgtctgcatctagttcggagacagacgtcaaccattccacttcggcccggggtacagttaccgaggtcccatacgagccgtaatttcgtttagccgttgggttcacgacggacctaacggaaaccgacggggccgaaccgtcccctacgagacgtttcgagttccttagtcggtcgnaacgtccagttagtcgagtacgggtcggtacccaagtccgtaggttcaggtcggcaagtcggactagtccggaggtactacgtacgttaaccagttaccttacaccgttaacgtcgtaacgaccgtacgtcgttaccgcggtaacgttaccgtgggtaaaaccgttttcggtttaccgttaaagttttaaaccggttttaccttaaacgggtttcccgtttaaacgttaaccccggttaaagttttaacccgtttaaaacggttacccggttaaaccccggtttacggggttaacccggttccgggttttaaaccccgggtccgggggttaaaaccgggtaacccgggtaagggttaaccggttaaacggaacccggtttaaccgggtaccgttaaacgggttccggttacgtaaaccccgttaacccgg

SEQ ID NO: 217248 - DNA, 856 bp, Homo sapiens
  misc_feature: GYAE6OF02GHE7O.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggcctcccgaggtaccagctgtgacatccaattcgacccagtcctcctactccctccctgtctgcatctagttggagacagacgtcaccatctacttcggccgggcgagtcgaggccatcagcgtatttacgtttacgccgttggttacgacagaccgaacggaaaccggacggggcgaccgccccgtacgagtacgttccgtagttcgtaggtggtgtacctaacgtccgaagtacgttacggacggtacggggtccgggtaccccagtaccgtaggttcgaggtcggcgtaggcgtacgtcgttacggtacggagtaacgttacgttaaccgtaccgtactaccctaacgttacaccgtacgtaccgaccggtaccttacggaccgaacccgttggtaaacggttaacgtttacgtttacctaacgttttaactttttaacggtttaccgttaacggttaaccttaacgttttaacgtttaaaccgtttaaccggttaaccccgtttaccccgggtttaaccggggttaaccgggtttaaccccggggttaccggggaaacccggggttaacggggtaaacccgggttaaaggggttaaacccgggtaaacgggtttaaaacccccgtaacgggtttaccggtacggggtttcccggttaaccggttacccgtaaacccgtaccggttaacttttttccggaactttttacccccgttacgttccccgtttaccggtaccccccgtaaccg

SEQ ID NO: 217249 - DNA, 674 bp, Homo sapiens
  misc_feature: GYAE6OF02GFHCY.1.34.D01.1.454.CMB.1.raw
  modified_base (127)..(127): a, c, t, g, unknown or other
  misc_feature (127)..(127): n is a, c, g, or t
  modified_base (209)..(209): a, c, t, g, unknown or other
  misc_feature (209)..(209): n is a, c, g, or t
tcagacgagtgcgtcacgaccggtgctcgatttagatcgtctgtgttgggtttgggggagtcagaccctgtcaggacacagcatggacatgagggtcccgctcagctcctggggctcctgctgctcnggctcccaaggtaccagctgtgacgtataccaattcgaccctagtctccactcctccctgtcctgctatctagttggagacnggagtccacctatcacgttcggccgggacagtcgacggccatcgacgcgtatttcttagccgttggttcacgtagaccaagaaaccgaggccgacgtcccctgacgtactcgtacgtcgtagtcgggtcacgtactaccgtagtacgttacgacgtaacggggttaccgggtacccacgttcccgtaagggtttaccagggttacggtctaacgtcggactacgttcggtacgggaactaagtacctttaacctacttaccgtacctaactacgtccgaacgaccgtacgccgtacgactacgtaccgtagttaactttacgtttacgaactttaatttacttacgtagtaactacttaattacgttacttaaccgtacccgtaggtaccgtcggtacggacggaaccggtacgtaacgggtacgaacggtaccgaacgtacggttcgaacggtcgacgtacccg

SEQ ID NO: 217250 - DNA, 562 bp, Homo sapiens
  misc_feature: GYAE6OF02G29F1.1.34.D01.1.454.CMB.1.raw
  modified_base (279)..(279): a, c, t, g, unknown or other
  misc_feature (279)..(279): n is a, c, g, or t
  modified_base (389)..(389): a, c, t, g, unknown or other
  misc_feature (389)..(389): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagctggtgcagcagaaaccagggcgagcccctnagactcgagtctagtggtgcatccagtattgacgaagggtcgggtcccagtccgaggttcacggtggacaagtgcagtcgtgggacagtagttacactctacaacgttancagcacgcctgccagtccgagtaagtattttacgacttaatttaacttacgtagtacaactattaagttaactaacgttaaccccgtagtacggtacggttaccggaccgtaaggggaacctaaagggtacgtaaacgtacgaaacccgtaacgttggtacggtcgttagacc

SEQ ID NO: 217251 - DNA, 834 bp, Homo sapiens
  misc_feature: GYAE6OF02HYUWC.1.34.D01.1.454.CMB.1.raw
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattcgacccagtctccatcctcctgtctgcatctattggagacagacgtacacctatcgacttggccgggcacgtcacggccatcagacgtacttcgttacgcgtggttgcagacaacggaaccgagggaccgacgtcccctanaggtacgtacggtacgtacgttaagtggtacgtctacgttaccgaagttagttcggacggtaacggggtccgggttaccctaacgtaccgtaggttacgtaggtacggtacgtacggtcgtaccgtacgttacgggtacggtaacgtaacggtttaactttacccgtaaccgtttccgttaaaccctacgtttaacgtaccgaacggtaccgtacggtcccttaggtaacccgtaaacgttaacgttaacggttaaagttaccgttttaagggtaacccttttaaaagtttttaacgtttaaccggtacgtttaaaaccgtaacgttttaaacgggttaaccttttaaacgtaaccccggtttaacccgtttaacgggggtttacccggtttaacccggggttacccgggaaaacccgggggttaaccgggggtaaacccggttaaacggggttaaccgggtaaaaccggttacccggtaaaacccgggtttaccgtaaccggggttaccggtaacccggttacgtaaccccg

SEQ ID NO: 217252 - DNA, 618 bp, Homo sapiens
  misc_feature: GYAE6OF02I1M8R.1.34.D01.1.454.CMB.1.raw
  modified_base (197)..(197): a, c, t, g, unknown or other
  misc_feature (197)..(197): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcagtcaggccatcagcgattcttagccttggttgcaggcaaggaaaccgagggcgacgcccctacgagactccgtaagtctagtggtcgcaacttccaaggtattaggacggtaaaggggttccgggtacccagtccgtaaggtttccaaggtcggctaacgtcgactacgtcggtagggaactacggactttaccacgtctacactacncgacgacacgctgcagtccgtaagagttactttagactttaacgtttactactagtaacctaacgttaacgttaatttaacgtaaccgttacccttaaggtcgtaacggttccggaaccggtaagggacgtaaacgggtggtaaccgttaccgaaccggtagtcgggtacggtaccgtagtaacccg

SEQ ID NO: 217253 - DNA, 797 bp, Homo sapiens
  misc_feature: GYAE6OF02HXG5G.1.34.D01.1.454.CMB.1.raw
  modified_base (200)..(200): a, c, t, g, unknown or other
  misc_feature (200)..(200): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatacaattgacccagtctccatcctccgtgtctgctatctagttggaanacagacgtcacctatcctacgttcggccgggtacgagtcgacggaccaagtcgagtacgtactttcgttaacgtccgtaggttcgacgtaacggaccaaacggaaaacccggtggggaccgtaaacccggtcccctaagtaacggtcgttaacggttacgtaccgttacggttacgggtaactccgtaacgttaccgtaaggttaacggttaccggtaaccggttaaacggggggttcccgggttaccccttaaacggttaccccggttaacgggtttaccggtaacgggttacggaaccggttaaggttaaccggtaaccttaaccggttaccggtaacggggaaccttaacgggttaacttaaccccgtacttaccgttaactaacgtaacgttacgacgtaccgacgtacgttacgacgtacggtaccgtaagtagttacgtttacgaatttaacgtttaacgttacgttaataaccgtaattacgttaattaccggtaaccgttaccgaggtttaccgtacggttaccggacggtaacgggtaacgtaggaacggtacgtaacgaacgttaacgtggtaccgagtaccgtaac

SEQ ID NO: 217254 - DNA, 417 bp, Homo sapiens
  misc_feature: GYAE6OF02FSGGK.1.34.D01.1.454.CMB.1.raw
  modified_base (228)..(228): a, c, t, g, unknown or other
  misc_feature (228)..(228): n is a, c, g, or t
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
  modified_base (391)..(392): a, c, t, g, unknown or other
  misc_feature (391)..(392): n is a, c, g, or t
  modified_base (394)..(417): a, c, t, g, unknown or other
  misc_feature (394)..(417): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagtnttttgctaattttattactgtacaactagtattatacgtacccctagtgacgttcgcagggaccaggtgagtcaaccgatgtgctncacatctgtcttcacttccttccccgcccttctcacgctacgtccgtcnggacgcgggctgggcaaggcncagtagnngnnnnnnnnnnnnnnnnnnnnnnnn

SEQ ID NO: 217255 - DNA, 689 bp, Homo sapiens
  misc_feature: GYAE6OF02HI7GA.1.34.D01.1.454.CMB.1.raw
  modified_base (223)..(223): a, c, t, g, unknown or other
  misc_feature (223)..(223): n is a, c, g, or t
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatggagggtccccgctcagctcctgggctcctgctgctctggctcccaggtaccagctgtgacatccaattgaccctagtcctccatccctcctgtctgcatctatggagacagctcacatcacgttgccggganagtcgaggcctagtcagcgtacttcgtttacgccttggttcgacgacgtacgaacggaaacccgnggggaccgaaccgcccccgtagaacgacgttacggtaacgtacttacggtaggtacgacctaactccgaagtagttcgacggtaaggggtccgggtccacgtccgtaggttctaggtacggctaaggtcgacacgttcggagggtacgtaacgtaacgttactaccttatacctatacgtacacggtccagtcctagacctacgcgttagtaacttgtttacgtaacgtaaatttttacgtacgtacgttaaccgtaaagtagtttacgttaaacgttaaccgtaacccgtttaccggtacggtaacgggtttcccggaaaccggtacgggtaaaccgtaaggggtacgttaacgtaccccgttaaggtaacccggttagggtacgtccggattaacccgg

SEQ ID NO: 217256 - DNA, 595 bp, Homo sapiens
  misc_feature: GYAE6OF02FT1VC.1.34.D01.1.454.CMB.1.raw
  modified_base (127)..(127): a, c, t, g, unknown or other
  misc_feature (127)..(127): n is a, c, g, or t
  modified_base (185)..(185): a, c, t, g, unknown or other
  misc_feature (185)..(185): n is a, c, g, or t
  modified_base (312)..(312): a, c, t, g, unknown or other
  misc_feature (312)..(312): n is a, c, g, or t
  modified_base (349)..(349): a, c, t, g, unknown or other
  misc_feature (349)..(349): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctntggctcccaggtaccagctgtgacatccaatttcccagtctccatcctcctgtctgcntctattggagacagtgtcaccatctacttgccgggcgagtcaggccatcagcgattcttagtctcggttgcagcgaagaaaccgaggcgacgcccctcgagactcgtagtctagtggtgcatccagntgcaaggtcggtccatcgagttcagtgcgagtcgcgntcgtggacagacttacgactctcaatactacgacgtcgacgacctgacgacgctagttaagttcttcgtattaacttttaactcgttacgtactaaacgtagttaacgttaacttaaaccggttaaccgttacgtacgggtaaccgggtttcccgacggggtaaccggggtaaccggaaacggggttagaacccggttacgtaaccgggttaaaccgtggttagggaccttccggaccgtaacccg

SEQ ID NO: 217257 - DNA, 768 bp, Homo sapiens
  misc_feature: GYAE6OF02FNUM3.1.34.D01.1.454.CMB.1.raw
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
  modified_base (750)..(750): a, c, t, g, unknown or other
  misc_feature (750)..(750): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctcgtggctccaggtaccagctgtgacactaccaattcgaccctagtcctccactccctccctgtctgctattctagttggacgacagacgtaccactactctacgttcggccgggagacggtccgacggcctagtccgnggtaccgtatttcctttaggtccgttaggttcncgtacgacgaaacggaaaccggcggaccgaccgtaccccgtagagtacgttacgttagtactaggtcggtagacctacgttaccgagttacgtggaaccggtacggggtccggtacccctagtcccggttaggttaccggacggtacggtacctaggtacggccttacggttccggtaggggtaacctaacggttaccttttaacccgaccgtttctaaccttaacgacggttaccgtacgcgtaaccgtccgtacaccgtaacgtacgtacggttaacgtttctttaaccgtacgtttaaactttacgttacgtacgtaaactacttaacgtttacttaaacccgttacccggttaaccgttcgtttacggggccggttaaccgggacccgggtaaccgggtaacggtaaccgggttacggtaacggtacccttaaccggtggttaccggnggtacccgtccgtaaccg

SEQ ID NO: 217258 - DNA, 820 bp, Homo sapiens
  misc_feature: GYAE6OF02H5GX8.1.34.D01.1.454.CMB.1.raw
  modified_base (184)..(184): a, c, t, g, unknown or other
  misc_feature (184)..(184): n is a, c, g, or t
tcagacgagtgcgtcacgaccggtgctcgatttagatcgtctgtgttgggtttgggggagtcagaccctgtcaggacacagcatggacatgagggtcccgctcagctcgtggggctctgctgctcgtggctcccaggtaccagctgtgacatccaattcgacctagtcctcactcctcctgtcncgctattcgttagttaggacgtaaccgagacgtacacctactcctacgttcggccgggtacgtaggtcgacggcactcgacgacgttattttcgtttacggtccgttcgggttacgcgaacgtacgaacggaaaccggacggggtaccgaccgccccgtaaggacgtacgttacggtacggttcgttaggtcgggtacgtacgtactaccgtaggttaacgtcggacggtaacggggtccgggtaccctacggtaccggtacgggttacgagggttcggacgtacggttcgacgtacgtttcggaacggtaacgtaacgtacgttactaccgttacttaacgtaacgttacgtacgtacgtacgtaccgtacgtacgacgtacgtacggttaacgtttaacgtttagtttaaacgttacgttttaaaacttttacgttaacgtttaccgttaaacgtaaacgttttaacgttaaacgtttaaccgtttaaacccgggttaccggtttacggttaccgggttaaccggttacccggggaacgggttaaacccgggggtaaccgggttaaacgggtaccggtaaccgttaaccgggtaaaccggttcgttacgggtacgttaccggtacgtaacccgg

SEQ ID NO: 217259 - DNA, 761 bp, Homo sapiens
  misc_feature: GYAE6OF02GCEZQ.1.34.D01.1.454.CMB.1.raw
  modified_base (127)..(127): a, c, t, g, unknown or other
  misc_feature (127)..(127): n is a, c, g, or t
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
tcagacgagtgcgtcacgaccggtgctcgatttagatcgtctgtgttggggtttgggggatcagaccctgtcaggacacagcatggacatgagggtccccgctcagctcctggggctcctgctgctntggctcccaggtaccagctgtgacatccaattgacccagtcctccatccctccctgtcngctatctattgganacaggtagtccacatcacttcggccgggcagtcacggtccatcgagccgttattcgtttacgtccgttaggttcgtaccgagtaccgaacggaaaccggtagggaccgaccggtccccctagaacgtacgtacgtacgttcctagttaggtcgacgtactccgtaagttacgttacggacggttaacggggttccgggtaccctacggttaccgtaacgggtttccgaacgggttcggaccgtaacggttcgacctaacggttccggtacgggaacgtacgttaacgttaaccaccggtttaccctacgtaacgtacgtcggaccgtacgtaacccgttccgacggtccgacgtcctacggttaagttcgttacgtaactttactttaacgtctaccggtactaaagttattaacggtaaccttaccgtaacccgggtttacggttacgggttaaccccggggttcgggtaaacccggttaacggggtaaaccgttcgggtaaacgggtaaccgtaaccaaccgggttacgggtaccgttcgtaccggtacccgttaaccg

SEQ ID NO: 217260 - DNA, 687 bp, Homo sapiens
  misc_feature: GYAE6OF02HOGUF.1.34.D01.1.454.CMB.1.raw
  modified_base (337)..(337): a, c, t, g, unknown or other
  misc_feature (337)..(337): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgctatctagttggagacagagtccaccatccacttggccggggcgaggtcaggccatcagcgtatttcttagtccgtggttgcagacaacggaaaccgaggggccgaaccgtccccctacaagtagttccggtacgttcgtaaggttcgggngcactccgagtattggacggtaaggggtcgggtacccctagtccgtaggttcgaggtcggcagtcgctagtcggtagacagtacttaccacttacncgtactacgtcgagtcncgtaccgtgaccgtaggtaccgttagtaacgtttaagttttacgtaactttaagttttaactttacgtaccttaacgtaaaccgttagtttaaagtttaccgtaaccgtttaccccggttaagggtccgggtttaaccggttccggggaacccgggtaacggggtaaccggtaaagggtaccgggtaaacgttacccggaaaccggtcggtttagggacccggtactacggtacccg

SEQ ID NO: 217261 - DNA, 797 bp, Homo sapiens
  misc_feature: GYAE6OF02GS3MB.1.34.D01.1.454.CMB.1.raw
  modified_base (319)..(319): a, c, t, g, unknown or other
  misc_feature (319)..(319): n is a, c, g, or t
  modified_base (351)..(351): a, c, t, g, unknown or other
  misc_feature (351)..(351): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcattctagttggagacagagtcaacctataccacttcggcccgggacgacgtcacgggcctatcacgcgtatttacgtttagtccgtggttgacgacgcgaacggaaacccgaggggccgaccgtaccccctanaacggataccggttacgttacgtagtgggtcncgtaactaccgaagtacttcggacgtaacgggggttcgggtaccccacgtacccgtaggtttacgaggttcggcgtagtcgactacgttacgtacgggaactaggtaactttacctacgttaccttaaccgtaaacgttaagttaccgaccgtaaacgcccgttacgcccgtaacggtcccgtaaggttaacgtttacgttttacggtaactttaacgttttttaacttaacccgttagtaaccgttaaaactagttttaaacgtttaaaccgtttaaacccggtttaaccccgttacgggttaaccggggttttacccgttaacccggggtaccggggtaaacggggtaaacccgttaaaggggggtaaccgggttaaacgtaacccggttaaacccggttaacggttacgggttaccggtaccgtacccggtaacctaacccgg

SEQ ID NO: 217262 - DNA, 602 bp, Homo sapiens
  misc_feature: GYAE6OF02FMXBJ.1.34.D01.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacgttgccgggnagtcaggccatcagcattcttagctggtncagcaagaaacngggcacgcccctagagatcgtagtctagtggtgcatcagtagttgacgtagggtcggtacccatccgaggttcaggtcggacagtcgctaagtcgtagggtacaggtacttacgactctactatactcagcacgcctgacacgtccgtagaagttcttttacgactttaaacgtttacttaacgtacgtaactaacgtaagtttaacttacgttaacccggttaccccttagggtaccggtaaccggttaccgggaccggtaacggggtaacccgtaaagggtacgggtaaaccgttaacccggaaccgttaacgtgggtaccgtaccgttacggaacc

SEQ ID NO: 217263 - DNA, 839 bp, Homo sapiens
  misc_feature: GYAE6OF02HIVL4.1.34.D01.1.454.CMB.1.raw
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
tcagacgagtgcgtcacgaccggtgctcgatttagatcgtctgtgttgggtttgggggagtcagaccctgtcaggacacagcagtggacatggacgggtccccgctacagccttccgtgggcctcctgcctgaccttctggactacccgaggtaccagtcgtgtcgacactcctaagttacgaccctagtccacctacttccctccgtgtccngtacagttctagttacggganaccgagtacgtaccaactagtaccgacggttaggccggnaacggtaccgcgtaactgacgagtacgtattacgttacgtacgttggtactcgacgaacgtaaccgaaacggacggccggacaccccgagtacgtacgtcggttacgtacttacggtacgtacgacgtaaccgtaacgtacgtacgttaacggtaccggggtaagggtacccgggtaaccctacggttaccgttacggttaccggtaggttccgggaagtccggtacggtactacggtttaccggaacggaacgtaacgttaaccttaacgttacccgtaacggttacccttaattaaccggtaccggagtaaccggtaccttaacggaccgtacgacggttacccgtaaggttaagtttcgttaacttaaacgggtttaacttaacctttacgttcggttaaacctagttaaacgtttacgttaaacccgtttaaaccgtacccgggtttaccggacccgggtttgaccccgggttaacgggaaacggggtaaccgttaacgggtaacggttaaacccggtacggtttaaccgacggaaccggttcggtaccgttaactacccgg

SEQ ID NO: 217264 - DNA, 679 bp, Homo sapiens
  misc_feature: GYAE6OF02GUN5W.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccatcctcctgtctgcatctattggagacagagtcaccatcacgttcgccgggcgagtcaggccatcagcgtatttcttacgccttggttgcgagacgaaggaaacccgaggggccgacgccccgtacagactcggtagtctagtggcgctagtccggtattcgacgtaaggggtccggggtacccagttccgtaggttcgaggtcggcgaggtgactagtccggtacggggaactaggtaacttacaccgttctaccgtaacgttagtacgacgtcaacggtcccgtacgtaccgtacgtccgttaagtaaacggttacgtttttagaacctttaattttacttaacgttcggttaacttaaaccgttagtttaacgtttaacgtaacccgttaaccccggttagggtccggttaccggttccgggacccggtaacggggtaacgttaaacggggtggtaaaccggtaccaacccggtaagttcgggtacgcgtacggaccttaccg

SEQ ID NO: 217265 - DNA, 772 bp, Homo sapiens
  misc_feature: GYAE6OF02IXY82.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctcctgtctgcatctattggagacagagtcacatacacgttcggccgggcgacgtaccgaggaccatacaggacgtacgtttactttacggtccgttagggttcgcgtacggacgaaacggaaacccggaggggaccgaaccgcccccgtacgaacggtacgttaccggttagttaccggtttaggttacggggtacgtaccgtaacgttacccgtaaggttacgtttacggggaccggtaaacgggggttaccggggttacccctaacgttccccggttaggggttaccgtagggtacgggtaccgaggttacggaccgttaagtccggtaggggtaacaggtaacgttacgaacttccgtaactacgtaactcgaacgtcctacgccgttacgacgtaacggccgtacggttaaagtttctttaaccgtactttaactttttacgttaacttacgtactaacgttaagttaactttaaacgttaaccgtttacccgttagttaccggtacggttaccgggaccggtaacggggtaaacgtcgggtaacggtaacgtcccgaaacggttaggtaccggtcggtacgtaccaccgg

SEQ ID NO: 217266 - DNA, 773 bp, Homo sapiens
  misc_feature: GYAE6OF02H63UF.1.34.D01.1.454.CMB.1.raw
  modified_base (558)..(558): a, c, t, g, unknown or other
  misc_feature (558)..(558): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctctgctgctctggctcccgaggtaccagctgtgactataccaattcgaccctagtcctccactccctcctgtctgctattctagttggaagacgagtacgtccaacctactccgtacgttccgggaccgggacgtaacgtcgacggcctatacgtacggtacgttaattttaccgttaggttccggttgggttcgactaacggtaaccgaaacggtaaacccgaggggtacccaaccgtccccttaacgacgtaacgttaccggttaagttaccgttaggtcgggtactaccgtaacgtacgtaagtacgttacggacgggttaacgggggttaccgaccccgttaggtaccgttaacgggtttacgaggttacgacggtcgtacgactcggttaggacgtaacgtaagttactaacgtcctacgtaccgtaactacgtanaccgtaccacgtcctaacggcgtaccgtagtaaagttacgtttacgttactaacgtttaacttttaacgattaaccgtaagtaacgtttaacttaacgttaacgaacccgtttaccgtaggttaccggtcgtacccgggcggttaaacgggtactaacggggttacgaaaccggtaccgtaacgttagggttaccggtagtaccctcgtaacccg

SEQ ID NO: 217267 - DNA, 552 bp, Homo sapiens
  misc_feature: GYAE6OF02G2FDT.1.34.D01.1.454.CMB.1.raw
  modified_base (230)..(230): a, c, t, g, unknown or other
  misc_feature (230)..(230): n is a, c, g, or t
  modified_base (337)..(337): a, c, t, g, unknown or other
  misc_feature (337)..(337): n is a, c, g, or t
  modified_base (370)..(370): a, c, t, g, unknown or other
  misc_feature (370)..(370): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcagaaaccagggcgagcccctcagatcggtagtctatggtgcatccagattggcaagggtcggggtcccagtcccaggttcagtggcaggtgcatcgtgggacngattacactctacgactagtcagcagcctgcgngccctagagttatttgactaagtttcttactgtacaactagttacttagtaaccgtaccccgtagttcggtacccggttcggacccgaaggggtaccaagggttacgggaacgttaccgaccgtaacgtggtggcgtcgtacccgacctgtacttgttccttctacgttccgttcccgtacc

SEQ ID NO: 217268 - DNA, 1030 bp, Homo sapiens
  misc_feature: GYAE6OF02H7NIH.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaagttcgacccagtcctaccactccctcccgtgtctgctattctagttggagacagagttcacctatcacgttcggccgggtcaggtcaacggcctatcaacggtctaactttctttacgccgttgggttgctaacgcgaaacggaaaccgcgggggaccaacggcccccctgaacggtacgttacccggtagttaccgtagttcgggttccgaccgtacgttacccgtaagtacgtttagggacggtaaacggggggtttcgggggttaacccccctaagggtttcccgttaagggtttacccggtaagggttaccggtacccggtaaggtttaccggaccgttacggtttacccggtaacgggggttaaccgtaaacggtttaacccggtttaaaccgtaacccctttaccttttaaacccggttaaacctttaccgttaaccgtaaccggacccggtaaccgttccccgggtttacgaacccgttaacgggttacccccggtttaaggttaaacgggttttaaaccgttttttaaccgggttaaaccttttaaaaccgttttttaaacgtttaccccgttttaaaggttaaacccgtttaaacggtttaaaaccgttttttaaacgtttaaacccggttaaacccggttttaaaccccccgggtttacggggtttaacccggggttttaaacccccgggttacccggggggttaaacccccggggggttaaaccgggggtaaaccccgggggttaaaacgggggtttaacccggggtaaaaccggtttaccccggaaaaacccggggggttttaaccgttacccggggggttttaaaccggttacccggtaaccccgggtttaaacccccgg

SEQ ID NO: 217269 - DNA, 904 bp, Homo sapiens
  misc_feature: GYAE6OF02JQ606.1.34.D01.1.454.CMB.1.raw
tcagacgagtgcgtcacgaccggtgctcgatttagatcgtctgtgttggggtttgggggagtcagaccctgtcaggacacagcatggacatggacggggtccccgctcagcctccgtggggctccgtgctgctcgtcggcctccgaggtaccagctgtcgacactacctaatcgacccatcctacctactcccttcccgtgttcctcgacctacttcttaggttcggaacgacagactacacctactacctacgttcgggaccggtacggacgtaccgacggacctaacgtccgtaacggtacttacgtttacgtttacggtcccgttgggttaccgaccgtaacggaaccgtaacgggaacccggacggggacccggtaacccgaccccggtacgaacggttacgttaaccggtacgttaccgttaacggttcggtacgtaccgtaaccgtacgtaacggttaacgtaccggaacggttacgggggtccggttacccgaacgttacccggtaagttaccggtagggtacgttacggagtacggtacgtacggttacggacgggtaactaacgttacgttaacctacgttaccctacgttaacacctaagtaccgtacggtaaccgtccggtacggacggtaaccgttacgtaacggttaaacgttttaccgtttaaggttaaccgtttaaacgtttaaccttaacgttaaccgtaacgttaacgtttaaacgttaaacctttaaacccgtaacccgttttaaccgggtaaccggttaccgggttaccgttacccggggtaacggggttaaccggttaacgggggtaaaccgggtaacggtaaaccggttaaccggtaaaccgtttacgggttaacggttacccggtacgttaaccgaacccgg

SEQ ID NO: 217270 - DNA, 804 bp, Homo sapiens
  misc_feature: GYAE6OF02JNH4U.1.34.D01.1.454.CMB.1.raw
  modified_base (335)..(335): a, c, t, g, unknown or other
  misc_feature (335)..(335): n is a, c, g, or t
  modified_base (368)..(368): a, c, t, g, unknown or other
  misc_feature (368)..(368): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctcgtggctcccaggtaccagctgtgacatccaattcgacccagtctccactcctcctgtctcgctatctagttggagacgagacgtacaccatacctaccgttcggcccggggacgaacgtccgaccgggtaccactcacggacgttatttaccgttacgccgtggctggctagccgaaggaacccggaggggaccgacccgccccgtanacggacgttaccggtagttcgtaagtcgggtcncgtaactccgaggtacgttggacggttagggtccgggtaccctacggtacccgttaagggttcggtacggtcgggacgttacgtacggtacgtacgttaccgggtaggaaccgtacggtaacttaccgtaaccctttcctaccgtaagttaccgtacggtaaccgtccgtaaccgaccgttaccgaccgtaccggtcgttaacgtaaacgttttccggtttacgtaaactttttaaaccgtttagtttaaccgttacgttaaaccgttaacgtttaacggttaaacctttaaccggtaaccccgggttttaccgttagggttacccgttaccggggttaacccggggtaacgacccgggggttaaaccgttaacggggtaaccgtacggtttaaaccccgaaccgggttagttacggggttcccaacggtaacccg

SEQ ID NO: 217271 - DNA, 914 bp, Homo sapiens
  misc_feature: GYAE6OF02H2ET4.1.34.D01.1.454.CMB.1.raw
  modified_base (143)..(143): a, c, t, g, unknown or other
  misc_feature (143)..(143): n is a, c, g, or t
  modified_base (356)..(356): a, c, t, g, unknown or other
  misc_feature (356)..(356): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccagtaccngctgtgacatccaattgacccagtcctaccatccctccctgtctagctactctagttggagacagacgtacacctatccgtacgttcggacccggggacgtacggttcaacgggtccaagtcgaaggtcgttacttttaccgtttacggtcccgttgggttacgcgaacgaccgtaaacggaaacccggtaggggaccaccgtcccccgttanaacggtacgttaccggttagtacgttagtgggtcactactaccgagtagttcggaccggtaacgggttccgggtacccctaggttaaccgtacgggttacaggttacggcgtagtacgtactaggttaccggtacgggtaactaaaggttaacttacccgttaaccttaccgttaacctacgtttaaacgttacccgacgggtaacccggttaccggttacccgacgtaacccgttacgggttaaaccggttaaacggttacggtttttaaacgttttacccggttaacttttttaaaaccggtttttaaccgttaaacggtttacccgttaaacccgaaaccgggtttttaaacgtttaaaccgttttaaaacccgttaccccggggtttaacccttaaaccgggggttttcgggtaaccccgggtttttaccgggaacccggggttaaacggggtaaaccccgggttaggggttaaaccggtaaacccggtttaacccggtaaacccggggttacgttaccggggttaccggtacccggttaacccgttaacccgg

SEQ ID NO: 217272 - DNA, 754 bp, Homo sapiens
  misc_feature: GYAE6OF02JFGF5.1.34.D01.1.454.CMB.1.raw
  modified_base (221)..(221): a, c, t, g, unknown or other
  misc_feature (221)..(221): n is a, c, g, or t
  modified_base (414)..(414): a, c, t, g, unknown or other
  misc_feature (414)..(414): n is a, c, g, or t
  modified_base (551)..(551): a, c, t, g, unknown or other
  misc_feature (551)..(551): n is a, c, g, or t
  modified_base (557)..(557): a, c, t, g, unknown or other
  misc_feature (557)..(557): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctcgtggcctcccgaggtaccagctggtagacatccaattcgacccagtcctccatcctccctgtctgctatctagtggagacagactcaacctntccgacgttcggcccggggacgtacgtccgacgggaccctatccggaaggtccggttactttccgttttacggcccgttgggtttacggacctaacggacccgaaacgggtaaaacccggagggggacccgaacccgtcccccctaaggacgttactacggtacgtacttaggtgggtcactacgccgtagtnttacgggacgtaacgggggtccgggtaacctaacggttcccgggtaaggtttcgacgggttagggaccgttacggtacgtactacggtcgggtaacgggtaactaaggttaacttaccacgttctaacggtacttanccgtanccgtaccgtcgtcgacacgtacgtataacgtttcgttagtactttagtttactacgttcgtaataaccgttaattcttaacgtacccggtaccgtttaggtaccgggtccgggtttacgggaacccggttaagggaaccgggttaaggtacggtaaaccgaccgttaacggacggttctcgggtaccttacacccgg

SEQ ID NO: 217273 - DNA, 631 bp, Homo sapiens
  misc_feature: GYAE6OF02GCHB8.1.34.D01.1.454.CMB.1.raw
  modified_base (114)..(114): a, c, t, g, unknown or other
  misc_feature (114)..(114): n is a, c, g, or t
  modified_base (133)..(133): a, c, t, g, unknown or other
  misc_feature (133)..(133): n is a, c, g, or t
  modified_base (504)..(504): a, c, t, g, unknown or other
  misc_feature (504)..(504): n is a, c, g, or t
  modified_base (583)..(583): a, c, t, g, unknown or other
  misc_feature (583)..(583): n is a, c, g, or t
  modified_base (588)..(588): a, c, t, g, unknown or other
  misc_feature (588)..(588): n is a, c, g, or t
  modified_base (595)..(595): a, c, t, g, unknown or other
  misc_feature (595)..(595): n is a, c, g, or t
  modified_base (598)..(598): a, c, t, g, unknown or other
  misc_feature (598)..(598): n is a, c, g, or t
  modified_base (600)..(601): a, c, t, g, unknown or other
  misc_feature (600)..(601): n is a, c, g, or t
  modified_base (603)..(631): a, c, t, g, unknown or other
  misc_feature (603)..(631): n is a, c, g, or t
tcagacgagtgcgtcacgaccggtgctcgatttagatcgtctgtgttgggtttgggagtcaggccatcagcgattctttagcctggttgcagcagaaaccagggcgagcccctnagatcgtagtctagtggtncatccagattgacaagggtcgggtcccatccgaggttcaggtggcaggtgcatcgtagggacagtacttacactcgtaccaacttatacgagtccacgtccctagaccacgtcccgtagtaagttagttttagaacctttaaagtttttacgtacctaggtacctaaaccggtatttactttaaacgtaccccgttaacccccgttagggtacggggtacccggtttccggaacccggtaagggggtaccctaagggggttagaaccgtaccgaacccggtaagttgggtagaccgtacgtacctaaccgtattccgtgtttacccttacgtaccttcccggttaccccactacggtacctacggtaaccnccgttaaccgtccgttacgacggggtaaccgggtccggttacccgtagggaccgaacgggtccgaactacgttaggccnaggtnagtcatngcngnncnnnnnnnnnnnnnnnnnnnnnnnnnnnnn

SEQ ID NO: 217274 - DNA, 791 bp, Homo sapiens
  misc_feature: GYAE6OF02J1H4R.1.34.D01.1.454.CMB.1.raw
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
tcagacgagtgcgtcacgaccggtgctcgatttagatcgtctgtgttgggtttgggggagtcagaccctgtcaggacacagcatggacatgacgggtccccgctcagctccgtgggctcctgctgctctggcctcccaggtaccagtctgtgactatccaattcgacccagtcctccatccctccgtgtctcgactactctagtggacacgagacgtccaacctagtccacgttcggccggggacacgtaccacggtacctagtcgaagtcgttactttcgttacgccgttggtcgacacgcgaacggtaaccgacgggcctaccggcccngacgtntcgtagttctacgtgtctacgactacgaggtacgtcgaccggtacgggtccggtaccctacgtacggtacgtgacggtacggcgtaggtcgacgttccgttaccgagggtaacccttagtaaccttaccgacctttacgttaaccacgttacgtaccacgtaccgccgtacgtaccgacggttaccgaccgttaaaggtacgtttaccgtttaaggtaacctttaggttttaaccgttaccggtttaaacctaccgttaaacggtttaaccgtttacgttttaaaccccggttaaccggttaccccgggttaaccggggttactttaaccccggggtacgggtaaccccgggttaaacggggtacccgttaaaggggttaaccccgggtaacggtttaacccgtaacccgggtaagggtttcccccggtaaggttaccccgttaacgtaacccg

SEQ ID NO: 217275 - DNA, 797 bp, Homo sapiens
  misc_feature: GYAE6OF02JK6MR.1.34.D01.1.454.CMB.1.raw
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagagtcaccatcacttcggccggcagtcacggccatcagctattcttagccttggttcncgagtcaagaaaccgngggactacgccccgtacagacgttcgtagtactacgttcggtcgactaacgtaccgtaagactttacggacggtaacggggttccgggtaccccaacgttaccggtaacgggttttcaacgggttccgggacgtaagggttcgtacgttacggtacgggtacgggaaccagttaacgttaaccttaccgtaccgttacgtaaccttacgtacgtaccgtaccgtaccggtacccgtacgtaccgtaccggttaccgttaaacggttaaacgttttaacgttttacggaaacgttttttaagttttaaccgttttaacgtaccggttaaacttaacgtttaaacgtttaacgtttaaaccggttaacccgtttaaccccggtttaaccgggttaccgggtttaccggttaacccggggtaacccggggtaaaccggggttaaacggaaccgggtttaaagggtaaacccgtaacccggtaaaccggtaaaaccgttccgggttaccggaccgtaccggtaaccg

SEQ ID NO: 217276 - DNA, 624 bp, Homo sapiens
  misc_feature: GYAE6OF02IZRZN.1.34.D01.1.454.CMB.1.raw
  modified_base (102)..(102): a, c, t, g, unknown or other
  misc_feature (102)..(102): n is a, c, g, or t
  modified_base (227)..(227): a, c, t, g, unknown or other
  misc_feature (227)..(227): n is a, c, g, or t
  modified_base (260)..(260): a, c, t, g, unknown or other
  misc_feature (260)..(260): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatccctccctgtctgcactctagttggagacagagtcaccgatcacgttgccgggnagtcaggccatcagctattctttagccgtggtncagcaacgaaaccgagggccgacgcccctacgagatcggttagtcctagtcggtcgacagtccagtattcggacgaacggggttcgggtaccccagttccgtaacgggttcagggtcggactaagggttcgacgtacgttcggtcggggaactaaggtactttaccacttcgtactaaccttatcgaacgccgtaacgccgtagcacgtcctaggtaattactttagacttaatttacctagtacttacaagttacgttacttactaacggtacccttaggtggtaaccgtcggacggtaagggtaccgaagggttaccgtaaggtacccgtaaccgtacggttggtacggtacgttacgaccg

SEQ ID NO: 217277 - DNA, 770 bp, Homo sapiens
  misc_feature: GYAE6OF02F13D2.1.34.D01.1.454.CMB.1.raw
  modified_base (141)..(141): a, c, t, g, unknown or other
  misc_feature (141)..(141): n is a, c, g, or t
  modified_base (530)..(530): a, c, t, g, unknown or other
  misc_feature (530)..(530): n is a, c, g, or t
tcagacgagtgcgtcacgaccggtgctcgatttagatcgtctgtgttggtttggtggagtcagaccctgtcaggacacagcatggacatgagggtccccgctcagctcctggggctcctgctgctctggctccaggtaccngctgtgacatccaattcgacccagtctccactccctccctgtctgctatctagttggagacagactcaacctatcctacgttcggccgggtgtacgtcacggaccatcgagtaccgtatttcgtttacgccgttggttcgcgaacgtacaaacggaaacccgtcgggggaccgtaaccgtccccctagtaacggtacgttaccggttaacggtacgtaaggttcgggtacgtactaaccgttaccggagtaacgttcggaaccggtaaggggttcccggggtaaccctaagtccgtaacgggtttcgtaacgggtggccgtaggtgacctacggttacggtagggactaacgtacttaacgtacgtccttaccgtataacctcggaacncgtacgtccgtacggactacggacccttaagaacggttttactttaaccggtaatttaaacgttttaaccgtttacgttaacggttacccttaaacgttaattttaacgtttaacccgtaacccgggttaaccccttagggtacccggtaccggtttccggggaaaccggtaacgggtaacggacggtttaagggaacccgttaacgaaccgggtagtcggttaccggtacgtaacccgg

SEQ ID NO: 217278 - DNA, 1047 bp, Homo sapiens
  misc_feature: GYAE6OF02HYFRM.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtcgacatacctaattcgacccagtcctcctactccctccctgtcctgctactcttagttacggacgacgacgtacgtccaacctactcctacgttcggccgggtacgacgtcgacggtccaactcgacggtcgttactttccgtttaacggtccgttggttacgccgaacgtaaccgaaaccggtaaacccggacggggcccgaacccgtcccccgtaacgtaacggtacgttaccggttaggttaccgttaggttcgggtacgtaccgtaaccgtaccgtaaggttacgttacgggtaaccgggtaacggggttacccggggtaccctaaccggtttacccgtaggggttaccgtacgggttaccgggtacgtacgggttaccgtacgttaacggtttacgggtaacgggtaacgttaacgttaaacccggtttaacctaacccgtttaccgtaaccgtttaaccgttaacgttaccgaacggttaacccgttcccggtacccgttacgggaaaccccgttacggttaacccgggtttaaaggtttaaaccgttttacgggtttttaacccgttaaaccgttttaaactttttaaaccggtttaacccgttaacggtttaaaaccccgttaaagttttaaacccgtttttaaacggttttaaaccccgtttaaacccccgggtttaaaacccggtttttaccggggttaacccgggttttaaaccccggggttacccgggggtaaaaccccgggggttaaacccggggggttaaaacccgggtttaaaacgggggttaaaccgggtttaaaaccccgggttaacccgggtaaaacccgggttttacccggggtaaccggggtttccgggttaaacccgggttcccgtaaaaccccccgg

SEQ ID NO: 217279 - DNA, 811 bp, Homo sapiens
  misc_feature: GYAE6OF02ITNU3.1.34.D01.1.454.CMB.1.raw
  modified_base (101)..(101): a, c, t, g, unknown or other
  misc_feature (101)..(101): n is a, c, g, or t
tcagacgagtgcgtcacgaccggtgctcgatttagatcgtctgtgttggggtttggggagtcagaccctgtcaggacacagcatggacatgagggtcccgntcagctccgtggggctcctgctgctcgtcggctcccaggtaccagtctgtacgacatccaattcgaccctagtctccgacttcctcctgtactgctattactagtggagtacagtcgtacaccgtactacctacgttcggccgggacgtacgtaccgaggtcctaacgtacgagtacggtaacgttttcgttaccggtacctttacggggttacgaccgaagtaaccgaaacggaaaacccggtgggtaaccgtaccgtacccccgtagaacggtacttacggttacgtaccgttacgtggtacgtccgtaacgtaccgtagtacgttaggtacggtaacggggtccggtaacctcgttaccggtacggttcggtaggtacgacggtacgtacgtccgtaaacgttcggaacggtacgtacgtaacgtttaccaccgttaacgtaccgtacgtaaccgtcgacgtacgtacggtaccgtcgttaccggaccgtacgttacggtaaacgtttcgtttaaacccgtaagtttaacgttaactttcgaacgttaactaacgtttagtttaaaccgttaacgttaacccggttaacccgttaacgggttaccggttacgggtccggtaaccgggtaccgggtaacggtaaaccggtaacggtaacgttaccccggaaggtttaaccggtcggtaccggtacggtaccgtaaccg

SEQ ID NO: 217280 - DNA, 665 bp, Homo sapiens
  misc_feature: GYAE6OF02JS0CH.1.34.D01.1.454.CMB.1.raw
  modified_base (303)..(303): a, c, t, g, unknown or other
  misc_feature (303)..(303): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
tcagacgagtgcgtcacgaccggtgctcgatttagatcgtctgtgttgggtttgggggtagtcagaccctgtcaggacacagcatggacatgagggtccccgctcagctcctggggctcctgctgctctggctcccaggtaccagctgtgacatccaattcgacccagtctccactcctccctgtctgcatcctattggagactagagtctaccactcacgttcggccggggcgagtacacgggccatccaaggccgtattccgtttagccgttggttcgacctaggccgtaacgaaacccgngggggtccaaccggccccttcggaagtactcgtaagtctacgtggtgccatccgacgtatcgacgtaagggtcgggccctatccgnggttcaggtcgangtgcagtcgtagggctaacgtntaccgtaaccttctacctaataccgtataaccggcgtagcccgtagtcgacgtacgttaggtaaactttagttttaccgttaattaaagttttaaccgtatacggttaataacgttaacgttaatttacgtaaaccgtttcccgtaacggttacggttacgtttccgggaccggttaaccgggaacgttaaggggtacgttaagcccggtaaacgaccgttcgggtggacgtccggtaacg

SEQ ID NO: 217281 - DNA, 1001 bp, Homo sapiens
  misc_feature: GYAE6OF02G6YC0.1.34.D01.1.454.CMB.1.raw
tcagacgagtgcgtcacgaccggtgctcgatttagatcgtctgtgttggggtttgggggagtcagaccctgtcaggacacagcatggacatgacgggtccccgctcagctcgtgggcctcctgctcgactcgtcggacctcccgaggtaccagtctgtagactactacctaagttcgaccctagtcctacctacttcccctcccgttgtacctcggtacctacgttaccgttaaggttcggggaaacgtaacccggacggtaacctcccgtaaaccctacgttaaccccgttaaccgggtttccgggaacccccgggggtacgtaaccgggttaccgaccgggtaccttaacgtccggtaacggtcgtttaaccgttttacgttaaccggtaccgtttcgggttacaccggaacgtaacccggtaaacggaaacccgggtacgggaaccggtccggtaacccccgtacgtaacggttaccggtaccgttagtaaccggttaggttacggggtcaaccgtaacgtaccgtacggttaacgtcgggtaccgggtaaggggttacccggtacccgtaccgtttacggaaccggttacgtaggtacggtcgtacgttacggtccgtaacgggttaccgggacggtaacgtaacgttacccgtaacgttacccgttacgttaacccaaccgtttacgtaaccgtacgtacccggtaccgtaccggtacggttaaccgtacccggttagttaaccggttacgtttaccgtttaacgttaacgtttaaaccgtttaaccggttacttaacgttaaaccgtaaccgttttaaacgtttaaccggttaaacccgttacccggttaacccgggttaaccggtttcccggggttaccggttacccgggtaacccggtaaccgggggttaaaccgtacgggttaaaccggtaccggttaacccggttaacggtaccgggtttaccggacggttaacccggtccgttaaaccgg

SEQ ID NO: 217282 - DNA, 1045 bp, Homo sapiens
  misc_feature: GYAE6OF02HZ2JW.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggcctccgaggtaccagtctgtgactataccaagttcgaccctagtcctccacttccctcccgtgtctcgactacttacgtagttggacgacgaggtaccgtaccaacctacttaccgtacggtttcgggcccgggggtacgtacggtaccggaacgggacctaacgttaccggacggtaccgtttaacgttttccgttttaaccgggccggttttagggtttacgaccgaacggtacccgaaaacgggaaaccccggacgggggacccggtaaccgtacccccccgttagaaccggtacggtttacgggtacgtttacccgttaaggtttcggggttaccgtaccgtaaccgtacccggttaagggtacgtttacgggtaaccgggtaaacggggggttcccggggtaacccctacggttaacccccgggttaggggtttaccggttaacggggtaccggtaacgtcggttacggtaccgttaacgggttaccgggtacggggtaaaccgtaacgtttaaccgttaaccctaccgtttaccgtaaccgtaaccgtttaacgacccgaaacggttaccgaccgggtaccccgtacggttacccggtaaaccggttaccgtttaagggtaaacgttttaacgttttaaccggttaaacgtttttaaacggtttttaaccgttaaccgttaaccggtttaaaccttaaaccggtttttaaaccgttttaaccgttaaacccgggttttaacccccgtttaaccccggtaccggggttaaccgggttaccccggttaccgggtaaccccgggggtaaacgggtttaacccgggtaaacgggggttaacccggtaaccggttaacccgggaaaacccggttaaccgggttcggtttacccggaccgtttacccggaacccg

SEQ ID NO: 217283 - DNA, 657 bp, Homo sapiens
  misc_feature: GYAE6OF02INFSF.1.34.D01.1.454.CMB.1.raw
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggcatggacatgagggtcccgctcagctcctgggggctcctgctgctctggctcccaggtaccagctgtgacattccgaattgacccagtctaccatcctccctgtctgctatctattggacgaacagacgtacacctatccacgttcggccggcagtcaggccatcagtcgtatttcttagccgttggttnccgagtacaacgtaaaccgaggggcgtacgccctnacgtatcgtatctagtggtncatccagtatgcgaaggtcggtacctagtcgtacgttacaggttcggcctagtcgactacgtcgtacgggaactagacttaccgacttctaacgtaacttacgacgaactacgtaacgtccgtacgaccgtacgtaccgtaaggttaaacttgtttaacgatttaactttaacgtacgtacgttaactaaacgttatttaaactaccgttaccgtaaccccgttaaggtacgttaccggtcggtaccgaagggaacccgtaaaggtaccgaaacgttcgtaaaccggcgttcggtaggacctacggaacctaacgtcgttactcgttaacttcctaacgttccctaacccttcccg

SEQ ID NO: 217284 - DNA, 723 bp, Homo sapiens
  misc_feature: GYAE6OF02IYHVB.1.34.D01.1.454.CMB.1.raw
tcagacgagtgcgtcacgaccggtgctcgatttagatcgtctgtgttggggtttgggggagtcagaccctgtcaggacacagcatggacatgacgggtccccgctcagctccgtggggctcctgctgctcgtggcctcccaggtaccagctgtgactactcctaattcgacccagtcctccactccctccctgtctgcattctagttaggacgaacagtacgtacaacctatccgaacgttcgggacccgggacgtaagtccgacggacctactacgagtacgtactttacgtttaacgccgttggttacgacacgacaaacggaaaccgcgggaccgaccgtcccctagagtacgtacggttagtacgtagtagggtctaccagttaccgaaggtacgttacggacggtaagggtccggtacccaagttaccgaaggttcgaaggtcgactaaggtacgactacggtcgtacgggactaagtacttaacccgtataccgtactaacgtactacgagtaccacggttccgagtacgacgtactaggtaactttattacgaactttaacgttacttacgtagtaccctaagttagttaaacgttaccgtaacccgtaacccgtttagggacccggtttacggaccgggaaacggaccgggtaaataaccgggtaaacggaaccgtaaccggtaacggtaccggtggttacgaccgtacgaaccc

SEQ ID NO: 217285 - DNA, 839 bp, Homo sapiens
  misc_feature: GYAE6OF02GVIDA.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtcggggcctcctgctgctcgtcggcctccgacggtaccagctgtgactactacctaattcgacccagtcctcctacttccctccttgtcctgacctacttacttagttaggaacgacgagtacgtaccaactactacctacgttcggaccggggacgtacggtaccgacggaccacgtacgtacgacgttaactttccgttacgtcgttcggttcgacgacgacgtaaacgaaaccgggtagggacccggacccgtacccctagtacgtactacggttactacgtaggtcggacgtacgtacgtacgaagttacgtcgaacggtaacggggtccggtaccctacggtacggtaggttaccgaggtacgacgtacgtcgaactacggttacggtaacggaacggttaccttaacggttacctaacttccgttaaccctaacgttaacgtaacgttacgtacccggtacggtccctaacgtaacgttacgtaattacgtttagttataaacgtttaacgtttacctaagtccgttaactaaacggtttacgttaaacgtttaacccgtaacccgtttaaccgggtaacggttaccggtttacccggtaccgggtaaccgggggtaccgttaaaacgggtaaacggggtttaccggaaaaccgtttaacccgggtaaaacccggtttcggtacgggttacccggacgttaccggaacccggtttaacccg

SEQ ID NO: 217286 - DNA, 743 bp, Homo sapiens
  misc_feature: GYAE6OF02I9WK6.1.34.D01.1.454.CMB.1.raw
  modified_base (189)..(189): a, c, t, g, unknown or other
  misc_feature (189)..(189): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccgctgtgacatccaattcgacccagtctccactcctcccgtgtctgctnttctagttggagacgagacgtcacatctacgtcggccgggcgacgtcgagccatccgagctatttacgttagtccgttggttcgacagactaaacggaaaccgacgggccggtaccgacccctcggaacgttacgtaccggttaagttaccgttaagtagggttcggtacctaacgttaacccgtaaggttaacgttacgggaaccgggttaaaccgggggttccggggttaaccccctaacgtttcccgggtaacgggtttaacccggagggttacgggtacggtaacgttaccgggacttacggttacggggtaacgggtaacgtaacgttaaccgtttaaccacctttcctaccgtaaacttcgtacccgtagaccgtaccgtcgttaccggactaccggtaacgttacgtaacgtttacgtttacgtaacttaacttttaacgttactacgtaacgtaactagtttactaaccgttaccgtaccgtgttcgtacggtacggacggtacgacggtaggtacgagtaccgtagacgttcgacgtcagtaacc

SEQ ID NO: 217287 - DNA, 692 bp, Homo sapiens
  misc_feature: GYAE6OF02F0PN7.1.34.D01.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (317)..(317): a, c, t, g, unknown or other
  misc_feature (317)..(317): n is a, c, g, or t
  modified_base (388)..(388): a, c, t, g, unknown or other
  misc_feature (388)..(388): n is a, c, g, or t
tcagacgagtgcgtcacgaccggtgctcgatttagatcgtctgtgttgggtttgggggagtcagaccctgtcaggacacatcatggacatgagggtccccgctcagctcctggggctcctgctgctctggctcccaggtaccagctgtgacatccaattcgacccagtctccatcctcctgtctgcatctattgganacagagtccaccatcacttggccgggnagtcaggccatcagcgtattctttagcctggttgcagcaagaaccngggcaccgtcccctnagactcgtagtctagtcggtgcactaccagtnttggacgtaagggtcgggtaccctagtccgtaggttccaggttcggacaggtcgactgtcgtacgggaacnggttaacttaccgtacgttcctacgtaacttacgtaccgtaacgtaccgacgtacccgtaggacctaccgggtaccttaagggtaacgtttacgttttacgggaaccttttaaagttttacgttaccggtacgttaactaacgttaacgtttaacgttaaccgtttaacccgttaccccgttaaggttaccggggttaccgttacccggggaccggttaacggggaaccgttaacgggggtaacgtaaccggttaacccgaaacccggttaacggttcggtacggtacccgttagaacccccgg

SEQ ID NO: 217288 - DNA, 803 bp, Homo sapiens
  misc_feature: GYAE6OF02HF6J2.1.34.D01.1.454.CMB.1.raw
  modified_base (102)..(102): a, c, t, g, unknown or other
  misc_feature (102)..(102): n is a, c, g, or t
  modified_base (213)..(213): a, c, t, g, unknown or other
  misc_feature (213)..(213): n is a, c, g, or t
  modified_base (460)..(460): a, c, t, g, unknown or other
  misc_feature (460)..(460): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggcctcccaggtaccagctgtcgacactccaattcgaccctagtctccacttccctcctgtctcgctatctagttggacgacagngtacacatctacgttcggaccgggtagacgtcgacggccatcgagtacgtactttacgtttacgccgttggttcgacgacgtaacgaacggaaaccggacgggtcccgtaccgacccccgtacgtaagtacggttaccgtagttccgtaggttcggactaccgtacgtaccgtagtacgtcggtaacggtaacggggtccggtacctcgtttacggtacggttcgacggttcggtaacgtcggtacncgttaaccgtcgggttaacgggtacgtaacggtttaacctttacccgtacctttacccgtaacttaacgttaaccgttacgaacgggttaccctacggtcccgtaacggtaccgtaccggttaccgttaaggttacgttttactttaacggttactttaaagttttactttaccgtagttaacgtacttaaaggtttaaccttaaacgtttacccgggtaacccgtttacgggttaccggttccggttaccggggtaaccgggtaacgggttaacggtaagggttaccggtaaccgttaccggaaccggtaccggttacggtacggttaccggtaccgtaacg

SEQ ID NO: 217289 - DNA, 1085 bp, Homo sapiens
  misc_feature: GYAE6OF02I3846.1.34.D01.1.454.CMB.1.raw
  modified_base (218)..(218): a, c, t, g, unknown or other
  misc_feature (218)..(218): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccgaggtaccagtctgtacgacatccaattcggacccagtcctccacttccctccgtcgtctgcctagttctaagttcggaanacaggacgtccacctattccacgtttcgggacccgggacgtacgtaccgacgggtccccaagttccgaacggtaccggttaactttttccgtttaacggtcccggtttcgggtttacggaccgaacgggaccctaaaacgggaaaaccccgggacgggggtaccccgtaacccggtcccccccgttaaggtaaccggttaacggttcccgggtttaacggttaccctttaaggggtttcgggtaccggacccttaacgtaccggtaacgtttaaggtttaccggacggtaaaccgggggggtttcccgggtaaccccttaggtttacccggtaaacggggtttttacgaacggggtttaccggacgttaaacggggttcgtaaccggttaacggttacccggggtttacggggaacctaaccggtttaacttaacccttaaccgtttcccgttaaaccctacgttaacgttaccgaaccggttaccgtaacccggtccgttaaccgggtacctaacccggttacccgtttaaagggttaacggttttttaccgttttaaaccggttaacgttttaaacctttttttaaacgttaccggttttaaaacgttaaacccgttaatttaaaccccggtttttaaacggtttaaccccggtttaaaaccccgtttacccccggttttaaaggggttaccccggggtttaaacccggggttttacccggaaccccgggggggttaaaacccgggttaacccgggttaaaagggggtttaaacccggggttaaccccggtttaaacccgggaaaccggtttaccccggggttaaccggtttaccgggggtaccctaacccggggttaaccccgg

SEQ ID NO: 217290 - DNA, 797 bp, Homo sapiens
  misc_feature: GYAE6OF02FMN57.1.34.D01.1.454.CMB.1.raw
  modified_base (303)..(303): a, c, t, g, unknown or other
  misc_feature (303)..(303): n is a, c, g, or t
  modified_base (383)..(383): a, c, t, g, unknown or other
  misc_feature (383)..(383): n is a, c, g, or t
tcagacgagtgcgtcacgaccggtgctcgatttagatcgtctgtgttgggtttgggcatggacatgagggtcccccgctcagctcctggggctcctgctgctctggctcccaggtaccagctgtgacatccaattgacccagttcctccactcctccctggtctgcatctattggacacagagtcacctatccacgttcggccgggcgtacgtcgacggaccactcgagtcgtaacttttccttaggtcccttagggttcgacgtacgacgaaaccgtaaaccggaggggcgaccgcccctanaacgtactacggtacgttctagtggaccgtacacttaccgaagtacttacggaaccggtacggggttccgggtaaccccncgttacccggtaggttaccgagggttcggtacctaagggtccgttagaccggttacggtacgggtactaaaggtttaaaccgttactacccttaccggtaactaacgttttaccaacgacgaccgtaaccgtccctaccggaacgtcccgtaacggttaacggtaacgtttacgttaaggttaaccttaaagtttttaaccgttacgttaccggtaaacgttaaaccgtaagttttaaaccgttaaacccgtttacccggttaacccggttaacgggtaacccggtttaccgggtaccgtacccgggtaacggggaaacgttaaggaacgggtaactacgaaccgtagtcggtacgtaccgtacgacctacgtattcgttccgtacttaacgtcccttacccgtccccgtaacc

SEQ ID NO: 217291 - DNA, 860 bp, Homo sapiens
  misc_feature: GYAE6OF02JDRC4.1.34.D01.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatcgtctgtgttggggtttgggggagtcagaccctgtcaggacacagcatggacatggacgggtcccccgctcagcctccgtggggcctcctgctgctcgtcggcctcccgaggtaccagctgtacgacatacccaattcgacccctagtcctccacttcccgtcctgtctgacattctagttgganaccgagacgtaccaacctattccgtacgttcgggaccggggtaccgtaacgtaccgacggacctagttaccgacggtaccgttacttttaccgttaacggccgtttagggtcgtaccgaacgtaccgtaaaacggtaaacccggaggggacccggtaaccccgtaccccgtaggaaccggttaacgtaccggttaacggtacgttacggtcggtacgaccgttaacgtaccgtaaggttcgttacgggaccgggtaaccgggggttaccggtaccccgaacgttaccgggttaacggttcgagggtacgtcgtaaggttcgacttacggtcggtaacggaacgtactaacgttaacctcttaccgtaactacttacgacgtacgacgtaaccgtcctaacggtaccgacgttaccgttaagggtaactttaacggttacgtaaaccgtttaatttaccgtaacgtttacgaaacgtttaacttaagtttaaccttaccgtttaaccgggtaacccgttacgggtaaccggttccggtttaaccgggaaacgggttaaccggggtaacggtaacgggtaaccggttaaaccgtaaccggtaaccggttacggttaacggtaccggtcgtacctaaccgg

SEQ ID NO: 217292 - DNA, 845 bp, Homo sapiens
  misc_feature: GYAE6OF02G6XKN.1.34.D01.1.454.CMB.1.raw
  modified_base (596)..(596): a, c, t, g, unknown or other
  misc_feature (596)..(596): n is a, c, g, or t
tcagacgagtgcgtcacgaccggtgctcgatttagatcgtctgtgttgggtttgggggagtcagaccctgtcaggacacagcatggacatggagggtccccgctcagctccgtgggggctcctgctgctcgtcgcctacccgaggtaccagctgtgacactaccaattccgacctagtcctcccacttccctccttcgtctacgctcttacgttagttagggacgacgacgacgtccaaccacgtcgtaccgttcggaccggggtacggacgtacgtaccggacctacgtaccgtaacggtcgttaacgttttccgtttaccggttccggttttacgggttacggaccggtaaccgtaaccggtaaaaccgggaaacccgggtacgggggtaacccggaacccgtccccggtagtaacgtccggttacgttacgtcgtagtcggtactcacttaccgagttccgtacggacggtaacgggttccgacccgtacgtcggttacgtccgtggtcgtaacggtcgtacgttacgacggttccggaaggtcccttaaggttaacctactaccgttaccctaccgttaactcggttaaccncggtacctaccggttcaggtaacccggagttccttaaagggttacttaaccggtttttgaaccgtttttaactttaacttcgggtttaccaaccggttaaatacgtttaaccgtaaaccgttaaccccggttacggtaacgtttccggttaacggtaccccggtaaggggtaaccgggttaacggtacggggaaccggtaaccgtacccggttacgttaaggtcccggtttaacggtccaggtaacccc

SEQ ID NO: 217293 - DNA, 677 bp, Homo sapiens
  misc_feature: GYAE6OF02F4PPD.1.34.D01.1.454.CMB.1.raw
  modified_base (608)..(608): a, c, t, g, unknown or other
  misc_feature (608)..(608): n is a, c, g, or t
  modified_base (613)..(613): a, c, t, g, unknown or other
  misc_feature (613)..(613): n is a, c, g, or t
  modified_base (620)..(620): a, c, t, g, unknown or other
  misc_feature (620)..(620): n is a, c, g, or t
  modified_base (626)..(626): a, c, t, g, unknown or other
  misc_feature (626)..(626): n is a, c, g, or t
  modified_base (633)..(633): a, c, t, g, unknown or other
  misc_feature (633)..(633): n is a, c, g, or t
  modified_base (638)..(639): a, c, t, g, unknown or other
  misc_feature (638)..(639): n is a, c, g, or t
  modified_base (644)..(649): a, c, t, g, unknown or other
  misc_feature (644)..(649): n is a, c, g, or t
  modified_base (651)..(652): a, c, t, g, unknown or other
  misc_feature (651)..(652): n is a, c, g, or t
  modified_base (656)..(663): a, c, t, g, unknown or other
  misc_feature (656)..(663): n is a, c, g, or t
  modified_base (665)..(669): a, c, t, g, unknown or other
  misc_feature (665)..(669): n is a, c, g, or t
  modified_base (671)..(677): a, c, t, g, unknown or other
  misc_feature (671)..(677): n is a, c, g, or t
tcagacgagtgcgtcacgaccggtgctcgatttagatcgtctgtgttgggtttgggagtcaggccatcagcgattctttagactggttgcagcagaaaccagggcgagcccctcagatcgtagtctatggtgcatccagattgcaaggtggggtcccatccaggttcagtggcagtgcatcgtgggacagattacactctcactatcagcagcctgcacgcctagaacgtattttagacttaattttacttacctcgttccaaacgtaaggttatttaataaccggttaacccccctaacggttggggtaacccggttttccggacccggtaaacgggggggaaccctaaaaggggttacgggtaaaaggtttaccccggaaaacccggtaaaacgtttggttacggggccttacgggtaccctaacccgtaagttaccgtttcgggttaccctttacctaaacgttccccgttttacccccccggtcccctttacccgttacccaaacccggtccctaaccgttttaccggttcccgttacgggaaccgggtcccggggtccgttacggggacccgtaaacgggggtcccaaccgtaagttaaccgngaacncgttaancgtaancgaactnaacgnntacgnnnnnnanncgcnnnnnnnnannnnncnnnnnnn

SEQ ID NO: 217294 - DNA, 868 bp, Homo sapiens
  misc_feature: GYAE6OF02HWIKO.1.34.D01.1.454.CMB.1.raw
tcagacgagtgcgtcacgaccggtgctcgatttagatcgtctgtgttggggtttgggggagtcagacccctgtcaggacacagcagtggacatggacggggtcccccgctcagcctccgtggggcctcctgctgcttcgtcggtcctacccgaggtaccaggccttgtgaacctactaccctaagttccgaccccgtagttcctacccactccccgttccccgtcgttctcggtactaacttaccgttaggttacgggaacgaacgaggtaaccgttccaacccgtactacctaccgttcgggccgggtacggtacgtcgacggacctaagtaccgacggtacgttacgtttacgtttaacgtccgttagggttccgaccgtaggaacccgtaaaccgggaaaacccgggacgggaccggtaacccgtcccccccgttaaggaacggtttaaccggttaccggttaaggttaccgttacggtggtaccggacctacgtacccgtagttacggttacgggaccgggtaaggggtcccggtacccgtaacgtaccggtacggttaccgaggttcggaaccgtaggtccgtacggttacggttaccggtacgggtacgtaacgttaaccgtttaccgtaccctttaaccgtaacccttaccgttacgtactacgaccggtacgtacccggaagtcccgttacgaccggttagttaacgtttacgtttacgttaacctttaagtttacacgtttacgtaacgtaacgttaagtttactactaccggttaccctgggtacgtcggtaccgggacggtaacggtacgaacggttacgaccgtacgtaacggtcgtcggtaacgtgtacgtaccg

SEQ ID NO: 217295 - DNA, 877 bp, Homo sapiens
  misc_feature: GYAE6OF02G2FE5.1.34.D01.1.454.CMB.1.raw
  modified_base (103)..(103): a, c, t, g, unknown or other
  misc_feature (103)..(103): n is a, c, g, or t
  modified_base (143)..(143): a, c, t, g, unknown or other
  misc_feature (143)..(143): n is a, c, g, or t
  modified_base (208)..(208): a, c, t, g, unknown or other
  misc_feature (208)..(208): n is a, c, g, or t
tcagacgagtgcgtcacgaccggtgctcgatttagatcgtctgtgttggggtttgggggagtcagaccctgtcaggacacagcatggacatgagggtccccgntcagctccgtgggctcctgctgctctggctccaggtaccngctgtgacatccaattcgaccagtcctccactcctcctgtccgtgctagttcttaagttgggaanacagtacgtccaaccagttccaacggttcggcccggggtagacgtccgaacggcctaatccgaaggcgtattttccgtttaacggccgttaggttcggactagtaccgaacggaaacccggtaggggaccacccggccccctagtaacggtaccgttacgggtaacgttcgttaaggtcgggttacacctaacggttacccaggttaaggttccgggaaccggtaacgggggttacccggggtacccctacgttacccggttagggttaccgtaagggttcggtacggtagttacggaccgtaacggttcgggtacgggaccttaaaggttacgttaaccgtacttaccgtaccttaaacgtaccgtaccgaacgcctaacggtccgtacgtacccgtacgtacccgttaaggtaacgtttactttactaacgttttaaacgtttacgttaccgttacggtaaaccttaacggtttaaacgttaacttttaacccggttaaaccgttaaccccggggttacggttaccggggttacccggttccgggggtaaaccgggttaaaccgggggttaaacccgggtaaggggtttaacccggtaacggttaaccccggtaaaaccggggttacgtttacggggaccggtttaacccgggtaccggtaaccccg

SEQ ID NO: 217296 - DNA, 738 bp, Homo sapiens
  misc_feature: GYAE6OF02JF4EL.1.34.D01.1.454.CMB.1.raw
tcagacgagtgcgtcacgaccggtgctcgatttagatcgtctgtgttggggtttgggggagtcagaccctgtcaggacacagcatggacatggacgggtccccgctcagctccgtgggctcctgctgcctcgtggcctaccgaggtaccagctgtagactataccaagttcgacccagtcctaccactccctcccttgtctcgtctattctagtcggaagactagactacacctagtcgtacgtcggccggacgtacgtcgacgctataccgagtacgttactttcgtacggtccgtggttacgacgtaacggtcaaaaccggaaccgggtcggggacccgtacccgtccccgtagtaacggtaacgttaccgttaggttacgtacggttggacgactaccgtcgtaagtacgttaggaaccgggtacggggtttccgacccgttaagtaccgggtagtacggtaggtcggacgtacgttcgacgttacgtcggtacggaactaggttaccttaccgactttacctaacgtaccgtagtccgacgtacgtccgtccgtacgtccgtacgtacgtagttagttaccttacgtacgttatttactagtactaacgtacgtaattacgttaaacgtacccgttaccgttggtaccggttaccgtaccgggtaccgggtaacggtaccggtaagacggttaacggtaaccgtacggtacgtcgcggtaaccgtcgtaaccgg

SEQ ID NO: 217297 - DNA, 785 bp, Homo sapiens
  misc_feature: GYAE6OF02IKWV5.1.34.D01.1.454.CMB.1.raw
  modified_base (127)..(127): a, c, t, g, unknown or other
  misc_feature (127)..(127): n is a, c, g, or t
  modified_base (414)..(414): a, c, t, g, unknown or other
  misc_feature (414)..(414): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
tcagacgagtgcgtcacgaccggtgctcgatttagatcgtctgtgttggggtttgggggagtcagaccctgtcaggacacagcatggacatgagggtccccgctcagctcctgggctcctgctgctntcggctcccaggtaccagctgtgacatcctatcgacccagtcctccactccctcccttgtctgctacttcttagttggagacgagacgtccaacctactcgtacgttcggacccggggacgtacggtccgacgggtcctacgtaccgtaaggtccgttaacgtttcctttttaaccggtcccggtttgggtttaccggactacgggaaccgaaaccggtaaaaccggacgggaccgtaccggtcccctacgacggtacgttacggtacgttacgtacgttgggtacnccgtacgttaccgagttacgtacgggtaccgtaggggttcccgggtaccctacggttaccgtacgggtttccggtaaggtcggacgtacggtacggaccgttggtccggtacgggtacgtacgtttaacgtaccgttacctcacgtacttacacgtacgccgtacnccggtnaccgttacgtaccgtaagttagttctttagacgtttaacttttagtaccgtttacggtaaactaagttactttaacgtacttttaaacccggcccgtttaggtaccggttccggttaccggaccggtaaacggggaccgtaagggttaccaaccgggttaaccaaccggtttagccgggtccgtacgtaggtaccccgg

SEQ ID NO: 217298 - DNA, 799 bp, Homo sapiens
  misc_feature: GYAE6OF02FYPIA.1.34.D01.1.454.CMB.1.raw
  modified_base (165)..(165): a, c, t, g, unknown or other
  misc_feature (165)..(165): n is a, c, g, or t
  modified_base (314)..(314): a, c, t, g, unknown or other
  misc_feature (314)..(314): n is a, c, g, or t
tcagacgagtgcgtcacgaccggtgctcgatttagatcgtctgtgttgggtttgggcatggacatgacgggtccccgctcagctccgtggggctcctgctgctctggcctcccaggtaccagctgtgacatccaattcgacccagtcctccatccctccctgtcngctacttcttagtagggacacgaggacgtccaaccacttcgacgttcgggccgggacgacgttcgacggtccaacgtcgagtccgttaactttccgttttaccggccgtttagggttcgaccgaacggtaccgaaacggaaaacccggnggggaccgaccggccccttaccgaggtaccgttaccggttcgtacgttaagtcgggtcgtacccgactccggtaagttacggttacggacgggtaacgggttcccggggtacctacgtccgggtaggttaccggtaggtcggacgtaggtcgacgttacgttcggacggtacgtaacgttaaccgttaacctacccgttccgttaaccttacgtaacgttcgaaccgccgtaccgtccgtaccgtaccgacggttaccgttaacgttaattttacggttaacgtacttttaaacgttttacgtaacgtttacgtaacggttaactacgggtttactttaaccgttacccgttaaccgttacgggttccgtaccggttcggaccgtaacgggaccgtaaggtacgtaacggacctacggtacgtggtacgacgttaccacgttctacgttaccgttcttaaccgttcctaccgtccctccgtaccg

SEQ ID NO: 217299 - DNA, 802 bp, Homo sapiens
  misc_feature: GYAE6OF02HF5X8.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcgagctccgtggggctcctgctgctcgtggctcccaggtaccagctgtgacatccaattcgaccagtctccatcctcctgtctgcattacgtagttgggaagaccgaggtacgtacaacgtaaattccgtaacggttcgggccggggacgtacgttccgaacgggccctacgtaccgaacggtccgttaactttaccgtttacggtcccgttgggttacgcgtaacgtaccgaaaccgaaaccggtacggggccgtaaccggtacccccgtacggacgttaccggttaccggttacggttaccgttaacggtggggtactaccgtacgtacccggtaaaggtccggtttacggaccggtaaacgggggtttcccggtaaccccgtacgtttacccggtgggttaccggtagtcgggggtacaacgggtccgacgttaacgggttcggtacgggaacttacggtaaccttaccgtaacttaccgtacgtaacctaacgtctaaccgggcgtaaccggcctacggtacgtaccggtaccgttaaggtaactttggttaacggttacctttaaagttttacctacgtagttaccaagttagttaccgtagttacccgaccgttaacggcgttacggtccgaacgggtaggactaagggtaccgtacggtaacgtaaccgtgtaacgggtcgacgatacccg

SEQ ID NO: 217300 - DNA, 675 bp, Homo sapiens
  misc_feature: GYAE6OF02G4ADW.1.34.D01.1.454.CMB.1.raw
  modified_base (77)..(77): a, c, t, g, unknown or other
  misc_feature (77)..(77): n is a, c, g, or t
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
  modified_base (289)..(289): a, c, t, g, unknown or other
  misc_feature (289)..(289): n is a, c, g, or t
tcagacgagtgcgtcacgaccggtgctcgatttagatcgtctgtgttgggtttgggcatggacatgagggtccccgntcagctcctggggctcctgctgctctggctcccaggtaccagctgtgacatccaattgacccagtctccatcctccctgtctgcatctagttggagactagagtcaccatcacgttgccgggcagtcaggccatcgagtcgtatttcttagcctgggttnacagacaagaaaccgagggccacgcccctanagtactcggtatctagtggtnactatccagtattcggacgtaagggttccgggtacctacgtccgtaggttaccgagtacggctagtcgactagtcgtagggaactagtacttacacgtctacaactatacagtacacgtacctgactacgtaccgtaggtaaacgtttacgtttacgaatttaaacgttttaagttaacgtacgtaaacctaaacgttaagtttaacgttaaaccgtaccggttaaccccggttacggttagggtaacccggttcggtaacccgggtaacgggtaaaccggtaaggaacgggtaaccttaaccggaacgtaacgttggtacggcctaacggacctaaacggtcttaccggttacgttacttacccgtacgttacctcccccgtaag

SEQ ID NO: 217301 - DNA, 833 bp, Homo sapiens
  misc_feature: GYAE6OF02HHQDC.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctcgtggctcccaggtaccagctgtgacatccaattcgacccagtctccatccctccctgtctgcatctagttggagacagagtccaccatactacgttcggccgggacgacgtacacgggtacccattccgaacggtacttaacgtttcgttttaacggtcccgttaggttcgacaacggtacgaaacggaaaaaccgcgggtacccggaacccgaccccgtacgaacgtacgttaccggttacgtaccgttaaggtcggggttacaacacttacccgagttagttacgaacggtaaggggtccgggtaccctacttaccggaaggtttcaacggttcggacgtagtcggtatacgttaccggagggactaaggtactttacgtactactacgtaaccttacgtacgagtaaccgacgtccgttacgacgtaacgtaccgtagttaacgtttacgtttacgttaactttaaaacgtttctttaaaccgtaacggtttaacctaaaacggtttaagtttaaaccgttaaacgtttaaccccggtaaacccggttttacccgggtaccggggttaacggtttacccccggggtaacccggggtaaacggggtaaacccgggttaaaagggttaaacccgggaaccggtttaaaccccggaaacccgggttacgttaacgggttacccggtaacgtaccggtaaccccgg

SEQ ID NO: 217302 - DNA, 846 bp, Homo sapiens
  misc_feature: GYAE6OF02IOOI8.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggcctcccaggtaccagctgtgacatccaattgacccagtcctccatccctccctgtctgactattctattggagacagtagtaccaccactcacgttcggaccgggcgagtccgaggccaacgtcaacgtacgttaactttacgtttacgcccgttaggttaccgacgtaacgacgaaacggaaaacccggacggggaccgaccgaccccctagtaacgtacgttacggttacgttacctaaggttgggtactacctaacgtaccgtaaggtacgttacggtaacggtaacggggttacccgggtaccctaaccgttaccgggtaaccggtttacgaggtttacgggaccggtacgttacggacgttacggttacgtaggggaaccttagtaaccgtttaaccgtaccttacgttaccctaacgttaaccgtacgaacgtaccgtaacgtccgtacggacctaaccggacgttaacgtaacggtttaacctttcggaaactttttaacgtttacgtttaacttacgttaaccgtaaacgtttagttaaactttaacggttaacccctttaacccggttaccgggttaccggttaacccgggtttaccgggaaacccgggtttaaaccgggggaaaccgttaaacgggggttaaccgtaaaccggtacccggtaaaccgggtaccgttagggttacccgggacttacccgggtaaacg

SEQ ID NO: 217303 - DNA, 777 bp, Homo sapiens
  misc_feature: GYAE6OF02GVKV7.1.34.D01.1.454.CMB.1.raw
  modified_base (504)..(504): a, c, t, g, unknown or other
  misc_feature (504)..(504): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtagacatccaattcgaccctagtctccgatcctccctgtctgctatctattggacgacagtcgtcaccatcacgttcggccgggacgtagtcgacgccatcagcgtatttcttagcgttggtcgcacgacaacggaaaccgcggggtaccgaccgcccctagaacggtacgtacgtacgttaccgtagtcggtcgtctaccgttaccgaagttacgtttcgggaccgtaggggttccgggtacccctagttcccgtaaggtttccgaaggtcggctaacggtgcttaccgtgggaggaacctaggttaaccttaccaccgttccgtctaaccgttaagccgtaacgacggtacccncgtacacggtaccacggttagtaagtttactttaccgttaactttacgttttaacgttacgtacggtaaaccttaaacggttactttacggtttaaaccccgttaaccgtttaacccccccggttttaagggggacgggtttaacccccgggttttacccgggaacccggggtttaaaccggggtaacccggggtaaaaggggtttcccggaaaccggttacccggttaaacccggtacgtacggggtccggttacccgtaccggttaaaccc

SEQ ID NO: 217304 - DNA, 717 bp, Homo sapiens
  misc_feature: GYAE6OF02G191C.1.34.D01.1.454.CMB.1.raw
  modified_base (100)..(100): a, c, t, g, unknown or other
  misc_feature (100)..(100): n is a, c, g, or t
  modified_base (370)..(370): a, c, t, g, unknown or other
  misc_feature (370)..(370): n is a, c, g, or t
  modified_base (528)..(528): a, c, t, g, unknown or other
  misc_feature (528)..(528): n is a, c, g, or t
tcagacgagtgcgtcacgaccggtgctcgatttagatcgtctgtgttgggtttggggagtcagaccctgtcaggacacagcatggacatgagggtcccgntcagctcctgggctcctgctgctctggctcccaggtaccagctgtgacatccaattcgacccagtcctccatccctcctgtctgcatctatggatacaggactcacctatccgacgttcggaccggggctaggtccgaacggcctaacgtcgaggtccttactttcgttacgtccgttggttcgacgtaggaccaaacggtaaaccgcgggaccgtaccgtcccctagtaacggtaccgttaccggtaagttcgttaaggtcgggttacncctaaacgttccgaaggttacgtttacggaaccggttaaacgggggttcccgggtaccccttaaggttaccccggttggttaccgagggtcggtaactacggtcgactacggtacggttacgggaactataacgtactaccgtacgtactacgttacncgacgtctaaccggccttaggcctacgtacctaggtacttacgttacgtacttaacgttttactacgtactacgttaacgtatttaacggtacttaaccggttacctacggttacggtccggtaccggtacggaacggtacgtaacggtacgtaacgtacgtaacggtacgttacggcgtcgacgtacc

SEQ ID NO: 217305 - DNA, 798 bp, Homo sapiens
  misc_feature: GYAE6OF02FLHIG.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctgggttgcagccgaacgaaacccgaggggcgaacgtcccctacgagagtcgtagtctagtggtgcataccagtacttcgacgtaaggggtccgggtcccgactacccgtagggttacagggttcggacgtaacggtcggtactaacgttccggtaggggtaacgtaacgggtaactttaaccaaccgttacccttaccgtaaaccttacctaccgtaacggtaccgtacggtaacccgttggacccaacggttacccgtaacggtaaagtttaccgtttttacggtaaacgtttaaatttttaacgtttaaacgtttacggttaaaccttaaaccggttaaggtttaaacttttaaacggttaaacccgtttaacccccgttacgggttaccgggttaacccggtttaccggggttaaccccgggtaaaggggggtaaaccccggttaaacgggggttaaccggggtttaaaaccgggtttaacccggtaaacccgggttaaaaccggttacggggttaaccgggtaccgtttaaccggtaaccccg

SEQ ID NO: 217306 - DNA, 829 bp, Homo sapiens
  misc_feature: GYAE6OF02G9EOB.1.34.D01.1.454.CMB.1.raw
  modified_base (344)..(344): a, c, t, g, unknown or other
  misc_feature (344)..(344): n is a, c, g, or t
tcagacgagtgcgtcacgaccggtgctcgatttagatcgtctgtgttggggtttggggggagtcagaccctgtcaggacacagcatggacatggacgggtccccgctcagctccgtggggcctcctgctgctctcggctcccaggtaccagctggtagacactacctaattcgacccagttcctccactccctccctgtctgcatactagttggagacagacgtaccaccatcctacgttcggccgggcgacggtcgacggaccactcgaaggccgttaacgttttccgtttaacggtccgttacggggttgaccaacggaacccgaaacggaaaaacccgggnggggaccccggaacccgtaccccccgttaggaacggtaccgtttaccggtaacggttacgtttacggtacggggtctacctacgttaccgaaggttagttaccggacgggtaacggggttccggtacctacggttaccgtaggttaccggaggttcggacgtaagtcgacttagcggtaacgggactaagttaaccgtacctaaccgtttaccaacctacgtaacgtcaacggacacccggttcctagggtacccctaacggtaccgttaaggtaagttttccgtttaataaccgtttaaagttttacctttaagtaccgttaacctaagtttaacgtttaaacctttaacgtaaccccggtttacccgtaagggtttaccggttacccggttaaccgggaaccgggaacggggtaaccgtaacgggttaaccgtaaaccggttacccgtaaacggtccggttaggccggtacgtcgtaaccccg

SEQ ID NO: 217307 - DNA, 682 bp, Homo sapiens
  misc_feature: GYAE6OF02HSWHA.1.34.D01.1.454.CMB.1.raw
  modified_base (125)..(125): a, c, t, g, unknown or other
  misc_feature (125)..(125): n is a, c, g, or t
  modified_base (143)..(143): a, c, t, g, unknown or other
  misc_feature (143)..(143): n is a, c, g, or t
  modified_base (373)..(373): a, c, t, g, unknown or other
  misc_feature (373)..(373): n is a, c, g, or t
  modified_base (456)..(456): a, c, t, g, unknown or other
  misc_feature (456)..(456): n is a, c, g, or t
  modified_base (490)..(490): a, c, t, g, unknown or other
  misc_feature (490)..(490): n is a, c, g, or t
  modified_base (504)..(504): a, c, t, g, unknown or other
  misc_feature (504)..(504): n is a, c, g, or t
  modified_base (530)..(530): a, c, t, g, unknown or other
  misc_feature (530)..(530): n is a, c, g, or t
tcagacgagtgcgtcacgaccggtgctcgatttagatcgtctgtgttgggtttgggcatggacatgagggtccccgctcagctcctggggctcctgctgctctggcctcccaggtaccagctgtnacatccaattcgaacccngtcacctatcctcctaggtctgacaattcctagttacggagacaagacgtccacctatacctaacgttcgggacccgggcgaacgttccgaacgggaccctaattccaacgggccttaacgtttccttttaaggccccttggggttacacgtacggacaaccggaaaaccggacggggaccgtacgtaccccctagaacggtaactccgtaaagtccgtaagtcggtacnctacgtaccagtacgtcgtacgaacggggtaccgggtccaggaccctagggttcgaggtggcgtaggtacggtcgtaggaacncgtattaccactcgtacacgtactagcacgtacncgacgtcagtactnttcgacgttattcgttactgtacgtnacgactacgtacgacctaagtcgcctacgttcgttaccgtccggtacggtaacggtacgaacggtacggtaacgaaccgtaccgtagtccggtagtccgacaccgtacgtagtttccgtacgtccttccgtaacttcccgtacccctccccg

SEQ ID NO: 217308 - DNA, 983 bp, Homo sapiens
  misc_feature: GYAE6OF02HFXU9.1.34.D01.1.454.CMB.1.raw
  modified_base (147)..(147): a, c, t, g, unknown or other
  misc_feature (147)..(147): n is a, c, g, or t
tcagacgagtgcgtcacgaccggtgctcgatttagatcgtctgtgttgggtttgggggagtcagaccctgtcaggacacagcatggacatgacgggtccccgctcagcctccgtggggctcctgctgctctggcctccgaggtaccngctgtgacactaccaattcgaccagtctccactccctcctgtctcgctacttctagttggacgacgagacgtaccacctaacgtcctacggttccggaccggggacgtacgtaccgacggacctacgtacgacgtacgttaacgtttaccgtttaccggtccgttagggttcgaccgtaagtaaccgaaacggtaaacccggacggggacccgtacccggtacccccgtacggtaacggttaccgttacggttaaccggttaccgtttaggtcgggtacgtaccgtaacgtacccgtaggttaacgttcggtaaccgggtaacgggggttcccggtacccctacgttaccggttaaccggtttacgtaacgggtcggtacggtacgtacgtaccgtaacggttacggtaacgggtacgttaaacgttaaccgttaccgtaccgtttaccgtaccgtaaaccgttaccgccgttaaacgccggtaaccgttcccggtaacggtacccgttaaccggttaaaccggttaacgtttaaacgttttaggttttaaacccggtttaaacgttttaaacggtttttaacccgtttaacggttaaccgtttaaaccgttaaaacgtttaaccgtttttaaaccgggtttaaaaccctttaaccccggggtttaaaccccgttaaccgggggttaacccggggttttaaccccgggttaccgggggtaccccggggttaaaacggggaaccggtttaaagggggttaaacccgggttaccgttaaacccgggtaaccgggttaaggtttacccggggtaagggtcccgtttaaaccggacccgg

SEQ ID NO: 217309 - DNA, 764 bp, Homo sapiens
  misc_feature: GYAE6OF02F3HL7.1.34.D01.1.454.CMB.1.raw
  modified_base (102)..(102): a, c, t, g, unknown or other
  misc_feature (102)..(102): n is a, c, g, or t
  modified_base (388)..(388): a, c, t, g, unknown or other
  misc_feature (388)..(388): n is a, c, g, or t
tcagacgagtgcgtcacgaccggtgctcgatttagatcgtctgtgttgggtttgggggatcagaccctgtcaggacacagcatggacatgacgggtccccgntcagctccgtggggctcctgctgctcttgcctaccccgaggtaccagctgtgaacatacctaagttcgaccctagttcctccacttccctcccgtgtctgactatcgtaagttggaagacagatccaacattaccgtacgttcgggcccgggagacgtccgacggccaatccgagtacgttatttcctttaacggccgtttgggttacgcaagacgaaacggtaaaccgacggggacccgtaccggtccccctagaacgtcttacggttacgtcgttagtgggtcnctaactcgaagtattacggacggtaacggggttcccgggtaccctacgtaccggtacggtttcgaggtcggacgtagtacgctacgtcggtagggactagtactactactcctactactactacacgtaccgacgtccgtacgacgaccgacgtaagttaacgttagtttacgttaactttaacttttaacgtttccgtaaaaaaaaaaaacgttcctaaacgttaacgttaactttaaaccgttaaccgttaacccgttaccgggttaccgggttaccgggttaccgggtaaccgggtaaccgggtaaccggtaacgggtaacggtaacggtaaccgtaaccggtaaccggtacggtacggtacgtacgtacccg

SEQ ID NO: 217310 - DNA, 1066 bp, Homo sapiens
  misc_feature: GYAE6OF02JILPK.1.34.D01.1.454.CMB.1.raw
  modified_base (143)..(143): a, c, t, g, unknown or other
  misc_feature (143)..(143): n is a, c, g, or t
  modified_base (189)..(189): a, c, t, g, unknown or other
  misc_feature (189)..(189): n is a, c, g, or t
tcagacgagtgcgtcacgaccggtgctcgatttagatcgtctgtgttgggttgggcatggacatgagggtccccgctcagctcctggggctcctgctgctctggctcccaggtaccagctgtgacatccaattgacccagtcnccatccctcctgtctgcatctagtggacgtacagtacgtccaaccntccacgttcggcccgggtcgagtccacggcctactccgaggtccgtactttccgttacggtcccgttaggttcgacctacggactaacggaaacccggtagggccgaaccgtccccctagaacgtacgttacggttacgttacgttaacggttcgggtacgtacccgtaacgttacccgtaaggttaccgttacggtaaaccggtaaaccgggggtttcccgggtaccccctaacggttacccggttaagggttaccgtacggttacgggaccgttacggtacgtaccggtacgttacgggttaacgggaaccttaacggttaaccgttaccgttaacccgttacgttaacccgtaaccgtttaacgtaacccggtacgtacccgtaaccggttaccccgtacgggttaacccggtaaacccggtttaaccggtttaacgttaaacggggtttttaaaccgttttccgaaaaaccgggttttttaactttttacccgggtaaaactttttaccccgggggtaaaaacttaaaccgggttttacgggttttaaaaccctttaaccgttaaacccccgggttaaacccgggttacccgggtttaaccggggtcccgggtttaaacccccggggtaaccggggttaaaaccggggttaaacccggggtttaacggttaaaaacccggggtaccgttaaaacccccgggtaacccgggtttaaacgtaccgggggtttcccggttaacccgggttaaaccgtaccccgggttaaaccctttacccgggtttaacccgggttttacccggttttaaacccgggtttaaccccttaaaccccccgttttttacccggggtacccccccccttttaacccccgg

SEQ ID NO: 217311 - DNA, 811 bp, Homo sapiens
  misc_feature: GYAE6OF02FICRY.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtgggctcctgctgctctcggcctccaggtaccagtctgtgacactacctaattcgacccagttcctccgactcccttcccttgtcctgactactcttagttacggaacacgagtacgtcccaacctactcgtaccgttccgggaccggggaccgaacggttcccaacgggtcccgaacgttaccgaacggtaccggttaaccttttccgtttaacggtccccgttgggttccgaccgagtaacccggtaacgggaaaaccgggacggggaccgaccccgtacccccgtaacgtaacggtacttaccggttagtccgtttaggttcggtacgactacgtacgtaacggtacgttacggtaaccggaacggggtttccgggtacccttaccgttccgggtaacggttttcgacgggtacggtaccgttacgggtccgtatacgggttccgggtaacggaacgtacgtttaacgttaccctcgttaccctacttaactacctacgtaacgtccgacgtaccggtcctaccggtaccgtcgtaagtaaggttactttcgtaattatttacgtactacgtagtaactagtttaacgtacttaccgtaccgttacgaccgggttccggtaccggtaccggaacggtacgtaacgggtacggtaaccgtaacgggaccgtaacggtcgtaccgtacgtcctaaccgg

SEQ ID NO: 217312 - DNA, 693 bp, Homo sapiens
  misc_feature: GYAE6OF02HSOP0.1.34.D01.1.454.CMB.1.raw
  modified_base (259)..(259): a, c, t, g, unknown or other
  misc_feature (259)..(259): n is a, c, g, or t
  modified_base (386)..(386): a, c, t, g, unknown or other
  misc_feature (386)..(386): n is a, c, g, or t
  modified_base (569)..(569): a, c, t, g, unknown or other
  misc_feature (569)..(569): n is a, c, g, or t
  modified_base (668)..(668): a, c, t, g, unknown or other
  misc_feature (668)..(668): n is a, c, g, or t
  modified_base (677)..(677): a, c, t, g, unknown or other
  misc_feature (677)..(677): n is a, c, g, or t
tcagacgagtgcgtcacgaccggtgctcgatttagatcgtctgtgttgggtttgggggagtcagaccctgtcaggacaaagcatggacatgacgggtccccgctcgagcctccgtggggctcctgctgctctggcctcccgaggtaccagctggcgactactccaattcgacccagtcctaccactccctccctgtcctgacctatctagtaggacacgagactaccactactccgtacgttcggacccgggagtaacncgacggcctaagtcgacggtcttatttaccgtttcgccgttggttcgacgacgaacgaacggaaaccggcgggaccgacccgtccccagaagtagttacggtaactgttaggtcggcaccgttaacnctaagttcgtaccggacggtaacggggttcccggtaccctacggttaccgttacgggttaaccgaggggtttacgacgacggtttacgacgtacccgttggtaccgggaattaacgttccgtaacctttaccgaactacgtacacggacgtcgaaccgtcggtacacgacggtctaaaggttntttgtacatttaacttcgactcgaaacacgtaagtttactacgaccggtaacctcggagtaccggtccggaggaacggaacgacggtagaaccacggtnttaccgggngtacggtcacgtagac

SEQ ID NO: 217313 - DNA, 895 bp, Homo sapiens
  misc_feature: GYAE6OF02IBQAK.1.34.D01.1.454.CMB.1.raw
  modified_base (210)..(210): a, c, t, g, unknown or other
  misc_feature (210)..(210): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctctggcctcccgaggtaccagctggtgacatcctaattcgacccagtctccactccctcccgtgtctgctatctagttgganacagacgtccaacctatctacgttcggaccggggacacggtaccgacggccctagtaccgacggtcggttactttaccgttttaggcccggttgggttacgaccgtaaggaccgtaaacggaaaaccggtccgggggacgtaacccggtccccccgtagtaacggtacgttaccggttacgttaccgttaaggttcgggtacgtacccgtaacgtacccggtaaggttacggtttacgggaccggttaaacgggggttcccgggtaccctaacggttcccggttaaagggtttcccggtaagggttcgggacccgtaacgggtcgtaaccgtaccggtttacggtaacggggtaactacgggtaccgtttaaacccacccgttaccgttaacgtacttaacggtaccgtaacgacccgtaacggcccgttaggcccgtaaacgtaccggttaaacggtaacgtttttagttttaccgtaaaccttttaagtttttaaccgtacggtattaaaccggttaacgttaacgttttaacgttaaaccggttaccccttaaccgggttacgggtacgggttaccccgggtttaccgggacccgggttaaacgggtaaccggtacggggttaaccggtaaaccgtaccggtaaccggttacggttaggtcccggtacggttaaccgtcccg

SEQ ID NO: 217314 - DNA, 661 bp, Homo sapiens
  misc_feature: GYAE6OF02GX80A.1.34.D01.1.454.CMB.1.raw
  modified_base (102)..(102): a, c, t, g, unknown or other
  misc_feature (102)..(102): n is a, c, g, or t
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (318)..(318): a, c, t, g, unknown or other
  misc_feature (318)..(318): n is a, c, g, or t
  modified_base (412)..(412): a, c, t, g, unknown or other
  misc_feature (412)..(412): n is a, c, g, or t
  modified_base (653)..(653): a, c, t, g, unknown or other
  misc_feature (653)..(653): n is a, c, g, or t
tcagacgagtgcgtcacgaccggtgctcgatttagatcgtctgtgttgggtttgggggagtcagaccctgtcaggacacagcatggacatgagggtccccgntcagctccgtgggctcctgctgctctggctcccaggtaccagctgtgacatccaattcgaccctagtctcctatcctccctgtctcgcatctatggaanacagacgtcaccatcacgtcgccgggcgtagtcgagtccatcagcgtattcttagcctggttcncagcgaagaaaccgnggtcgacgcccctagagtactcggtagtcgtagttggnctagtccagtagtggactaagggtcggtaccctacgtccgaacggttcgaggtcgacgtagtcgacgtgtcggtaggacgtaagtacttaaccncttcgtaaccgtacttactacgaacgtacctaggtccctaggacctaacggtacgtaagtaacgttcgttttaggacctttaagtttaaccgttcgttaacgtaccgtaaactttcggttaaactttaccgttaacccgttaacccgttaggtacccgttaccggtccgggtaaaccggaacggggtaaccgtaacggtaggaaccttaacccaaacgggtactacgggttgaccccgttntaacccgg

SEQ ID NO: 217315 - DNA, 878 bp, Homo sapiens
  misc_feature: GYAE6OF02GHMAV.1.34.D01.1.454.CMB.1.raw
  modified_base (324)..(324): a, c, t, g, unknown or other
  misc_feature (324)..(324): n is a, c, g, or t
tcagacgagtgcgtcacgaccggtgctcgatttagatcgtctgtgttggggtttgggggagtcagaccctgtcaggacacagcatggacatgagggtccccgctcagctccgtgggctcctgctgctctggctcccaggtaccagctgtcacactcctaaatttcgaacccagtcctccacttccctccctgtctcgcactcgtaagttggactacaggacgtaccaccatacctacgttcggcccgggagtacggtcgacggccatccgagtcgtacgttcgtttagccgtggttcgacgacgacaacgaaaccgcgggaccnccgccccagacgtagtacgtacgtcgtacgtggtcactactacctagattacggacggaacggggttccgggtaccctacgttaccggtacgggtttacaacgggttacggaccgtagggttacgtaccgttaacggttccgggaacggggtaaccttacgggtttaaacctttaacccgtacccgtttccgtaaaccgtaaccgtttaaccacggtaaccgtaccggttaaccgcccggttacgtaaccgacccggttaaccgttaaacgggttaacttttacgttttaaccgttaaacgtttttaaaccggttttaatttacccggtacgtttaaacctaaacggtttaaccttttaaacgtttaacccggtttaaacccgggtttaacccccggttaacgggttacccggggttaaccgggtttaacccgggggaaccggggttaaaccggggttaaacccgggttaaggggttaaccggttaaacccggttaaccggtaaaccccgggtttaacggttccgggtaacgtttacccgtaccggttaacccg

SEQ ID NO: 217316 - DNA, 831 bp, Homo sapiens
  misc_feature: GYAE6OF02JQF3L.1.34.D01.1.454.CMB.1.raw
  modified_base (150)..(150): a, c, t, g, unknown or other
  misc_feature (150)..(150): n is a, c, g, or t
tcagacgagtgcgtcacgaccggtgctcgatttagatcgtctgtgttgggtttggggagtcagaccctgtcgaggacacagcagtggacatggacgggtccccgctcagctccgtggggccttcctgctgctctggctcccgaggtaccngctgtgacataccaattcgaccctagtctccatccctcctgtctgctatctagtggacacagtacgtccaacgacttcgtacgttcgggccgggacacgtccgacggtaccactcgacgtacgttactttcgtttacggccgtttggttacgacgacgtaccgaaacggaaaccgtcgggaccaccgccccgttaagaacgtacgtacgttcggttacgtaggtcggtcgtactacgttcgaagttacgtacggacggtaaccgggttcggtacctaacgttcgtacggtaccgtaggtacgcgtacggtccgacttcggtacgtacgggtaacctaggttaccttaccgtaccttacgttaactaccgttaaacgtccgtaacgtacgtacccgtaccggtaggaccgttaacccgacgtttacgggtaaattttccgtttaacggtaactttttaacggtttaacgtttaccgtaacgttaacccgttaagttaacgttttaaccgtttaaaccggtacccgtttaacccgggtttaagggttcccggtttaaacgggtcccggggtaaacccggttaaggggtaaaacccgggttaacggttaaccgggttaaaacccttaaccgggaaaccggtttaccggttacgggtaacccggttaccgttaacggtaaccccg

SEQ ID NO: 217317 - DNA, 722 bp, Homo sapiens
  misc_feature: GYAE6OF02GMEYC.1.34.D01.1.454.CMB.1.raw
  modified_base (527)..(527): a, c, t, g, unknown or other
  misc_feature (527)..(527): n is a, c, g, or t
tcagacgagtgcgtcacgaccggtgctcgatttagatcgtctgtgttgggtttgggggagtcagaccctgtcaggacacagcatggacatgacgggtccccgctcagctccgtgggctcctgctgctctggctcccgaggtaccagctgtacgacactaccaattacgacccagtcctcctactccctccctgtctgctagtctagttggagacgagacgtccaacctatccgacgttcggccgggcgtacgtcgacggacctatcgacgtcgttactttccgttagccgttggtacgcgaacgacgaaacggaaaccgtcgggggcctacccgtcccctacggtaacgtaccgttaccggttacgttcgtagtcgggtcaacctacgtacaaggtacgttcggacggtaacggggtccggtaccctacggtaccgtaggttcgacgggtacggtacgtaggtccgacgtaggttccggaagggaacctagtactacctactacgtacctactacgacgtacgtacnccgtcgtacgctaccgtcgtaagttaacgttctttacggtaatttaacttacgttacgttactaactacttaacgttacgttacctaaccggtacccgttaagggccggttacccgtacgggaacccgggtaaggtaaccgaagggttacgtaaccgtaccgtacggttaccgacggtacggacctacggtaacc

SEQ ID NO: 217318 - DNA, 708 bp, Homo sapiens
  misc_feature: GYAE6OF02H2XGQ.1.34.D01.1.454.CMB.1.raw
  modified_base (198)..(198): a, c, t, g, unknown or other
  misc_feature (198)..(198): n is a, c, g, or t
  modified_base (270)..(270): a, c, t, g, unknown or other
  misc_feature (270)..(270): n is a, c, g, or t
tcagacgagtgcgtcacgaccggtgctcgatttagatcgtctgtgttgggtttgggggagtcagaccctgtcaggacacagcatggacatgagggtcccgctcagctccgtggggctcctgctgctctggctccaggtaccagctgtgacataccaattcgaacccagtctccatcctcctgtctgcatctattgganacagacgtcactatcctacgttcgccgggcgagtcaggccaatcgagtcgtatttcgttacgccgttggttncagacaagaaccggacgggaccgtacgaccccgtcgacggtacgttacgtacgttacttacgtaggttcgacgtactaccgtaagacttacggaacgtacggggttaccgggtacccctacgttccggtaacggtttccgtaacgggtacggttaccgagtacggtactacggttacggtacgggtaacgaaacgttacttaaccctacgtactaaccgtacttagactaacggctaacgcccgagtaccgaactcgtaagtacctttatttacgtacttaaattttacgacttaacgttccgtaaaattacgtttaaactaccggttaccttaaaccccggtgttacggggtaccttaccgggaaacccgttagggtaacctaaacggggttcgaaaccgttacgaaaccgtaccgttgggacgttcgctaacccgg

SEQ ID NO: 217319 - DNA, 885 bp, Homo sapiens
  misc_feature: GYAE6OF02JAD2H.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggcctcctgctgctctggctcccaggtaccagctgtgacatccaattcgacccagtctccactcctcctgtctgacatctattggagacagagtccacctatcacgttggccgggcgtacgtcgacggccagtccgagtccgtaatttcgtttacgccgttgggttacgactacggaccgtaaacggaaaacccggacggggacgtaccggtaccccccgtacgaacggtacgttaccgggttaggttaccgttaggttgggtaccgtacgtacgttacccggtaaagggttaccgtttacgggaaccgggttaaaagggggttcccgggggtttacccccgtaacggtttaacccccgggttaaggggttttccccggtaaggggttaccggacccggttaagggttaaccgtacgttaaccgggtttaccggggtaaccgggtaaccgtaagggttttaaaccctttaacccggtaccttaccgttaccctaacggttaactaccgaaacggtccgtaacgtccccgtacggtaccgtaaccggttaccgtaaggttaacgtttaccgtttagttaactttaattttaacggttaccgtaagttaaccgtaacgttaagtttaacgttacccgttaaccgttaccccggttagggtttaccgaccggggtttaccggacccgggtaaacgggggttaccgtaaaggggtacgttaaacccggttaacccggtaacgtaacgttcggggtaccctacggtaccgtaacccg

SEQ ID NO: 217320 - DNA, 724 bp, Homo sapiens
  misc_feature: GYAE6OF02FKRQL.1.34.D01.1.454.CMB.1.raw
  modified_base (498)..(498): a, c, t, g, unknown or other
  misc_feature (498)..(498): n is a, c, g, or t
  modified_base (537)..(537): a, c, t, g, unknown or other
  misc_feature (537)..(537): n is a, c, g, or t
  modified_base (547)..(547): a, c, t, g, unknown or other
  misc_feature (547)..(547): n is a, c, g, or t
  modified_base (556)..(556): a, c, t, g, unknown or other
  misc_feature (556)..(556): n is a, c, g, or t
tcagacgagtgcgtcacgaccggtgctcgatttagatcgtctgtgtttgggtttgggggagtcagaccctgtcaggacacagcatggacatgacgggtccccgctcagctccgtggggcctcctgctcgctctggctcccaggtaccagctgtgacatcaattcgacccacgtctccacttcctccctgtctcgactactcgtagtagggacgaacgaggacgtccaaccgtattcccgtactttaccgggccgggtaccggtacggtacgaccggtcccacggtccgaacggtccgttacttttcccggttaccgtccgtttggtacgacggtaccgtaccgaaacgggtaaaacccggccggggtacgaacccggccccgttaacgtagtaaccggttcgtagttacctaggttcggtacgactacgtaccgtagtaccgtcggacgtaggggtccggtaccctaacgtcggtacggtctaggtcgacttaggtanacgtacgtaggtacggataacgtctacgactctacgtanctccgagtcnccgtcgtanccgtgtctaggtactacgtttgtaaactttaatacgtttacgtacgttaagtaactagtaccttaacgtacctaacccgggttagccggttaccgggttccggaacggtaagaacccgggcggtaagggtaacctacccggaattccgggacgacggttcaccggtac

SEQ ID NO: 217321 - DNA, 695 bp, Homo sapiens
  misc_feature: GYAE6OF02IDXHY.1.34.D01.1.454.CMB.1.raw
  modified_base (152)..(152): a, c, t, g, unknown or other
  misc_feature (152)..(152): n is a, c, g, or t
  modified_base (196)..(197): a, c, t, g, unknown or other
  misc_feature (196)..(197): n is a, c, g, or t
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (434)..(434): a, c, t, g, unknown or other
  misc_feature (434)..(434): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctcgtggctccaggtaccagtctgngacactcctaatcgaccctagtcctccacttccctcccgtgtcnncacttctagtggagacaggactcaacntacacgttcggaccgggnacgtcgacgacactcgacgcgttagttccgtttacgccgttgggtacaccgagacgaacgtaaacggnggcgtaccgccctacgaggntaccgttagtacctagttggacgtacacgttaccgagtacgtcggtacgtaacggggttccggaccctaaagttcccgtaaggtgtacgggttcgcgttaaggngtaactacggtacgacgggtaacgtacgtagttacacctccgtatacgtacgtacacgacctactcgacacgtaacgccgtagttaatacgttacttaacttaattttacctaggtttaccgaactaacgggtttatttaactaaacgttaacccgtaaccgttacggttacgggtaccgttcgggaaccggaacgggttaaaccggtaggtaacgtacgggacctaaacccggtagttaaccggggtctaccgtctaacg

SEQ ID NO: 217322 - DNA, 851 bp, Homo sapiens
  misc_feature: GYAE6OF02H2GNC.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagtctgcgacactccaattgacccagtcctaccatccctacctgctgctatctagttcggagacagacgtacacctagtactaaccgttggaccggggtcgaagtccacgggtccctaagtcgaacggtctaacttttccgtttaaacgccgtttaggttcgacctaaggaccaaacggaaaaccccggagggggtacccgtaacgaccccccttacgtaacggtaacgttaccgtaacggttacgtacgttagggttacgcctaacgtcccgtaaaggttacttacgggaacgtaaacgggggttccgggtaccctaacgttacccggttaaggttccgaaggttacgccgtaacggtagtccaaggttaccggtacgggtaaacctacggttaacgtttaacctaccgtttacgtacccctaaattaaacgggttcaaccgtaccgagacccttcggacaacgttccgtaaggtaagttaaacgtttcgaacttaacgtttttaacgtaaaccgtcgttaaaacccgaagttaaacgtttacggttaaactaacccgggtttaacccttaccgggttaccggtaacccgggtttccggtaacccggggtaaaccggggtaacccgtaaaagggggttaaccggtaaacgtaacccgggttaaaaccggttaacgtacgggtaaccggttcgtaaccgtaaaccccgg

SEQ ID NO: 217323 - DNA, 728 bp, Homo sapiens
  misc_feature: GYAE6OF02G4MIU.1.34.D01.1.454.CMB.1.raw
  modified_base (102)..(102): a, c, t, g, unknown or other
  misc_feature (102)..(102): n is a, c, g, or t
  modified_base (136)..(136): a, c, t, g, unknown or other
  misc_feature (136)..(136): n is a, c, g, or t
  modified_base (143)..(143): a, c, t, g, unknown or other
  misc_feature (143)..(143): n is a, c, g, or t
  modified_base (152)..(152): a, c, t, g, unknown or other
  misc_feature (152)..(152): n is a, c, g, or t
  modified_base (166)..(166): a, c, t, g, unknown or other
  misc_feature (166)..(166): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (242)..(242): a, c, t, g, unknown or other
  misc_feature (242)..(242): n is a, c, g, or t
  modified_base (712)..(712): a, c, t, g, unknown or other
  misc_feature (712)..(712): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggcctcccnggtaccngctgtgacntaccaattcgaccngtctccatccctccctgtctgcatctagtggancagatcacntctagttggccgggcgacgtcgacggccatacgngcgtatttcgttaacgccgttggttcgacctagacgaacggaaaaccgacggggccaaccggtccccccgagtaaccggtagtccgtaacggtttcctaacggtggtcggtacctaacttccgtaacgtagttacgggacggtaaagggggttccgggtttacccctagtttacccgagggtttacccgtagggtaccggggtcctaaggttcgtaccggtaacgtttccggtaaagggacgtaacgttaaccgttaacccgtaccttaccgttacccgaattacccgtacgacggtaccgtaacccgctacgggtaccgtacgtaccgtacgttaaggtacttttagactttaacgttttacgtactaacgtactaacttagttaacttacgtaccgtaacccgttcggagttaccggtcgggaacggtaacggtaccgttagggacgtaacgttccgtaacggtacgnggtcgtcgacggtacc

SEQ ID NO: 217324 - DNA, 739 bp, Homo sapiens
  misc_feature: GYAE6OF02HSR9Z.1.34.D01.1.454.CMB.1.raw
  modified_base (102)..(102): a, c, t, g, unknown or other
  misc_feature (102)..(102): n is a, c, g, or t
  modified_base (278)..(278): a, c, t, g, unknown or other
  misc_feature (278)..(278): n is a, c, g, or t
  modified_base (293)..(293): a, c, t, g, unknown or other
  misc_feature (293)..(293): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctcgtggcctcccgaggtaccagctgtgacataccaattcgacccagtcctaccattccctcctgtctgctatctagtacgagacagagtaccactatctacgttcggccgggacgagtcgacggcagtcgagctattcgttagccgttggtncagacaacgaacggnggacaccgccctagaacgtacgtcggtattcgtagtcggtacgactaccgtaccgaagtactacggacgggtaaacgggtcccgggttacccctaaacgttccggtacgggttacgtacgggtcggtaacgaggttcgacgttaacggttcccggaagggtaaccgttaacgtaacttacccgaacgtttcctaccgtaacttactaacgacgtaccgaccgtcgtaaccgtacgtaccgtaacgttaaggtaactttaggttaaccttaagtttaaccttttacgtttacgtaaccttacgaaaccgtttaagtacgtttaaaccgtaccgttacccggttacggttaccggtaccggtttacccggacggttaaccggggaaactaccgggttaacgtaaccggtaaccgtaaccggttaggtccggtggtaccgacctaccgg

SEQ ID NO: 217325 - DNA, 672 bp, Homo sapiens
  misc_feature: GYAE6OF02FXIJN.1.34.D01.1.454.CMB.1.raw
  modified_base (103)..(103): a, c, t, g, unknown or other
  misc_feature (103)..(103): n is a, c, g, or t
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagacgagtgcgtcacgaccggtgctcgatttagatcgtctgtgttggggtttgggggagtcagaccctgtcaggacacagcatggacatgagggtccccgntcagctcctggggctcctgctgctctggctcccaggtaccagctgtgacatccaattcgacccagtctccatccctccctgtctgcatctattgganacagagtccaccatcacttgccgggcgagtcaggccatcagcgattcttagccttggttgcgagcaagaaaccgagggcacgcccctanacgatcgtagtcctagtggtgacataccgagtagttgacgtaaggggtcgggtacccagtccgtaggttcaggtcggctaggtcgaccgtatacggtagggtaacagtaacttaacgtacttctacctaacttactccacgacgtacgtcctagtaccgacgtccttagaacgtttactttttagaacctttaaattttacgttaacgttcgttaactaaacgttagtttaaatttaaccgttaaccgtttaccccttagggtaccgggttacccggttaccgggtaacccggaaccgggggttaacccgtaaaggggttaccggtaaaccggttaccgtaaacccggttaacggtcgggtacggtacggtaccggtaacccg

SEQ ID NO: 217326 - DNA, 636 bp, Homo sapiens
  misc_feature: GYAE6OF02G6ZTJ.1.34.D01.1.454.CMB.1.raw
  modified_base (541)..(541): a, c, t, g, unknown or other
  misc_feature (541)..(541): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (564)..(564): a, c, t, g, unknown or other
  misc_feature (564)..(564): n is a, c, g, or t
  modified_base (568)..(568): a, c, t, g, unknown or other
  misc_feature (568)..(568): n is a, c, g, or t
  modified_base (576)..(576): a, c, t, g, unknown or other
  misc_feature (576)..(576): n is a, c, g, or t
  modified_base (581)..(581): a, c, t, g, unknown or other
  misc_feature (581)..(581): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
  modified_base (605)..(605): a, c, t, g, unknown or other
  misc_feature (605)..(605): n is a, c, g, or t
  modified_base (623)..(623): a, c, t, g, unknown or other
  misc_feature (623)..(623): n is a, c, g, or t
  modified_base (626)..(626): a, c, t, g, unknown or other
  misc_feature (626)..(626): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcgaaggtggggtcccatccaggttcagtggcagtgcatctgggacagattaccactctcactatcagtcagtcctgcgagcctagagtattttgacttaattttacttacgtcgtactaactagttaattaacgtacgtaacccccgttacggttcgggtacccggttcggaccgaacggggggaaccctaagggggtacggaaacgtccgtaaaccggtaaccgttggtacggtcctacggacgaccctagttaccgtttacgttcccgtttacctacttacccgtttccccccaccccttcctaccgtacccgtacctacccgtccggttacttaccgggacggtccgggtcgtacggggtaccggaacggtccgtacgagtacggtcgactagngctagccatccgnaacngcnctntagngcgtacgngcatntatatgtcgtcgtcncgngtcgtnacgtagtacgtacacganacngaccgtgtcg

SEQ ID NO: 217327 - DNA, 769 bp, Homo sapiens
  misc_feature: GYAE6OF02GN01T.1.34.D01.1.454.CMB.1.raw
  modified_base (230)..(230): a, c, t, g, unknown or other
  misc_feature (230)..(230): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggactcccaggtaccagctgtgacatccaattcgacccagtctccatccctccctgtctgcatctagttggagacagagtcaccatctacgttcggccgggngagtcgacggcctatcacgcgtactttctttaggcccgttggttcgaccgagtccgaaacgaaacccggaggggccaaccggccccctagacgtagtcggttagtacctaaggtcgggtacgcgtaacgtccgaagtagttcggacggtaacggggtccgggtaccctacgtcccggtaggtttcgaaggtcggacgtacggtcgacgtacgtaccggtaggggactaacgggttaacttaccgaaccgtttccaaccgtaccgttaacgtaccgtaaggcctaaaccggcccgttacgaccgaaccggttaccgtaaggttaacgttacttttaggaccgtttttaaaagttacctttaaccggtattaaccgtaaaccgttagtttaaaccttaccggttaaccccgttaacccggttacggttacgggtaccccgggtttaccgggaaccgggtaaccggggttaacccggtaaagggtacgggtaaaccctaaccggtaacccggttagccgggttaaggtcccgtaggaccccc

SEQ ID NO: 217328 - DNA, 847 bp, Homo sapiens
  misc_feature: GYAE6OF02HT4MH.1.34.D01.1.454.CMB.1.raw
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
tcagacgagtgcgtcacgaccggtgctcgatttagatcgtctgtgttgggtttgggggagtcagaccctgtcaggacacagcatggacatgacgggtccccgctcagcgtcctgggggcctcctgctgctcgtggctcccgaggtaccagctgtgacataccaattcgacccagtcctccactccctccctgtctgctactctaagttggacgacgagtacgtaccaaccgtatacctcggttaccggccggggtacgacgtcgaagggcctagtcgaggccgttaacgtttctttacgccgttggggttacnccgtaagaccgaacggtaaaacccgnggggaccggaacccgtcccccttacgacggtaacgttacggttacgtaccttaggttcgggtaactccggtaactccgtaaggttatacgggtaacgggtaacgggggttccgggtacccctaattccggaacgggttcgacggtcggactacgggtagtcgtaaggttcggtacggggtaataacgttaccgtttaacgtacttcccgttaaccggtaactttacctacgggaccaccggttaacgtcccgtacggcctaaggtccgtaaagtactttacgttttccgaattaacgttttcttaacgtcctaacttaaaacgttcgggtttaacttaacccgttaacccgttcccgggttaaggtacccggggtttaacgggtaccccgggttaaacggggaacccggggttaaaggggtaacccggttaaacgggttaaccccgtaaacgggtaaacccttaaccgggggttacggttaacggtaccccggttagtaaacccccgg

SEQ ID NO: 217329 - DNA, 745 bp, Homo sapiens
  misc_feature: GYAE6OF02IMU3B.1.34.D01.1.454.CMB.1.raw
  modified_base (154)..(154): a, c, t, g, unknown or other
  misc_feature (154)..(154): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
tcagacgagtgcgtcacgaccggtgctcgatttagatcgtctgtgttgggtttgggggagtcagaccctgtcaggacacagcatggacatgagggtccccgctcagcctccgtggggcctcctgctgctctggactccgaggtaccagctggtnacataccaattcgacccagtcctccattcccgtcctgtctgactattcgtagttggacgacgagacgtcaccgatctacgtcggccggcgagttccgacggccatcgagtcgtactttcgttacgccgttgtcgcaagacaacgaaccgngggccgaccgtcccagacggtacgttaccgtagtcgtagtcgggtncgtacgcctaggtgttcgaacggtaggggtccggtacccaagttccgaggtttacgaaggtcgacgtagtcgtactacggttcggacgggtactagtaaccttacgtaacctttcgacgtaaacttacgtcgagtcgtaaccgccttagaccgtaacgtaccgttaggttaaaacttttcgtttttcgaacttttaaagtttttcgttaaaccgtaggtaaacttacggtttaacgtttaactttaacccgttaaaccccgggttaaccctttggggtttaccggttacccgggttacccgggaaacggtaacccgggggttaaacgtaagggtaacccgggttaaactacccggtaaacgttacccggtggtacccggtaccgcgttaaccccg

SEQ ID NO: 217330 - DNA, 736 bp, Homo sapiens
  misc_feature: GYAE6OF02JMV8L.1.34.D01.1.454.CMB.1.raw
  modified_base (295)..(295): a, c, t, g, unknown or other
  misc_feature (295)..(295): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatcctccctgtctgcatctagttggagactagacgtccaacctatcctaacttgggcccgggcggtaagtccgacgggccaagtcgaacggtcgttagtttcctttaacggccgttgggttcncaaccggacaacggtaaacccgaggggaccgtaaccgtcccctagagtacgtaccgtaaggtcctaggtccgggtacgtaccgtaacttcccgaagtacgtttaccgacgggttaaacgggtccgggttacccaagttacccgggtaaggttcgacgggttacggacgtaggtacgcttacggcggtacgtatacgtacttaactcgttctactacgtacacgtacgctacgtcgacgcgtaccggtcgttaagaacgttacgttacgtaagtttacgttaaacgttaccgtagtaaacccttaatacgtttaactacggttaaccgtaccgttaacggtacgttccggggtttaacccggaccgggtaagggtacccggttaaggtaccggtaacgttaacccgaacccggtaggttacggtccggtacgtactacccgg

SEQ ID NO: 217331 - DNA, 704 bp, Homo sapiens
  misc_feature: GYAE6OF02GPPNR.1.34.D01.1.454.CMB.1.raw
  modified_base (495)..(495): a, c, t, g, unknown or other
  misc_feature (495)..(495): n is a, c, g, or t
  modified_base (538)..(538): a, c, t, g, unknown or other
  misc_feature (538)..(538): n is a, c, g, or t
  modified_base (582)..(582): a, c, t, g, unknown or other
  misc_feature (582)..(582): n is a, c, g, or t
  modified_base (613)..(613): a, c, t, g, unknown or other
  misc_feature (613)..(613): n is a, c, g, or t
tcagacgagtgcgtcacgaccggtgctcgatttagatcgtctgtgttgggtttgggggagtcagaccctgtcaggacacagcatggacatgacgggtccccgctcagcctccgtggggctcctgctgctcgtgctcccgaggtaccagtctgtacgactactacctaacttcggaccctagttcctacctaccttccccgttcccgttacggtcctaggccttacgtttaccttaaggttcgggaacgaactaacggttaccgtacccacctactaccgtaccgttccgggaccggggacgtacggtcgaccggcctacgtccgaggtccgttagtttccttacgtccgtttgggtctaccgacggtaccaacggtaaccggacggaccgtacccgccccttaggacgtaccgttacggtaaccttcggtacgtcgggtacacctacgtacgtagtacgttgacggtacggtccggtaccacgtacgtagttcgngtacgtgacgttcgcgtgtcggacgactacgtctacgcgtacncgtactgtacgacgtccacgtcgacgtcgacgtcttagtacgtnttaccgtattagttctacgtactatacgttntagtactaccgtacgtaggtccgtgtaccggtcggacggtacggacgtacgtacgtaccgaacggttcgtacggtcgtaccgtatacccgg

SEQ ID NO: 217332 - DNA, 619 bp, Homo sapiens
  misc_feature: GYAE6OF02GX8N3.1.34.D01.1.454.CMB.1.raw
  modified_base (286)..(286): a, c, t, g, unknown or other
  misc_feature (286)..(286): n is a, c, g, or t
  modified_base (436)..(436): a, c, t, g, unknown or other
  misc_feature (436)..(436): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccatccctccctgtctgcatctattggagacagagtcaccatcacttggccgggcgagtcaggccatcagcgattcttagcctggttgcagcagaaaccagggcgacgcccctnagatcggtagtctagtgggtgcatccaagtacttggacgaaggggtcggggtcccagtccgaggttcaggttcggctaggtcgctacgtcgtgggaactaggtacttacacttctacactactacagcacgctgcaacgcctagaagttntttacgacttaatttacttactgtaactaacgttattaactttacgtaaaccggttaccccttaaggttacgggttaccggttacccgggaccggtaacgggggtaacccgtaagggggttaccgggaaacgtttaccggaaacccggtaacggttagggtcgggttacccgtaggtaccccg

SEQ ID NO: 217333 - DNA, 720 bp, Homo sapiens
  misc_feature: GYAE6OF02JXSWY.1.34.D01.1.454.CMB.1.raw
  modified_base (226)..(226): a, c, t, g, unknown or other
  misc_feature (226)..(226): n is a, c, g, or t
  modified_base (605)..(605): a, c, t, g, unknown or other
  misc_feature (605)..(605): n is a, c, g, or t
  modified_base (686)..(686): a, c, t, g, unknown or other
  misc_feature (686)..(686): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgcctctggcctcccaggtaccagctgtgacatccaattcgacccagtcctccactccctcccgtgtcctgaccattcgtagttaggacgacagactcaccncttcacgttggcccgggcgagtccgacggtaccatccgagccgttattccgttgccgttggttcgacctaggtaccaacggaaaccggtggggaccgaccgtccccgtagaggtaactccggtaagttccgtagttcggtcgacgtacttaccgaagttaccgtgggaccggttaacgggggtaccggtacccctaaacggttcccggttaggttacggtaaccggttgggtaccgttaagggttccgcgttaacggtccggttagggaacctaggttactacctaccgttcttaacacgttcgaacctaggaacccgtacgtccaacggtctaccggttaacgacgttaagtgtttccgtaaactttagtttaccgtntaacgtactacgttacgtattacccgttaaggacccgttggaccggtgttacccgggaggtacgggtaactcggtaacggnttaccgaacgttggtcgtacggtccctagtaacc

SEQ ID NO: 217334 - DNA, 873 bp, Homo sapiens
  misc_feature: GYAE6OF02GNDSX.1.34.D01.1.454.CMB.1.raw
tcagacgagtgcgtcacgaccggtgctcgatttagatcgtctgtgttgggtttgggggagtcagaccctgttcaggacacagcatggacatgagggtcccgctcagctcgtggggctcctgctgctctggctcccgaggtaccagctagtagacatacctaattcgacccagtcctccatccctcctgtctgctatcgtagttaggagacgagacgtaccaaccagtacctacgttcgggaccgggtactacggtccgacggcctaacgtaccggtaacggtcgttaacgtttttaccgttttaacgggccccgtttaggggtttaccgaccggttaaccggaaccgttaaaaccggggaaaacccgggtaccgggggtaccccgtaacccggttaccccccgtaacggtaacgggttaaccgtttaccgggttaaacggttttaccgtaacggtttaacgggtccggtaacctaaccgttaacccggtaaggttaacggtttaaccgggaaccggttaacggggttacccgggttaccctaaccggtttacccggtaggttacggtaacgggtcggggtaacctaggttaccgtaacgtacggttacggggtacgggtaaaccgtagtttaaccctttaacgtacctttaccgtaacctaactaacgtacaaccgggtacctacggtaccgtacgtacgaccgttacgtaggtaactttgttaactaacgtttattaccgtttagacgttaacgaacttagttaacttaccgttaaccggtaccgtggttaccgtaccggtacgacgggtaacggaccgttaagggaaccgtaaccgtacgtaaccggtcggtagtacgtcgtaactaccgg

SEQ ID NO: 217335 - DNA, 594 bp, Homo sapiens
  misc_feature: GYAE6OF02GJEG0.1.34.D01.1.454.CMB.1.raw
  modified_base (113)..(113): a, c, t, g, unknown or other
  misc_feature (113)..(113): n is a, c, g, or t
  modified_base (123)..(123): a, c, t, g, unknown or other
  misc_feature (123)..(123): n is a, c, g, or t
  modified_base (279)..(279): a, c, t, g, unknown or other
  misc_feature (279)..(279): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (427)..(427): a, c, t, g, unknown or other
  misc_feature (427)..(427): n is a, c, g, or t
  modified_base (576)..(576): a, c, t, g, unknown or other
  misc_feature (576)..(576): n is a, c, g, or t
tcagacgagtgcgtcacgaccggtgctcgatttagatcgtctgtgttggggtttgggggagtcagaccctgtcaggacacagcatggacatgagggtccccgctcagcctccnggggttttcncctgctgctctggctcccaggtaccagctgtgacatacctaattcgacccagtctccatccctcctgtctgcattctagtggagacagtagtccaccgtatccacgttgcccgggtgacgtcacggccatcagcgtacttctttagccgttggttncgagacgaacgaaacccgagggccaccgtcccctagagacgttcgtagttctagtcggntcactcgtagtntgacgaggtcggacctaagtcgtagttacaggtgacgagtgctacgtcggagaacagtactacactcgtcactactnacgccagccgtgctagctacgtagttctttacgactttattcttagtctaacgtacttagttagtaccgttacctaccgttacgttgtaaccggttccggaacggtaacgggtaaccggtaggttaggaccgtaaccgtacggttacgnggtccgtcggtactaccg

SEQ ID NO: 217336 - DNA, 577 bp, Homo sapiens
  misc_feature: GYAE6OF02H167U.1.34.D01.1.454.CMB.1.raw
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
  modified_base (360)..(360): a, c, t, g, unknown or other
  misc_feature (360)..(360): n is a, c, g, or t
  modified_base (434)..(434): a, c, t, g, unknown or other
  misc_feature (434)..(434): n is a, c, g, or t
  modified_base (553)..(553): a, c, t, g, unknown or other
  misc_feature (553)..(553): n is a, c, g, or t
  modified_base (562)..(562): a, c, t, g, unknown or other
  misc_feature (562)..(562): n is a, c, g, or t
tcagacgagtgcgtcacgaccggtgctcgatttagatcgtctgtgttgggtttgggggagtcagaccctgtcaggacacagcatggacatgagggtccccgctcagctctgggctcctgctgctctggctcccagtaccaggctgtgacataccaattgacccagtctccactcctccctgtctgcatctagtgagcagagtcacctatcacgttcgccgggacaggtcaggcctagtcagcgtattcttagccgtgttgcagacaagaactgggacncgcccagatctacgtgtactgtcgggtanctatcgatactcgacgtaggtcggtaccacgtccgtaggtccaggtcggtacngtagtacctacggttcgtagggacctagttaacctaaccgtcttacactaacgtactacggactcgcgttaccncgtacgacgtactaagtacgttagttctaacttaattttcgacttagactaattagtacttaacgttaccgtacttaccggtagacgttaccgggacgtacggtaacgaggacgtaacncgtaacgtntagggctagctaccg

SEQ ID NO: 217337 - DNA, 536 bp, Homo sapiens
  misc_feature: GYAE6OF01CMW4H.9.3.A03.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (314)..(314): a, c, t, g, unknown or other
  misc_feature (314)..(314): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaancgccaccctctcctgcagggccagtcagagtgttggcacctagtagcctggaccaanagaactcctggccaggctcccaggcctcctcattatgatgcatccaacgacggcctacgnggccgtccagcccaggttcaggtggcagtgggtctggggacagtacttcactctacacatcagcacgccagacgcctagaagtatttgacttattttatactgtcagcagcgtgcaagtggtcttctctacgtttcgggcggtacgggtaccgaagggtcgagaccgaagacgaacgtggtagggctggcaccgtatctgtacttcgacttccgttaccccg

SEQ ID NO: 217338 - DNA, 507 bp, Homo sapiens
  misc_feature: GYAE6OF01AL58W.9.3.A03.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (290)..(290): a, c, t, g, unknown or other
  misc_feature (290)..(290): n is a, c, g, or t
  modified_base (499)..(499): a, c, t, g, unknown or other
  misc_feature (499)..(499): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaanacgaatcctggccaggctcccaggctcctcatttangatgcatccaacagggccacgtggcgtcccagccaggttcagtgcagtggtctgggacagacttcactctcacatcagcagcctagagcctgaagtatttgctatttatactgtcagcagcgtgcctaagtcggtcttctctacgtttcggacggtagggaccaagggtcggagaccgaggacgaacgtgtggctgcacatctgtctcntcctcccg

SEQ ID NO: 217339 - DNA, 508 bp, Homo sapiens
  misc_feature: GYAE6OF01BOD3R.9.3.A03.1.454.CMB.1.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (494)..(494): a, c, t, g, unknown or other
  misc_feature (494)..(494): n is a, c, g, or t
  modified_base (500)..(500): a, c, t, g, unknown or other
  misc_feature (500)..(500): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttangatgcatccaacngggccactggccgtcccagccaggttcagtggcagtggtctgggacagacttcactctcaccatcagcagcctagacgcctgaagtattttgctattttattactgtcagcagcgtgccaagtggtcttctctacgtttcggcggtagggaccgaaggtggagaccgagacgacgtgtggctgcacatctntcttcntcctcccg

SEQ ID NO: 217340 - DNA, 505 bp, Homo sapiens
  misc_feature: GYAE6OF01D7X50.9.3.A03.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (497)..(497): a, c, t, g, unknown or other
  misc_feature (497)..(497): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagngccaccctctcctgcagggccagtcagagtgttggcacctacgtagcctggtaccaacagaatcctggccaggctcccaggctcctcatttangatgcatccaacagggccactggccgtcccagccaggttcagtggcaggtgggtctgggacagacttcactctcaccatcagcagcctagacgcctgaagtattttgctattttattacttgtcagcagcgtgaccaagtggcttctctacgtttcggcggaggaccaggtggagacagacgacgtgtggctgcacatctgtcttcntcctcccg

SEQ ID NO: 217341 - DNA, 524 bp, Homo sapiens
  misc_feature: GYAE6OF01D0ZL1.9.3.A03.1.454.CMB.1.raw
  modified_base (196)..(196): a, c, t, g, unknown or other
  misc_feature (196)..(196): n is a, c, g, or t
  modified_base (513)..(513): a, c, t, g, unknown or other
  misc_feature (513)..(513): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagcccaccctctcctgcagggccagtcagagtgttggcacctacgtagcctggtaccaacagaatcctggccaggcctcccaggcctcctctatttatgatgcatccaacagggggccactcggcgtcccagccaggttcgagtggcgaggtggtcgtgggacagacttcactctcaccactcagcacgcctagacgcctagaagtattttgactattttattactgtcagtcagcgtgacaagtgtcttctctacgttcggcggagggaccgagggtgacgacgagacgacgtgtggcgtgcacactctgtcttcnctccgttcccg

SEQ ID NO: 217342 - DNA, 658 bp, Homo sapiens
  misc_feature: GYAE6OF01DB030.9.3.A03.1.454.CMB.1.raw
  modified_base (303)..(303): a, c, t, g, unknown or other
  misc_feature (303)..(303): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaagacgcccaccctctcctgcgagggccagtcagagtgttggcacctacgtagcctggtaaccaacagaactccgtggccaggcctcccgaggcctcctctatttacngatgcactaccaacgacgggccacgtcggccgtcccagcctaggttcaggtggctaggtcgggtctaggggacaggtacttcactctacaccatcagcacgacctagacgtccgtagaacgtttatttttagttaatttttatacttagtacagtctacggtcgtacgaccgtaaggttcggtactttctaccgttaccggtttccggggaccgggtaacggggaacccgtaagggggtacggaaccggtaacccgaagggtaaaccgtaacggttcgggtcgggtacctaccggtacccaaccgtacgttccgttcggttaccttacccgtactttccccgttccccgtacccg

SEQ ID NO: 217343 - DNA, 512 bp, Homo sapiens
  misc_feature: GYAE6OF01D06JO.9.3.A03.1.454.CMB.1.raw
  modified_base (196)..(196): a, c, t, g, unknown or other
  misc_feature (196)..(196): n is a, c, g, or t
  modified_base (502)..(502): a, c, t, g, unknown or other
  misc_feature (502)..(502): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggctcccaggctcctcatttatgatgcatccaacagggccacgtggcctcccagccaggttcagtggcaggtggtctgggacagacttcactctcacatcagcagcctagagcctagaagtattttgctattttattactgtcagcagcgtgccaagtgcttctctacgtttcggcggagggaccagggtggacgaccgagacgaacgtggtggctcgacacatctagtcttcnttccgtcccg

SEQ ID NO: 217344 - DNA, 568 bp, Homo sapiens
  misc_feature: GYAE6OF01BH69I.9.3.A03.1.454.CMB.1.raw
  modified_base (195)..(195): a, c, t, g, unknown or other
  misc_feature (195)..(195): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccaggggaaangccaccctctcctgcagggccagtcagagtgttggcacctacgtagcctggtaccaacagaatcctggccaggcctcccaggctcctcatttangatgcatccaacngggccacgtggccgtcccagccaggttcagtggcaggtggtctgggacagacttcactctcaccatcagcagcctagacgcctagaagtattttgctattttactactgtacagtcagtcgtgacctaaggtcgtcctttctccgtacgttttcgggaccgggtagggacccgtaagggtcggaacgaccgaaggaacggtaacgtggtagggcttggaccaccgtacgttcgttacgttacctttcgtacgttcccgttccccgg

SEQ ID NO: 217345 - DNA, 934 bp, Homo sapiens
  misc_feature: GYAE6OF01AV342.9.3.A03.1.454.CMB.1.raw
  modified_base (176)..(176): a, c, t, g, unknown or other
  misc_feature (176)..(176): n is a, c, g, or t
tcagtgatacgtctcacgaccggtgctcgatttagagagcgtcactaggggggtagggaacgtgctcagttagggacccacgtagggaacccagtggaacgaccccgacgtcctactaggcttctccttcctcctgctactctggctcccgagtcgaccaccggaggaaattggtnttgacactaggttcctccgtagtccttaacccgtggttcctttcgtcgttccgagggggaaagcgccacccgtctccgtggctagggccgaggtctaggacgtggttcggcggtaccctaggtagccgttcggtaccaacgtagaactccctggccgaaggtcctacccgttaagggtcccttaccgttcgaatttttacgacggtacttcggggacccctacgttacccggaaaaccgtaccgggggacccggtaaacgggttccggggtcccggttaccccggaagggccccggtaacgggtttaaccaaagggtttaacggggaccgtaaaggggtttcggggggttaaccgttacggggggaaaaccctaaaaagggttccgttttaccgtaccggttaaccctttccgaaacccgtaaggttacccggaacgtaccgtaaccggtacccgttaacggtaccggttacccgtaagggtaaacggttaacgtttttaaccgggtaacctttaaaacggtttttaaaccttttaaccgtttaacgtttaacgtaacggtaccgtaacggtaaccggttacgtaaccgtaacggttcggttaccgttacgtacgtaccggtttaccgggacgggtaacgggtaccgtagggtacggtaacgtaccgtaggtaaccggtacggtacgggtaggacggttcggaccgaacggtacgttacggtacggttaccttaccgttccgttttccccggtaaccg

SEQ ID NO: 217346 - DNA, 554 bp, Homo sapiens
  misc_feature: GYAE6OF01D6PMR.9.3.A03.1.454.CMB.1.raw
  modified_base (195)..(195): a, c, t, g, unknown or other
  misc_feature (195)..(195): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaangccaccctctcctgcagggccagtcagagtgttggcacctacgtagcctggtaccaacagaatcctggccaggcctcccaggctcctcatttatgatgcatccaacagggccactggcgtccagccaggttcagtgcaggtggtctgggacagacttcactctcaccatcagaagccctagacgcctaggaagtattttgactattttattactgttactagtcagcgtgccaagttcggcttctcgtacgtttcgggcggtacgggtacccaagggttcggaacgaccgaaggaacggtaacgtggtcggtactaggccaccgtatccgtgtaccttctacttccgttccccgtaccc

SEQ ID NO: 217347 - DNA, 554 bp, Homo sapiens
  misc_feature: GYAE6OF01BPLPA.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggcctcccaggcctcctcatttatgatgcatcccaacgacgggcccacgtcggccgtcccagcccaggttcagtggcaggtgggtcgtggggacagacttcactctcaccatcagcagcctagacgcctagaagtattttgacttattttattactgtcagtcagcgtgcctaagtcggtcttctctacgtttcgggacgggtacgggaccgtagggtggacggaaccgacggacgtaacgtggtaggcgtcgccacctatctacgtccttctcgttccttccccg

SEQ ID NO: 217348 - DNA, 537 bp, Homo sapiens
  misc_feature: GYAE6OF01DG4YB.9.3.A03.1.454.CMB.1.raw
  modified_base (196)..(196): a, c, t, g, unknown or other
  misc_feature (196)..(196): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (525)..(525): a, c, t, g, unknown or other
  misc_feature (525)..(525): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaacagaatcctggccaggctcccaggctcctcatttangatgcatccaanagggccactggctcccagccaggttcagtggcagtggtctgggacagtacttcactctcacatcagcagcctagacgctgaagtattttagctaattttattacttgtctagtctagcgtcgctaagtggtcttcgtctacgtttcgggcggtacgggaccgaagggtcggacgtaccgagaacgaacgtggtaggcgtggacaccacgttctcgttccttctntccgttaccccg

SEQ ID NO: 217349 - DNA, 535 bp, Homo sapiens
  misc_feature: GYAE6OF01CB3DY.9.3.A03.1.454.CMB.1.raw
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
  modified_base (360)..(360): a, c, t, g, unknown or other
  misc_feature (360)..(360): n is a, c, g, or t
  modified_base (442)..(442): a, c, t, g, unknown or other
  misc_feature (442)..(442): n is a, c, g, or t
  modified_base (503)..(503): a, c, t, g, unknown or other
  misc_feature (503)..(503): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccacgtgaccaccggagaaattagtgttgacacagtctccacgccaccctcgtccttcgtctccaggggaaagagccaccctctcctgcgacgggccagtcagagtgttggtacctacgtagcctggtaccaacagaatcctggccacggctccccaggctccctntatttatgatgcatccaaacgngggccactgggcctcccagcaggttcaggtggcaggtggggtcnggggacagtacttcactctcacatcagcaagcctaagagcctagaagtatttgcttaattttattactgtctagcagtcgtntacgagtggtcttctcgtacgttcgggtcggacggacaggtggacgacagacgagtgtggntcgcaccagtcgtcttcttcacttcgtcccgc

SEQ ID NO: 217350 - DNA, 576 bp, Homo sapiens
  misc_feature: GYAE6OF01B3WIM.9.3.A03.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaanagccacctctcctgcagggccagtcagagtgttggcacctacgtagcctggtaccaacagaatcctggccaggcctcccgaggctcctcatttangatgcatccaacgacgggcccacgtggccgtcccagcccagggttcaggtggcaggtgggtctgggacagacttcactctcaccatcagcagcctagagcctagaagtatttgctattttattacttgtactagtcagtcgtcgacctaaggtcgtcttctcgtaccgtttcgggacgggtagggaccgtaagggtaggacggaaccgaaggaacggaacgttggtcggtacgttcggaccgtaaccgacgttcgttcgttacctttctacgttccgttaccccg

SEQ ID NO: 217351 - DNA, 832 bp, Homo sapiens
  misc_feature: GYAE6OF01BQL98.9.3.A03.1.454.CMB.1.raw
  modified_base (326)..(326): a, c, t, g, unknown or other
  misc_feature (326)..(326): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccacctgtccttgtctaccgaggggaaagacgcccaccctctcctgcgaggccagtcagagtgttggccaccgtacgtacgccgtacggtaaccaacgagtaacttcccgtaggacccagggtccctacccgaggtcccttcctactaattttacgngattcgactactacccgaaacgtacgggcccacgtcggcctacccgagcccgtaggttcaggtcggacgtaggtcgggtctaggggactacggtaccttccaacgttcctaccaactacgttaccgaacggacctaacggtacccgtaaggaccgtaccgttaaggtaacgtttacgtttttacgaacgttttaatttttaacgtttaacgttcgttaacgtacgtaccgtacggtccggtacgtaaccggtaacggttcggttacctttaccgttacccggttacccgggttttacccggggaaccggggtaaaccggggttaacccgggtaaagggggttacccgggaaaccgggtaaccccggtaaacgggtaaaccggtaaaccggtttcgggtacccggggtacccgttaccgggaacccgttaacccgttaacccggtttaccgtttaccggttttacccctttacccgtttacccgtttccccccgtttaacccccggg

SEQ ID NO: 217352 - DNA, 541 bp, Homo sapiens
  misc_feature: GYAE6OF01CBNL4.9.3.A03.1.454.CMB.1.raw
  modified_base (290)..(290): a, c, t, g, unknown or other
  misc_feature (290)..(290): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttangatgcatccaacagggccacgtggcgtcccagcccaggttcagtggcagtgggtctgggacagcttcactctcaccatcagcagcctagagcctagaagtatttgctattttatactgtcagcagcgtgcctaagtcggctttctctacgtttcgggacgggtacgggacctaagggtggacgaccgagaaccgaacgtggtaggctggaccaccgacgttctacggttccttctacttcccgttaccccg

SEQ ID NO: 217353 - DNA, 569 bp, Homo sapiens
  misc_feature: GYAE6OF01B03WN.9.3.A03.1.454.CMB.1.raw
  modified_base (290)..(290): a, c, t, g, unknown or other
  misc_feature (290)..(290): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttangatgcatccaacgagggcccacgtggccgtcccagccaggttcagtggcaggtggtctgggacagacttcactctcacatcagcagcctagacgcctagaagtattttgctaattttattactgtcagcagtcgtgacctaagtcggtctttcgtcgtacgtttccgggacggtacgggaccgtaagggtcggacgtaaccgagaaccggtaacgtcggtagggtactcggacctaaccgtacgttccgtgttacccttctaccttcccgttaccccgg

SEQ ID NO: 217354 - DNA, 608 bp, Homo sapiens
  misc_feature: GYAE6OF01D9N9S.9.3.A03.1.454.CMB.1.raw
  modified_base (298)..(298): a, c, t, g, unknown or other
  misc_feature (298)..(298): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaagagcccaccctctcctgcagggccagtcagagtgttggcacctacgtagcctggtaccaacagaactccgtggccaggcctcccgaggcctcctctatttangatgcatccaacgcgggccacgtggccgtcccagccagggttcaggtggcaggtgggtcgtggggacccagtaccttcgacctctcaccatcgagcacgcctagacgccgtagtaagtattttgacttattttattacttgttacagtcgtacgtcgtcgtaccgtaaggtcggtctttctcgtaccggttttcgggacgggtacgggaaccggtagggtacggaacggaaccgacggaacgtaacggttggtagggcgtcggacctaccgtacgttccgttcgttaccttactcgttcccgttaccccg

SEQ ID NO: 217355 - DNA, 599 bp, Homo sapiens
  misc_feature: GYAE6OF01A1PIJ.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggcctcccaggctcctcatttatgatgcatccaacgacgggccacgtcggccgtcccagccaggttcagtggcgtaggtggtctgggacaggtacttctactttcacctatcagcagcctagacgcctaggaagtattttgacttattttatactgtcagtctagcgtgctagtggtcttctcgtacgtttcgggcgggtacggtaccgaagggtacggaacggtaccgaaggtaccggtaaacggttcgggtcgggtacctacgggtaccaaccccgtagttcccgttacgttccctttacctaccgtttccccgttaccccggtacccg

SEQ ID NO: 217356 - DNA, 592 bp, Homo sapiens
  misc_feature: GYAE6OF01DNXRX.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtcccagggaaaggagccaccctcctcctcgcagggccgacgtcagagtgttggtcacctaccgtagcctcggtaccgaacagaatacctcggccgacgctcccacggctcctcacttatgatgcactccaacacggccgactggccgtcccacgccgacggttcgagtggcagtgggtcgtggacgagacgttcactctccaccactcacgcacgcctagagccctgtaacgtattttgactagtttttaacttacgtcgtcagtcgagtcgtagtccgaacgtggtcttaccttcaacccgttttcggggcgggacgggtacccaaggggttggacgaaccctaggacgtaacgttgtggtccgtgtaccgaccctattcttcgtacttcctactcctttccccgaacc

SEQ ID NO: 217357 - DNA, 648 bp, Homo sapiens
  misc_feature: GYAE6OF01CCJR0.9.3.A03.1.454.CMB.1.raw
  modified_base (620)..(620): a, c, t, g, unknown or other
  misc_feature (620)..(620): n is a, c, g, or t
tcagtgatacgtctcacgaccggtgctcgatttagagagcgtcacagggggaggaactgctcagttaggacccagagggaaccatggaagccccagctcagcttctcttcctcctgctactctggcctcccagtgaccaccggagaaattgtgttgacacagtctccagccaccctgtccttgtctccgaggggaaagacgcccaccctctcctgcgacgggccagtcagagtgttggacacctacgtagccgtggtaccaacagaacttcccgtaggcccagggtccctcccgaggtccttcctctattttatgatcgctactacccaacgacggggcccacgtcgggccgtccccagcccgtaaggtttccaggttcggctaggttcgggtctggggacaggtacttcactcctacacccatccgagtccacgtaccctaaggacgtacctaggaacgttagttttagactttaattttaactttacgttacgttacgtaggctacggtcgttacgacccgtaaggtcggttcctttaccttaccgttaccggtttcgggacgggtacggaccgtagggtcggaacgaccgagaacggtacgtggtgcgtcgccaccncgttctacgttcttcacttccgtacccg

SEQ ID NO: 217358 - DNA, 561 bp, Homo sapiens
  misc_feature: GYAE6OF01AR2EX.9.3.A03.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaacagaactcctggccaggcctcccaggctcctcatttangatgcatccaacngggccacgtggcgtcccagccagggttcaggtggctaggtggtctggggacaggacttcgactctcaccatcgagcagcctagacgcctagaagtatttagcttattttatacttgtacagcaggtcgtgactaagtcggtcttccgtcgtaccgtttcgggacggtacgggaccgtaagggtcggacgaccgaggaaccgtaacgtggtcggctcgaccgacctattccgtgttccttctacgttccgttaccccg

SEQ ID NO: 217359 - DNA, 628 bp, Homo sapiens
  misc_feature: GYAE6OF01BARVY.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggcctcccagtgaccaccggagaaattgtgttgacacagtctccagccaccctgtccttgtctccgagggaaagagcccaccctctcctgcgagggccagtcagagtgttggcaccgtacgtacgcctggtaaccaacagaactccgtggccaggcctcccgaggcctcctactatttagtgatcgcactacccaacgacggggccctacgtcggccgtcccagccgtagggttcaggtggctaggtgggtcgtgggacaggtacttcactctcacatcagcacgccgtagacgcctagaagtatttgacttagttttacttacgttgtacagctaggcgtcgaccgtaaggttcggtcctttcgtaccgtaccggtttccgggacgggtaacgggaccggtaagggtcgggaacgaccggaggaaccgtaaacggtcggtacggcgtcggaccgtaaccgtacgttccgttacgttcctttacctcgtttcccgttacccccgg

SEQ ID NO: 217360 - DNA, 571 bp, Homo sapiens
  misc_feature: GYAE6OF01BHTYU.9.3.A03.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (410)..(410): a, c, t, g, unknown or other
  misc_feature (410)..(410): n is a, c, g, or t
  modified_base (454)..(454): a, c, t, g, unknown or other
  misc_feature (454)..(454): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagtcaccctgtccttgtctccaggggaaangccaccctctcctgcagggccagtcagagtgttggcacctagtagcctggtaccaanagaatccgtggccaggcctcccgaggcctcctcatttangatgcatcccaacagggcccacgtggcctcccagccaggttcaggtggctaggtcgggtctggggacaggtactttcgactctcgacctagtcagcacgccctagacgcctagaagtntttgcttattttatactgtacagcagcgtgcctagtcgtcttcncgtacgtttccgggacggtacgggacagggtcggacgaccgtagaaccgaacgtcggtaggctcggaccctaaccgacgttccgttacgttaccttcgtaccgttcccgtaccccgg

SEQ ID NO: 217361 - DNA, 513 bp, Homo sapiens
  misc_feature: GYAE6OF01BJ0SG.9.3.A03.1.454.CMB.1.raw
  modified_base (291)..(291): a, c, t, g, unknown or other
  misc_feature (291)..(291): n is a, c, g, or t
  modified_base (502)..(502): a, c, t, g, unknown or other
  misc_feature (502)..(502): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggcctcctcatttangatgcatccaacagggccactcggcgtcccagccaggttcagtggcaggtggtctgggacagacttcactctcaccatcagctagcctagagcctgaagtatttgctattttattactgtcagcagtcgtgccaagtggcttctctacgtttcggcggtaggaccgaaggtggagaccgagacgaacgtgtggctgcacatctgttcttcncttccgtcccg

SEQ ID NO: 217362 - DNA, 618 bp, Homo sapiens
  misc_feature: GYAE6OF01DPXJ8.9.3.A03.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccgaaggggaaanagcccaccctctcctgcagggccagtcagagtgtggcacctacgtagcctggtaccaanagaactcctggccaggctcccgaggcctcctctatttatgtatgcactccaacgacgggcccacgtcggccgtcccagccgaggttccaggtcggcgagggttgggtcgtaggggacaggtactttcactctacacctatcgagcacgcctagacgccgtagtaagttattttagtacttattttattacgtgtacagtcgagtcgtacgactaagtcgtcttcgtcgttacgtttcgggacgggtacgggaaccgtagggtacggaacgtaccgaaggtaaccggtaacgtcgggtaggcgtcgaccctaaccgtacgttccgttacgttacctttcctaccgtttccccgttaccccg

SEQ ID NO: 217363 - DNA, 516 bp, Homo sapiens
  misc_feature: GYAE6OF01DI04T.9.3.A03.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (304)..(304): a, c, t, g, unknown or other
  misc_feature (304)..(304): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaaattgtgttgacacagtctccagccaccctgtccttgtctccaggggaaanagccaccctctcctgcagggccagtcagagtgttggcacctacgtagcctggtaccaacngaatcctggccaggctcccaggctcctcatttatgatgcatccaacngggccactggcgtcccagccaggttcagtggcaggtggtctgggacaggacttcactctcaccatcagcagcctagagcctgaagtatttgctattttatactgtcagcagcgtgccaagtgcttctctacgtttcgggcgggaggacctagggtggaacgacaggacgaacgtggtaggctgcacacttctcgttcttcattcctaccccg

SEQ ID NO: 217364 - DNA, 558 bp, Homo sapiens
  misc_feature: GYAE6OF01E0SE3.9.3.A03.1.454.CMB.1.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
  modified_base (362)..(362): a, c, t, g, unknown or other
  misc_feature (362)..(362): n is a, c, g, or t
  modified_base (412)..(412): a, c, t, g, unknown or other
  misc_feature (412)..(412): n is a, c, g, or t
  modified_base (545)..(545): a, c, t, g, unknown or other
  misc_feature (545)..(545): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagagtgttggcacctacgtagcctggtaccaacgagaactcctggccaggcctcccgaggcctcctntatttatgatcgcactccaacgacgggccacgtcggccgtcccagcctaggttcaggtggcgaggtcggtcgngggacagtacttcactctacacatcagcacgactagacgtctagaagttntttgacttattttattacgtgtacagcagtcgtacgacgtagtcgtcttcgtacgtacgttcggacgggacggtacagggtcgacgacgagacgtacgtggtaggctcgaccactacgttcgtcttccttacnctcccgttacccg

SEQ ID NO: 217365 - DNA, 537 bp, Homo sapiens
  misc_feature: GYAE6OF01A0VMK.9.3.A03.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (293)..(293): a, c, t, g, unknown or other
  misc_feature (293)..(293): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaancgccaccctctcctgcagggccagtcagagtgttggcacctagtagcctggaccaanagaatccgtggccaggcctcccgaggcctcctcatttangatgcatccaacgaggcccacgtggctcccagccaggttcagtggcaggtggtctgggacagacttcgactctcaccatccagcagccctagacgcctagaagtattttgacttagttttattacgtgtacagcagcgtgacaagtggtcttctcgtacgtttcggcggtacgggaccagggtggacgacgacgacgaacgtggtggctgccacctatctcgttaccttcagtcccgttccccg

SEQ ID NO: 217366 - DNA, 558 bp, Homo sapiens
  misc_feature: GYAE6OF01D0Z4S.9.3.A03.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
  modified_base (386)..(386): a, c, t, g, unknown or other
  misc_feature (386)..(386): n is a, c, g, or t
  modified_base (544)..(544): a, c, t, g, unknown or other
  misc_feature (544)..(544): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttgcacctagtagcctggtaccaanagaatcctggccaggctccaggctcctnatttangatgcatccaacgngggccacgtcggccgtacccagcccaggttccaggtggcaggtggtctgggacagtacttcactctacacctatcagcagcctagngcctagaagtattttgcttattttacttacttgtctagctagcgtcgactaggtcgtccttctccgtacgtttcgggacggacgggtaccgtaagggtcggacgacgaaggacgaacgtggtaggctggacctaccgagttccgttagttacctttcncttcccgttccccg

SEQ ID NO: 217367 - DNA, 546 bp, Homo sapiens
  misc_feature: GYAE6OF01A8ZIK.9.3.A03.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagccaccctctcctgcagggccagtcagagtgttggcacctacgtagcctggtaccaacagaactcctggccaggcctcccgaggcctcctctatttangatgcactccaaacgcgggccagtcggccgtcccagccaggttcaggtgcaggtggtctgggacagtacttcgactctacaccatcagcacgcctagcgctagaagtatttgacttattttactactgtacagctagtcgtcgactaagtcgtcttctcgtacgttcgggacggacggtaccagggtcggacgacgaggacgacgtggtgctcgacactacgttcgtcgttacttctacgttcctacccg

SEQ ID NO: 217368 - DNA, 517 bp, Homo sapiens
  misc_feature: GYAE6OF01DC5L5.9.3.A03.1.454.CMB.1.raw
  modified_base (195)..(195): a, c, t, g, unknown or other
  misc_feature (195)..(195): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (504)..(504): a, c, t, g, unknown or other
  misc_feature (504)..(504): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctccagtgaccaccggagaaattgtgttgacacagtctccagccaccctgtccttgtctccaggggaaanagcccaccctctcctgcagggccagtcagagtgttgcacctacgtagccctggtaccaacagaatcctggccaggctcccaggctcctcatttangatgcatccaacnggccactggcgtccagccaggttcagtgcagtggtctgggacagacttcactctacacatcagcagcctagagcctagaagtatttgctattttatactgtcagcagtcgtgactaagtcgcttctctacgtttcggcggacgggaccgagggtcggacgaccgagacgaacgtggtaggctgaccacatctacgtcttcncttccgttccccg

SEQ ID NO: 217369 - DNA, 553 bp, Homo sapiens
  misc_feature: GYAE6OF01CKMOI.9.3.A03.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (542)..(542): a, c, t, g, unknown or other
  misc_feature (542)..(542): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcgagggccagtcagagtgttggcacctacgtagcctggtaccaanagaatccgtggccaggcctcccgaggtcctcctctatttactgatgcataccaacgacgggccacgtcggccgtcccagccgtaggttcaggtcggcaggtcgggtctaggggacaggtaccttcactcgtaccaccatcagcagcctagcgtccgtagaagtatttgacttattttatactgtcgagtcgagtcgtgactagtcgtcttctcgtacgtttcggcggtacggacgaggtgacgaccgagacgtaagtgtcggcgtcgccacgtagtcttcgtcttcncgttcgtcccg

SEQ ID NO: 217370 - DNA, 680 bp, Homo sapiens
  misc_feature: GYAE6OF01B5MWV.9.3.A03.1.454.CMB.1.raw
  modified_base (199)..(199): a, c, t, g, unknown or other
  misc_feature (199)..(199): n is a, c, g, or t
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
  modified_base (478)..(478): a, c, t, g, unknown or other
  misc_feature (478)..(478): n is a, c, g, or t
tcagtgatacgtctcacgaccggtgctcgatttagagagcgtcacagggggaggaactgctcagttaggacccagagggaaccatggaagccccagctcagcttctcttcctcctgctactctggcctcccagtgaccaccggagaaattgtgttgacacagtctccagcccaccctgtccttgtctccgaggggaaancgccaccctctcctgcgagggccagtcagagtgttggcacctacgtagcctggtaaccaanagaactcccgtggcccaggcctacccgaggcctcctctattttngatcgactactaccaaacgacgggcccaacgttcggggccctaccccgaagtcccgtaagggtttccaagggttcggaccgtagggttcggggttctagggggaactaggtacctttcaaccttctaccacctagtccgaagcctaacggcctaggcgtaccgtagtaacgttnttttacgactttaagtttttattacttagtacgtacgtactaggtcgtcgaccgtaagggttcggtcctttccgtccgttaacggtttccgggacgggtaacgggtaaccggtaagggtacggaacgaaccgacggtaacgaacgtcggtacggacttcgaccgaacctcgtcgttcttacctttcgactttcccgtacccg

SEQ ID NO: 217371 - DNA, 529 bp, Homo sapiens
  misc_feature: GYAE6OF01A48NI.9.3.A03.1.454.CMB.1.raw
  modified_base (197)..(197): a, c, t, g, unknown or other
  misc_feature (197)..(197): n is a, c, g, or t
  modified_base (369)..(369): a, c, t, g, unknown or other
  misc_feature (369)..(369): n is a, c, g, or t
  modified_base (518)..(518): a, c, t, g, unknown or other
  misc_feature (518)..(518): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagngccaccctctcctgcagggccagtcagagtgttggcacctacgtagcctggtaccaacagaactcctggccaggcctcccaggcctcctcatttatgatgcatccaacgacgggccacgtggccgtcccagccaggttcaggtggcagtgggtctgggacagacttcactcncacatcagcagcctagcgcctgaagtatttgacttattttattactgtctagcagtcgtgacctagtcggtcttctcgtacgtttcgggacggtacggacgaggtcggacgacgagacgaacgtggtaggctgcacagttctgtcttcncgttcctcccg

SEQ ID NO: 217372 - DNA, 522 bp, Homo sapiens
  misc_feature: GYAE6OF01AYNZ1.9.3.A03.1.454.CMB.1.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (511)..(511): a, c, t, g, unknown or other
  misc_feature (511)..(511): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccaggggaaangccaccctctcctgcagggccagtcagagtgttggcacctacgtagcctggtaccaacagaactcctggccaggcctcccaggctcctcatttangatgcatccaacngggccactggcgtccagccaggttcagtggcaggtggtctgggacagacttcactctcaccatcagcagcctagacgcctgaagtatttgacttattttattactgtcagcagcgtgccaagtgtcttctcgtcgtttcggcggtacgggaccagggtgacgaccgaggacgaacgtggtaggctcgccaccatctcgttcttctnttccgtccccg

SEQ ID NO: 217373 - DNA, 694 bp, Homo sapiens
  misc_feature: GYAE6OF01DLCB7.9.3.A03.1.454.CMB.1.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaattgtgttgacacagtctccagcccacctgtccttgtcctccgaaggggaancgcccaccctctcctgcgagggccagtcagagtgttggctaccgtacgtacgcctaggtaaccaagagaactccgtggaccaggcctcccgaggtcctcctactatttnagtatcgcactaccgaacgcggccacgtcggaccgtcccagccgtaggttcgaggttcggacgtagggttcggtcgtacgggactacgtaccttcgacttctaccacctactcgaacggtcctacggtacccgtaaggaccgtccgttaaggttaaagtttcgtttttacgtacttttaagtttttaacttaaccgtgtacctaaggtccgtaacggtccgttacgacccggtaaggttccggttcctttacgttaccggttaccgggtttaccgggacggggtaacggtaaccggtaagggtcggaaccgtaccggaacggtaacgtacggtgtcggtacctggaccctaaccgtgtccttacgttccgttctcgttcccgtacccg

SEQ ID NO: 217374 - DNA, 552 bp, Homo sapiens
  misc_feature: GYAE6OF01EV98W.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggctcccaggctcctcatttatgatgcatccaacagggccactggcgtcccagccaggttcagtggcagtggtctgggacagacttcactctcaccatcagcagcctagagcctgaagtatttgctattttatactgtcagtcagcgtgccaagtcgcttctctacgtttcggacggtacgggaccgaagggtggaacgacccgaaggaaccgtaacgtcggtagggccgtgggaccctaccgacttaccgttcgttacctttcctacgttcccttacccccgg

SEQ ID NO: 217375 - DNA, 609 bp, Homo sapiens
  misc_feature: GYAE6OF01CRXF6.9.3.A03.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaangccaccctctcctgcaggccaggtcaggagtgtggcactacgagcctggtaccaacgagaactcctggccacggcctcccgggctcctctattttancgatgacctatccaacgacgggccacgtcgggccgtcccagcctaggttccgagtggctaggtgggtcgtggggacaggtaccttcgacttccacactatcagcagtccagtacgctagaagtctttagcttaattttacttacgtgttacagtcacgtcgtcgaccctaaggttcgtacctttctacgtaccgtttacggggcggtaacgggtacctaagggtcggaaccgaccggaaggaacccggttaaggtggttaccgggttagaccctacgtacttcgttacgtcttactacgttccttcccgtctacgg

SEQ ID NO: 217376 - DNA, 564 bp, Homo sapiens
  misc_feature: GYAE6OF01CCJKT.9.3.A03.1.454.CMB.1.raw
  modified_base (197)..(197): a, c, t, g, unknown or other
  misc_feature (197)..(197): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagcccaccctctcctgcagggccagtcagagtgttggcacctacgtagcctggtaccaacagaactcctggccaggcctccccgaggcctcctctatttatgatgcactccaacgacgggccacgtcggcctcccagcccgtaggttcaggtcggctaggtgggtctagggacagtacttcacttcacacatcagcacgcctagacgtcctagtaagttatttacgacttattttacttacttgtcagcgtagtcgtcgacgtagtcgtcttctcgtacgtttcggacgggtacggacgagggtcggacgacgagacgtacgtggtagcgtcgaccactacgtcttcgtcttctcgttccgttcccg

SEQ ID NO: 217377 - DNA, 796 bp, Homo sapiens
  misc_feature: GYAE6OF01BRK8V.9.3.A03.1.454.CMB.1.raw
  modified_base (197)..(197): a, c, t, g, unknown or other
  misc_feature (197)..(197): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagccaccctctcctgcagggccagtcagagtgttggctaccgtacgtacgcctggtaccaacagaactcctggaccaggcctcccgaggcctcctctatttatgatgactactccaaacgtacgggcccaacgttcggcctacccgagtcccgtaaggtttccaaggttcggaccgtaggggttcgggtccgtagggggaacaggttacctttcgaaccttccgtaccaaccctagttaccaacggtacccaacgggtacccttaaggaccgtacccgtaaggtaaacgttagtttttacgacgtttaacttttttaacgttaccgttagtttacgtaacggtaccgtaacggtccgttacggaacccgttaagggttacggttccgttttaccgttacccgttaaccgggttttaccggggtaaccgggtaacgggggtaacccgtaaaggggttaccgggaaccggtaaacccggtaaagggtaaacccgggtaaacggttcggggttacgggtaccgttcgggaacccgtaaacccgttaccgttaccgttaccgtttacccgtttaaccgtacgttttccccggtttaaccccgg

SEQ ID NO: 217378 - DNA, 738 bp, Homo sapiens
  misc_feature: GYAE6OF01C5MHF.9.3.A03.1.454.CMB.1.raw
  modified_base (306)..(306): a, c, t, g, unknown or other
  misc_feature (306)..(306): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccgaaggggaaagacgccactcctctcctgcgacgggccagtcagagtgtggcacctacgtacgcctggtaaccaacagaactccgtggccgaggcctccgacggcctcctactatttanggaattcgactaactcccgaaacgacgggcctacgtcggccgtacccgaggccctagggttaccagggtcggctagggtcgggtacgtagggacacggtacttccacgttcctacaccctatccgaagccgtaacgcctagacgtaccgtaggtaaacgttagttttacgactttaagttttaacgttaccgttacggttaccgtaagtaccgtaacgggttaccgtcggaaccggttaacggttccgggtaccctttacccgttaccggtttaccggttttaccgggggaaccgggttaacgggggtaacccggttaaagggggttacggaaaccgggtaaccggtaaggtaaacccgggtaacgtcgggtacgggtccgtaccggacctaccgtaacgttccgtacgtttcctaccgtacgttcccccgg

SEQ ID NO: 217379 - DNA, 679 bp, Homo sapiens
  misc_feature: GYAE6OF01AN4CK.9.3.A03.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagagtgttggcactacgtagcctggtaccaacagaactcctggccaggctcccaggctcctcatttangatgcatccaacgngggccacgtggcctccagcctaggttcagtggctaggtggtctggggacagtccttcgactctccactatcgagtccagtacccgtagacgtccttaggaagttacgttttcgactttaagtttttaactttaccgttacgttacctacggtacctaacgggtccggttacggaacccggtaaggtttcggtaccgtttaccgttacccgttaacggttttcccgggacggggtaacggggtaacccgttaagggtcgggtaaacgacccggtaaaggtaacccggtaaacggttcgggttacgggccgttacggacccgtaacccgtacgttaccgttacggttacctttaccgtacttccccgtttaccccgg

SEQ ID NO: 217380 - DNA, 572 bp, Homo sapiens
  misc_feature: GYAE6OF01BK1LK.9.3.A03.1.454.CMB.1.raw
  modified_base (198)..(198): a, c, t, g, unknown or other
  misc_feature (198)..(198): n is a, c, g, or t
  modified_base (566)..(566): a, c, t, g, unknown or other
  misc_feature (566)..(566): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaangcccaccctctcctgcagggccagtcagagtgttggcacctacgtagcctggtaaccaacagaactcctggccaggcctcccgaggcctcctctatttatgatgctatcccaacgcgggcccacgtggcctcccagccgaggttcaggtggcagggtcggtcgtaggggacaggtacctttccgaaccttcctaccacctatccgagccaacgccgtagacgtccgtagtaagttattttgacttaattttattacttgtacagtcacgtcgtcgacctaaggtcgtcttcgtcgtacgtttcgggacggtagggaccgagggtcggacgacgagaacgagtggtagcgtgacacactctgtactctnttctcg

SEQ ID NO: 217381 - DNA, 820 bp, Homo sapiens
  misc_feature: GYAE6OF01CZ27P.9.3.A03.1.454.CMB.1.raw
  modified_base (306)..(306): a, c, t, g, unknown or other
  misc_feature (306)..(306): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtcctccgaaggggaaagacgcccaccctctcctgcgagggccagtcagagtgttggcacctacgtagcctggtaaccaacagaactccgtggccacggcctcccgaggtcctcctctatttangtatcgcactaccaacgacgggcccacgtcggcccgtacccgacgtcccgtagggttccagggtcggacgtacgggtcgggtcgtacgggggactacggtacctttcgaaccttcctaccaaccacgtcgaacgtaccacggtaccgtaacggacgtacccgttaggtaaagttacgtttttacggtaccttttaagttttttaacttacgttcgttacgtaacggtacgtaacggttcccggtacggtaccgttaacgggtttcgggtacccgtttttaccgttacccggtttacccgggtttttaccggggaacccggggggttaaacggggtaaacccggggtaaacgggggtaccggggtaaaaccgggaaccccggtaaaaccgggtaaacccgggttaaaccggttcggggttacggggtacccgttccgggaaccccgttaacccgttaccggtttcccgttacgtttaccctttcccgttaacccgtttcccccgtttacccccgg

SEQ ID NO: 217382 - DNA, 662 bp, Homo sapiens
  misc_feature: GYAE6OF01C8JFE.9.3.A03.1.454.CMB.1.raw
  modified_base (198)..(198): a, c, t, g, unknown or other
  misc_feature (198)..(198): n is a, c, g, or t
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccgaggggaaancgccaccctctcctgcagggccagtcagagtgttggctacctagtagccctaggtaccaanagaactcctggccaggcctcccgaggcctcctcatttngatgcatccaacgnggccacgtggctcccagccaggttcagtcggcaggtcgggtctaggggactaggtacctttcgaacctctaccgacctagtccgacgccaaggtaccctaaggaccgtaccgtaggtaaacgttagttttacgtacttaagtttttaacttaccgttaggttactacgctaaggtccgttacgtaccgtaaggttcggttacctttccgttaccgtaaccggtttccgggaacgggtaacgggtaaccgtaaggggttacggaaccggaccgtacggtaaaccggtacggtcgggtacggcttcggaccacgttacgttcgttacgttcctttaccacgtttccgtacccg

SEQ ID NO: 217383 - DNA, 581 bp, Homo sapiens
  misc_feature: GYAE6OF01AL4DV.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaacagaactcctggccaggcctcccaggctcctcatttatgatgcactccaacgacgggcccacgtggccgtccccagcctagggttcaggtggcgaggtgggtctggggacagtactcactctcacatcagcagcctagacgctagtagtatttgtactattttatttacttcgtctacgtcgtagtcgtgtccccccccgtaggtcggtccgttcttcgtacgtttaccggtacgggtacgggaccggtaagggtacgggacggaccgacggtaacggaacgtcggtggcgtcgacgaccactcgttcgttcttctcgtccgtccccg

SEQ ID NO: 217384 - DNA, 590 bp, Homo sapiens
  misc_feature: GYAE6OF01AONV3.9.3.A03.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggcctcccaggctcctcatttatgatgcatccaacncggccactggccgtccagccaggttcagtggcaggtgggtctggggacaggtaccttcgactctccaccatcagccagccctagacgacctagtaagtattttagcttaatttttaattacttgttacagtcaggtccgtgaccgtaaggttcggtcctttccgttccgtaacgttttccggggaccgggtacgggtaacccgtaaggggtcggaacggaccgaacggacgtaaacgtggtagggcgtcgacacctacttccgtgttacttcattccgttaccccg

SEQ ID NO: 217385 - DNA, 765 bp, Homo sapiens
  misc_feature: GYAE6OF01CHVSC.9.3.A03.1.454.CMB.1.raw
  modified_base (303)..(303): a, c, t, g, unknown or other
  misc_feature (303)..(303): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaagagcccaccctctcctgcgagggccagtcagagtgttggcaccgtacgtagcctggtaccaacagaactccgtggaccaggcctcccgaggtcctcctctatttangatcgcatacccaaacgacggggcccaacgttcgggccgttacccgagcccgtagggtttccaagggtcggccgtagggttcggggtaccgttagggggaaccaacggttaaccgttttcccaaccgttccttacccgaaacccctagttaccgaacggcgtaacggcccgttaacggaacggtcccgtaagggtaacgttagtttttacggtaccgtttaattttttaacgttacgtttacgttacgtaacggtaccgtaacgggtacggtacggtacccgtaacgggttcgggtcctttaccgttaccgttaccggttttcggggaaccgggtaacggggtaaccggtaaggggtacgggaacggacccgtaacgggaaccggtaaacggtcggtacgggcggttcggacctaaccgtacttccgttacggttacctttacgtccgttcccgttaccccg

SEQ ID NO: 217386 - DNA, 564 bp, Homo sapiens
  misc_feature: GYAE6OF01BRH7S.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaacagaactcctggccaggcctcccaggctcctcatttatgatgcatccaacagggcccacgtggccgtcccagccaggttcagtggcaggtggtctgggacagtacttcactctcaccatcagcacgcctagagcctagaagtatttgacttattttattactgtacagtctagcgtcgactaagtcgtcttctctacgtttcgggacggtacgggaccgtaagggtcggaacgaccgaggaaccggaacgttggtacggcgtggaccaaccgtacgttcgttcgttacctttctacgttcccgttaccccg

SEQ ID NO: 217387 - DNA, 796 bp, Homo sapiens
  misc_feature: GYAE6OF01CYMEQ.9.3.A03.1.454.CMB.1.raw
  modified_base (413)..(413): a, c, t, g, unknown or other
  misc_feature (413)..(413): n is a, c, g, or t
  modified_base (779)..(779): a, c, t, g, unknown or other
  misc_feature (779)..(779): n is a, c, g, or t
tcagtgatacgtctcacgaccggtgctcgatttagagagcgtcacagggggaggaactgctcagttaggacccagagggaaccatggaagccccagcctcagtcttctccttccctcctgccttactcgtcggtccctacccgagtcgaacccgaccggaagtaaatttggttgttacgaccaacgtacgttccctaccgaaccgccccctacccgttcgttccccgtttgtcccgttaccgggaaagggggaaacaccgacccctaccccttcctccgtcgaccggaacgggccctaagtccaaggtaggttggttacggacctaaccgtacgtacgtccgtacggtaaacccaaagacgtaactccggtcggaccgtacggcctacccggagtccctcctacttatttagngatcgactacctaaccgaacgaccggtcccacggtcggcctacccgagtcccgtagtcagggtgcgtagggtcggtacgacggaacacgttcctacgacctctaccaccgtatccgagtccacgtacctagaccgtacgttaagttaacgtttacgttacgtactttttaactttacgttcgtacgtcgaacgtcgtagtccgtacggaacgttagggttccgtttacctttaccgtaccggttaccgggttacggggaaccggtacgggtaaaccgagggtaaccgaaaccgaaccggtaggtaaccgacggttcggacgggtacctaaccggcctaaccgttgttccgtttaacttcccttacnccccgtttaccctaccg

SEQ ID NO: 217388 - DNA, 587 bp, Homo sapiens
  misc_feature: GYAE6OF01CPN2D.9.3.A03.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaancgccaccctntcctgcagggccagtcagagtgttgcactagtagcctggaccanagaatcctggccaggctcccgaggcctcctcatttangatgactatccaacgcgggccagtggcctcccagccaggttcaggtcgctaggtcggctgggacagtacttcactcacaccatcagtcacgcctagacgctagaagttattttagtacttaattttacttacgttgttactagtcagtcggtcacgtaagttcggtctttctccgtacgtttcgggacggtaacgggtaccgtaagggtacggaacgtaccgaggaacggacgttacggtggtacgttacgtaccctagttccgttgttaccttactaacttcccgttcccgtacccg

SEQ ID NO: 217389 - DNA, 555 bp, Homo sapiens
  misc_feature: GYAE6OF01C5XBA.9.3.A03.1.454.CMB.1.raw
  modified_base (295)..(295): a, c, t, g, unknown or other
  misc_feature (295)..(295): n is a, c, g, or t
  modified_base (378)..(378): a, c, t, g, unknown or other
  misc_feature (378)..(378): n is a, c, g, or t
  modified_base (543)..(543): a, c, t, g, unknown or other
  misc_feature (543)..(543): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaaggggaaagacgccaccctctcctgcagggccagtcagagtgttggcacctacgtagcctggtaccaacagaatccgtggccaggcctcccaggcctcctcatttangatgcataccgaacagggccacgtggcgtcccaagcccaggttccagtggcgagtcgggtctgggaacaggacttcgacttcncaccagtcaagcagcctagacgcctagatatttgtacttattttatacttgtctagcagtcgtgaccgtaagtggtccttcgtctacgtttcgggcggtacggaccgaggtggaacgaccgagacgtacgtcgtggcgtcgacacctacttctacgttccttacncttccgtacccg

SEQ ID NO: 217390 - DNA, 617 bp, Homo sapiens
  misc_feature: GYAE6OF01EFXAX.9.3.A03.1.454.CMB.1.raw
  modified_base (197)..(197): a, c, t, g, unknown or other
  misc_feature (197)..(197): n is a, c, g, or t
  modified_base (402)..(402): a, c, t, g, unknown or other
  misc_feature (402)..(402): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaaccaacagaactcctggaccaggcctcccgaggcctcctctatttatgattgctactacccaaacgacggggcccacgtcgggccgtccccagcccgtaggttcaggtcggcgaggtcgggtcgtggggaacaggtacttcacttctcaccntcacgcacgctagacgcctagaattattttgactttattttattactcgtacgagtcaggtcgtcgaccgtaggttcggctttcctccgttacgtttccgggacgggtacgggtaccggtaagggtcgggacgaaccgtaggaaccggtacgtcgggtacggcgtcggaccgaacctgttccgttcgttacctttcgtccgttcccgttaccccg

SEQ ID NO: 217391 - DNA, 647 bp, Homo sapiens
  misc_feature: GYAE6OF01EYSU2.9.3.A03.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagccaccctctcctgcgaggccagtcagagtgttggcacctacgtacgcctggtaaccaacagaactccgtggccaggcctcccgaggcctcctctatttangatgacactcccaacgacgggccacgtcggccgtcccagcccgtaggttcaggtcggaccgtagggttcgggtcgtaggggaacagtacctttcgaccttcctaccaaccctatccgaacgaccgacggtcccgtaagacgtaccgttagtaacgtttagttttacgactttaatttttatttaaccgtgtacgacgtacgtacgtccggtacgaccgtaggttcgtctttccgtaccgttacgggttacgggacgggtaacgggaccgtaagggtcggaacgaccgagaacgtacgtggtgacgtcgaccacgtacgttcgtagttacctctaccgttccgtacccg

SEQ ID NO: 217392 - DNA, 689 bp, Homo sapiens
  misc_feature: GYAE6OF01CDIPK.9.3.A03.1.454.CMB.1.raw
  modified_base (196)..(196): a, c, t, g, unknown or other
  misc_feature (196)..(196): n is a, c, g, or t
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaancgccaccctctcctgcagggccagtcagagtgttggccaccgtagtagcctggtacccaanagaatcccgtggcccaggcctcccgaggtcctcctnattttangatgcatcccaagacgggcccagtcggcctcccgagcccagggtttccaggttggcctagggtcgggtctggggacaggtacctttcgaccttctaccaaccctatccaaggtccaacggacccgttaagacggtacccgtaggtaagttacgtttttcggactttaatttttactacgtttcggttacgtaagtccgtaacggccggtttacgacccgtaagggttcgtccctttacgttaccgttaccgttttccgggaccggtaacggggtaaccgtagggttacgggaacgtaacccgtaaggaaccggtaagtcgggtacgtccggttcgacccgtaacctacgttcttacggttaccttccgttaccgtcccgtttacccccg

SEQ ID NO: 217393 - DNA, 916 bp, Homo sapiens
  misc_feature: GYAE6OF01CTSMJ.9.3.A03.1.454.CMB.1.raw
  modified_base (267)..(267): a, c, t, g, unknown or other
  misc_feature (267)..(267): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccacgccaccctgtcccttgtctccgaaggggaaagacgcccaccctctcctgcgacggccagtcagagtgttggccaccgtacgtacgccttggaacccaanacgaatcccgtggaccacggccctacccgaggtccctcccgttactaacttttacgtcgtaagttcgacctaacgttacccccgaaacggaccgggggacccctaaccggttccggggtacccgttcccccgaaaggtcccccgtaaagggttttcccgaagggttaccgggacggttaacggggttcggggttaccgttacggggggtaacctaaccgggttaaccctttttacccggaaaccccgtttccgttaaccccctaaacccgtaacgttaccccggaaaggtaccccaaaccgggtaccccgttaagggtaacccggtacccgttaagggttaaacggtttaacgttttttacggtaacctttttaagtttttttaaaccgtttaccgtttacgttaccgtaacggtaccgtacggtcccggtttacggtaaccgtaacgggtttccggttacctttccgttaccgttaccgggtttaccggggaaccgggggtaaccgggtaaccggtaacggggtacgggtaaaccggtaaaccgtaacgggtaacccggtaaacgttcggggtaacggtccgttaccggaccctaacccgtacgttccgttacgtttacccttccgtacgtttcccccgttacccccg

SEQ ID NO: 217394 - DNA, 771 bp, Homo sapiens
  misc_feature: GYAE6OF01A47H6.9.3.A03.1.454.CMB.1.raw
  modified_base (125)..(125): a, c, t, g, unknown or other
  misc_feature (125)..(125): n is a, c, g, or t
  modified_base (129)..(129): a, c, t, g, unknown or other
  misc_feature (129)..(129): n is a, c, g, or t
  modified_base (132)..(132): a, c, t, g, unknown or other
  misc_feature (132)..(132): n is a, c, g, or t
tcagtgatacgtctcacgaccggtgctcgatttagagagcgtcacagggggaggaactgctcagttaggacccagagggaaccatggaagccccagctcagcttctcttcctcctgctactccgngccnccngcaccgacggaatagttgtgtacgacagtacgtcctacgacgaccctaccgttcgttccgttcgtaccctacggggaaagggaaacgcccgacccctacccttccgttccgcggaccgggaccggaccgtacgtacgaaggtaggttcgggtaccgaccctaaccggttaacggtccgtccggttaccggtaaaccaaacgtaacgtaccgttccggtcggaccggacggtcccctaccggacggtcccttccgtactttaagtttacgacgtacgtcgactaccgtaacccgaacgggccggaccctacggtccggtaccccgtaccgaccgtacggttacggtacgagggtcgaacggtggggtcggtacggacgggaactaccgttacctacgtaccttccaacccgtaacctagtaccggacgtacctaccggtaccgtaacgaccgttacgtaaagtacgttttacgttacgtaactttttaactttaactacggttacgtacgtacgacgtacgtcgtacgacgttaggtctacttcgtacgtacggttcgggacggtacgacgtaggacgaacgacgacgaacgtcgtggcgtcgcgacctactcgttcgtacttctactccgtcccgtacg

SEQ ID NO: 217395 - DNA, 606 bp, Homo sapiens
  misc_feature: GYAE6OF01CS08F.9.3.A03.1.454.CMB.1.raw
  modified_base (592)..(592): a, c, t, g, unknown or other
  misc_feature (592)..(592): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccgaaggggaaagcgccaccctctcctgcacgggccagtcaggagtgttggccaaccgtacgtagcctggtaccaacagaatccctggccaggcctacccgaggtcctcctctatttatgatcgcactaccaacgacgggccacgtcggctcccagccctaggtcagtggctaggtgggtctgggactagacttcactctccacctatccgagacacgcccgtagacgccttaagaagttacgttttcgactttaatttttaacttacgttcgtacacgtacgtacggtcggttacgaccgtaaggttgtcccttcgtaccgttacggtttcgggacgggtacggaaccgtagggtagacggtaccaggacgacgtggtaggctcgcctacacgttctcgttcttacncgttcccgtacccg

SEQ ID NO: 217396 - DNA, 590 bp, Homo sapiens
  misc_feature: GYAE6OF01CHCM1.9.3.A03.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggcctcccgaggcctcctctatttangatgcatccaacgacgggccacgtggccgtcccagccaggttcaggtggcaggtgggtctaggggacaggtacttcactctcaccatcagcagcctagacgcctagaagtattttgcttattttattactgtactagcagtcgtcgaccgtaagtcggtctttccgtcgtaccgtttcgggacgggtacgggtaaccgtaaggggtacggaacggaccgaaggaacgtaacgttcggtacggcgtcggacctaccgtacgtaccgttacgttaccttcctcgttcccgttaccccg

SEQ ID NO: 217397 - DNA, 759 bp, Homo sapiens
  misc_feature: GYAE6OF01DM2W5.9.3.A03.1.454.CMB.1.raw
  modified_base (306)..(306): a, c, t, g, unknown or other
  misc_feature (306)..(306): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtcctccgaaggggaaagagcccaccctctcctgcagggccagtcagagtgttgcacctacgtagcctggtaaccaacagaactccgtggacccaggcctcccgaggccttcctactattttagngacttgacactacccgaaacgtaccggggccctacggtcggcccgtccccaggcccgtaaggttccgaagggttcgggaccgtagggttcggggtaccgttagggggaacctaggtaccctttcaacccgttcctaccgacctagtccgaaggcctaacggtccctaaggacgtcccgttaagtaacgtttactttttcggtactttaatttttacttaccgttagttacgtaacggtcgaacggtccggttacgtaacccgtaggttcggttcctttaccgttaccgttaccgggtttccgggacggggtaacgggtaaccggtaaggggtcgggaacggtaaccgaacgggtaaaccggtaacggttcgggtacgggtaccgttaccggaacccgtacccgtaacgttcccgttacgtttaccctttactaccgtttccccgttaccccgg

SEQ ID NO: 217398 - DNA, 757 bp, Homo sapiens
  misc_feature: GYAE6OF01B1YUD.9.3.A03.1.454.CMB.1.raw
  modified_base (194)..(194): a, c, t, g, unknown or other
  misc_feature (194)..(194): n is a, c, g, or t
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctcgaggggaancgccaccctctcctgcgacgggccagtcagagtgttggcacctacgtagcctaggtaccaanagaactccgtggccaggcctcccgaggcctcctctatttangatcgacactacccaacgcgggcccacgtcggcctcccgagccgtaggttccaggtcgggacgtaggttcgggtccgtaggggaacctaggttacctttccgaaccgtttcctaccgaaccctattacccgaacgccgtaaccggtacccgtaaggtaccggtaccgttaaggtaaacggtttagtttttacggtaactttaagtttttaacgtttacgtttacgttaccgtaacggtacgtacgggtaccgttacggtacccgtaagggttcggttacctttcgttacccgttacgggttttccggggaccggggtaacgggtaaccggtaaggggtacgggaaccggtaaccggtaacggtaaccggtaacggttcgggtacggtaccgttccggaccgtacccgttacgttaccgttacggtttacccttccgttaccgtttccccggttacccccg

SEQ ID NO: 217399 - DNA, 629 bp, Homo sapiens
  misc_feature: GYAE6OF01A0DNQ.9.3.A03.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccgagggaancgccaccctctcctgcgagggccagtcagagtgtgcacctagtagcctggtaccaacagaactccgtggccaggcctaccgaggtcctcctctatttangatgctactccaacgacggcccacgtcggcccgtccagcctaggttccaggtcggcctagggtcggtcgtaggggacctaggtaccttcgacgttctaccaccgtatcgagccacgcctagacgtcctagaagttatttgacttattttaatcgtgtcaagctagtccgtagacgtaagtcggtaccttcgtacgtacgtttcgggacggtaacgggacccgtaagggtcggaaccgtaccgaaggtaaccggtaacggttcgggtacggacgtaccggaccctaaccgtacgttccgttacggttacctttaccctacgtttcccgttacccccg

SEQ ID NO: 217400 - DNA, 666 bp, Homo sapiens
  misc_feature: GYAE6OF01CLUGU.9.3.A03.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagcccaccctctcctgcagggccagtcagagtgttggcacctagtagcctggaaccanagaatcctggccaggcctccaggcctcctnatttangatgacataccaacgcgggccacgtggcctccagcctaggttcaggtcggcgtaggtgggtctaggggacagtaccttcgaactctacacctatcagccagtccgtaagacgtcctagtaagtagttttgactttaattttattacgttcgtacgtagtaccgtacgtccgttacgaccgtaaaggttcggtcctttaccgttacgttaaccggttttccgggacgggaacgggttaacccggtagggtacgggaaccggtaaccgaacgggtaaaccggtaaacggttgggtacgggtaccgttacggacccctaaaccgtacgttacccggtttagttacccttttaccgtaccgtttccccgttacccccgg

SEQ ID NO: 217401 - DNA, 591 bp, Homo sapiens
  misc_feature: GYAE6OF01BPYMW.9.3.A03.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagngtgttggcacctacgtagcctggtaccaacagtaactccgtggaccagggtcctcccgaggccttcctctatttangatgcatcccaacgngggccacgtggcctcccagccctaggttcaggtggcaggtggtctgggacagtacttcacttctacacatcagcagcctagacgctagtaagtatttgacttattttattacttgtacagtcgtacgcgtacgaccgtaagttcggtactttccgtcgttacgtttccgggtacgggtacgggaccgtaagggtcggaacggaccgaacggaacgtaacgtcggtaggcgtcgaccaccgtacgttctacgttacttctacgttccgttaccccg

SEQ ID NO: 217402 - DNA, 574 bp, Homo sapiens
  misc_feature: GYAE6OF01CGG2W.9.3.A03.1.454.CMB.1.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgctccaggggaaanagccaccctctcctgcagggccagtcagagtgttggcacctacgtagcctggtaaccaanagaatcctggccaggcctcccgaggcctcctcatttangatgactatccaacacgggcccacgtcggccgtcccagcccgaagggttcaggttcggacagggttgggtccgtaggggactacggtacctttcgaacttcctacgaaccctatcgagccacggtcctagacgtcctagaagtattttagcttaattttattacttgtactagtcagtcgtgactaagtcgtcttactcgtacgtttcgggacggacggaccgaggtcggaagaccgagacgtaacgtgtggctgcacactctcgtactctcttcgtcccg

SEQ ID NO: 217403 - DNA, 794 bp, Homo sapiens
  misc_feature: GYAE6OF01AMA1K.9.3.A03.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaagngcccaccctctcctgcagggccagtcagngtgttggcaccgtacgtacgcctggtaccaacgagaactccgtggccaaggcctcccaggcctcctctatttangatcgcactccaacgcggccacgtcggccgtcccagcccgtagggttccaggttcggcgtagggtcgggttcgtaggggtacacgggtaccttcaccgtccgtacccaccgtactccgagcccgaacgtccccgttaaggaccgtacccgttaggtaaacggtttacgtttttacggtacttttaacgttttttaacgtttaccgttacgggttaccgtaacgggtaccgtaacgggtcccgggttaacgtacccggttaaacgggtttccgggttacccgtttttacccgttaccgggtttaacccgggttttcccgggggaacccgggggtttaaccggggtaacccggtaaggggttacgggaaccggtaccccggtaaacgggtaacccggtaaacggtttcgggtaccgggtaccttacgggtaccctaaccgttacgtttcccggtttacgttacccgtttaccgtccgttttcccccgtcccccgg

SEQ ID NO: 217404 - DNA, 805 bp, Homo sapiens
  misc_feature: GYAE6OF01BIMX5.9.3.A03.1.454.CMB.1.raw
  modified_base (198)..(198): a, c, t, g, unknown or other
  misc_feature (198)..(198): n is a, c, g, or t
  modified_base (309)..(309): a, c, t, g, unknown or other
  misc_feature (309)..(309): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccacctgtccttgtctccgaggggaaagngccaccctctcctgcgagggccagtcagtagtgttggcctacgtacgtagcctaggtaccaacgagaacttccgtaggccagggcctacccgaggtcctacctctatttancgtatgacacttacccgaacgacggggaccctacgtcgggacccgttcccgagccccgtaagggtttccaagggttcggacgtagggttcgggtcgtggggacctaggtacctttccgacctccgtaccgaacctaacgttccgacgtccaacggtcccttaagggacgtacccgttaggtaacgtttacgtttttacggtacttttaacgttttttaaacttaaccggtttacgttaacgtacggtaccgtacggtaccggtttacggtacccgtaaagggtttcggtacccgttttaccgttaccggttaccgggttttacccggggaccggggtaacgggttaacccgggtagggttaacgggaaccggtaaaccggtaccgggaaaaccggtaccgggttagggtaccgggtaccgtcggtaacccgtaacccggttcgtttacccggtacggtttaccctttacttaacccgtttccccggttaacccccg

SEQ ID NO: 217405 - DNA, 848 bp, Homo sapiens
  misc_feature: GYAE6OF01E26IN.9.3.A03.1.454.CMB.1.raw
  modified_base (197)..(197): a, c, t, g, unknown or other
  misc_feature (197)..(197): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaancgccaccctctcctgcagggccagtcagagtgttggcaccgtacgtagcctggtaaccaacagaactccgtcggccgacggcctcccgaggtcctcctcgtactttagtgacttgctactacccgaaacggtacgggccctacggtcgggacccggtaccccgacggtcccgtaagggtttaccgaagggttcgggaccgtaggggttcggggtaccgttacgggggaacctacggtacctttaccgtaccgttcctaccctaaaccctacgttacccgaacgtacccgtaacggtacccgttaacggaccgtacccgttaagggtaaacgtttacgttttttacggtaaccttttaacgttttttaacgttttaaccgttacgttaccgtaacggtacccgtacggtaccgggttacgtaacccggttaagggttcggttacccgtttccgttaccgtttaccgggtttaccggggaccggggtaaacggggtaacccggtaaggggtaccggaaaccgggtaacccgtaaacggggtaaacccgtaaacgggtttccgggtacgggtaccggttacggtaaccccgtaccgttaccgttacccgttaccggtttacctttacccgttccgttccccgtttaccccccgg

SEQ ID NO: 217406 - DNA, 608 bp, Homo sapiens
  misc_feature: GYAE6OF01CXB9W.9.3.A03.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
  modified_base (424)..(424): a, c, t, g, unknown or other
  misc_feature (424)..(424): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaanagcccaccctctcctgcagggccagtcagagtgttggcacctacgtagcctggtaccaacagaatccgtggccaggcctacccgaggcctcctcatttangatgcactccaacgagggccacgtcggcctcccagccctaaggttcaggtggctaggtgggtcctaggggacaggtactttcactctaccaccatccagcacgcctagacgcctagaagtattttnacttaattttatactgtacagtcaggtcgtgacctaaggttcggtacctttccgtacgttaccggtttcgggaccgggtaacgggtaccgtaagggtcggaacggaccgaaggtacgtaacgtggtaggtctcggacctaccgtacgttccttacggttctttacctacgttcccgttaccccg

SEQ ID NO: 217407 - DNA, 583 bp, Homo sapiens
  misc_feature: GYAE6OF01E0W4K.9.3.A03.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (292)..(292): a, c, t, g, unknown or other
  misc_feature (292)..(292): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagngtgtggcacctacgtagcctggtacccaacagaatcctggccaggcctcccaggcctcctcatttangatgcactacccaacgacggggccctacgtcggaccgtcccagcccgtagggtttcaggtcggactaggtgggtctaggggacaggacctttcacctctcaccatcgagcacgcctagacgcctagaagtattttgacttattttacttactgtcagtcagtcgtcgacctaggtcgtctttcgtcgtacgtttccgggacggtacgggtaccgagggttcggacgtaccgacggaacggtaacgtggtggctgaccgactacgtctagttccttcgttcctttccccgac

SEQ ID NO: 217408 - DNA, 611 bp, Homo sapiens
  misc_feature: GYAE6OF01A0704.9.3.A03.1.454.CMB.1.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaancgccaccctctcctgcagggccagtcagagtgttggcacctacgtagcctggtaccaacagaactccgtggccagggcctccccaggccttcctctatttacngatgcactccaacgagggcccacgtcggaccgtcccagcccgtaggttcaggtggcaggtcgggtctggggacagtacttcactctcacatcagcagcctagcgtcctagaacgtatttagcttattttattactgtcagcacgtcgtcgaccgtaagtcggtcttcgtaccgtacggtttcgggacgggtacgggtaaccgtaggggttacggaacggtaccggaaggtaacccggtaacggtcggtacggacttcggaccctaccgtacgttccgttacgttaccttccctacgttccccgtaccccgg

SEQ ID NO: 217409 - DNA, 795 bp, Homo sapiens
  misc_feature: GYAE6OF01BZ4JT.9.3.A03.1.454.CMB.1.raw
  modified_base (197)..(197): a, c, t, g, unknown or other
  misc_feature (197)..(197): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaancgcccaccctctcctgcagggccagtcagagtgttggccacctacgtagcctaggtaaccaaaagatcctggaccaggcctcccgaggcctcctctatttatgtactcgactactaccgaacgtacgggaccctacgtcggtcccgtacccgacggcccgtaggttcgaggtcggcgtaggtcggggtcgtacggggactaacggtaccttcgacctctaccaaccgtattccgaacggaccaacggtcccgtaacggtacgtacccgttaaggtaaacgtttacgtttttacgtacttttaaacgtttttaacgtttaacgtttacggttaccgacgtaccgtaacggttccggtacggtaaccgttaacgggttcgggtttcctttaccgttaccggtttaccggttttaccgggggaccggggttaaaccggggtaaccggttaacgggggtaacgggtaacggtaaacccggtaacgggtaaaccggtaaacgggtttcgggtaccgggttaccggttacggtacccgtaaccgttaacgtttccggtttcgttacccgttttaccgtacctttcccccggttcccgtaacccg

SEQ ID NO: 217410 - DNA, 557 bp, Homo sapiens
  misc_feature: GYAE6OF01DXYIL.9.3.A03.1.454.CMB.1.raw
  modified_base (291)..(291): a, c, t, g, unknown or other
  misc_feature (291)..(291): n is a, c, g, or t
  modified_base (371)..(371): a, c, t, g, unknown or other
  misc_feature (371)..(371): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaaggggaaagagccacctctcctgcagggccagtcagagtgttggcacctacgtagcctggtaccaacagaatcctggccaggctcccaggcctcctcatttangatgcactccaacgagggccacgtcggctcccagccaggttcagtggcaggtggtctgggacagacttcactctacaccntcagcagcctagacgctagagtagtttgacttaattttatacttgtacagtcgagtcgtgacctaaggtcgtcttctacgtaccgtttcgggacggtacgggaaccgtagggtcggaacgaccgaggaacgacggttggtggcgtcgacctacgacttcttcgttaccttactcttccgtaccccg

SEQ ID NO: 217411 - DNA, 749 bp, Homo sapiens
  misc_feature: GYAE6OF01D3VAB.9.3.A03.1.454.CMB.1.raw
  modified_base (196)..(196): a, c, t, g, unknown or other
  misc_feature (196)..(196): n is a, c, g, or t
  modified_base (320)..(320): a, c, t, g, unknown or other
  misc_feature (320)..(320): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaanacgcccaccctctcctgcgacggccagtcaggagtgttcggccaccgtacgtacgcctaggtaaccaacgagaactccgtggacccgaaggtcctacccgaggtcccttcctactattttacgnggaatcggactaaccgtacccgaaaacggccggggtaccctaaccggtcgggtaccccgtacccaggtacccgtagggtttaccgaagggttcgggcgtaaggggtcgggttaccgtaggggaacctagtaccctttcgaccttccgacctaaccgtgtaccacggtcctaacggcccgtaaggtacgtccgtaaggtaagtttagttttcggaactttaattttaacttaccgttgtactacgtcgtacggttcggtacgtaccgtaagggttcgttaccttaccgttacgtaccggtttcgggaaccgggtacgggaacccgtagggtaccggaacggtaccgtaggaaccgttacgtcgggtacggccgtacgacctaaccgtacgttccgttacgttacctttcgtacccgttcccgtaccccgg

SEQ ID NO: 217412 - DNA, 639 bp, Homo sapiens
  misc_feature: GYAE6OF01DBSFV.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtcctgtctccaggggaaagacgccaccctctcctgcaggccagtcagagtgttggcacctacgtacgccttaggtacccaacgagaactcccgtaggccaggcctcccgaggcctcctctatttatgatgactactccgaaacgacgggcccacgtgggaccctcccgagccgtaggttcaaggtcgcgtaggtcggtcgtggggacagtacgtttacacgtcctacaccatcgagcacgcctagacgtcgtagtaagttagtttgtacttattttattactcgttacgacgtcgtagtcggtacgccgtaacggttcggtctttaccgtcccgtaacggtttccgggacgggtaacgggtaccgtaaggggtggaaccgaccgaacggtaaccggaacgttcggacggtctacggaccctaacgtcgttccgttacgtttcctaactccgttcccgttccccg

SEQ ID NO: 217413 - DNA, 690 bp, Homo sapiens
  misc_feature: GYAE6OF01DN8WL.9.3.A03.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (655)..(655): a, c, t, g, unknown or other
  misc_feature (655)..(655): n is a, c, g, or t
tcagtgatacgtctcacgaccggtgctcgatttagagagcgtcacgagggggaggaactgctcagttaggacccagagggaaccatggaagccccagctcagcttctcttcctcctgctactctggctcccagtgaccaccggagaaattgtgttgacacagtctccagcccaccctgtccttgtctccgaggggaaacngcccaccctctcctgcgagggccagtcagagtgtgcacctagtagcctggtaccaagagactcctggccaggcctcccaggtcctcctcgtattttanagattcgactactaccgaacgacgggcccacggtcggaccctacccgacggtcctacgggtttcagggtcggacgtacgggttcgggtacgtagggactacggtaccctttcgaaccttcgtaccaacctagttacgaacgtccgaacgtaccgtaacggacgtaccgtaggtaacgtttgtttttacgtactttaattttacttacgttcgtactagcgtacgtccggtacgtacgtaagtcggttcctttacgtacccgtttacggttaccgggaccgggtaacgggtaacccgtaggggtacgaccgtaaccggaacgaaccggttaacgtcggtaggactcggaccgtaaccngttaccgtcttacgttccttacgtcccgttccccg

SEQ ID NO: 217414 - DNA, 694 bp, Homo sapiens
  misc_feature: GYAE6OF01CKZ3T.9.3.A03.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (307)..(307): a, c, t, g, unknown or other
  misc_feature (307)..(307): n is a, c, g, or t
  modified_base (467)..(467): a, c, t, g, unknown or other
  misc_feature (467)..(467): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtcctccgaaggggaaancgcccaccctctcctgcgagggccagtcagtagtgttgcactacgtagcctaggtaccaanagaactccgtaggccaggcctcccgaggtcctcctctattttacgngattcgacctacttacccaacggtacggggcccctaacgtcgggtccctacccgaggtaccccgtaggtttccaagggtcggctagggtcgggtcgtaggggaccaggtacctttcacgttcacgtaccatccaacgcacgcctagacgctagtaagttntttagtacttaatttacttacgtgtacgagtcgtacgtcgtgtacgtaagttcggtacttccgtacgttaccggttccgggaccgggtaacgggtaaccggtagggtacggtaaccgaaccggacggtaaaccggtaacggttcgggtacggtacggtacccgtaccgtaacccgttacgttcccgttacggtttacccttacgttacccgttccccgttaccccgg

SEQ ID NO: 217415 - DNA, 716 bp, Homo sapiens
  misc_feature: GYAE6OF01C7JJR.9.3.A03.1.454.CMB.1.raw
  modified_base (204)..(204): a, c, t, g, unknown or other
  misc_feature (204)..(204): n is a, c, g, or t
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (428)..(428): a, c, t, g, unknown or other
  misc_feature (428)..(428): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagtaaatttgtgttgacacagtctccacgcccaccctgttccttgtcctccgaaggggaaancgcccaccctctcctgccgacgggccagtcagagttgttggcctacctacgtgcctggtaacccaanagaactcctggcccaggcctcccgaggcctcctntatttangatgccatccaacgcgggccacgtcggccgtcccgagtaccctagggttcagggttcggcgtaggttcgggtcgtagggacctacgtacctttccgaaccttcctaccgaaccgtntaccgaacggcctacggtaccccgtaaggtacgtacccgttaagttaacgtttacgttttacgtacttttaacttttttacttaccgttaggttacctcgtaccgtacggttaccggtaccgtaccgtaaggttcggttacctttaccgttaccgttaccggtttcggggaccgggtaacgggtaccgtaaggggtaggaccggtaacgacggtaacgtacggtcggtacggacgttacgccgtaaccgtcgttccttacgttccttacttccgttcccgttaccccg

SEQ ID NO: 217416 - DNA, 690 bp, Homo sapiens
  misc_feature: GYAE6OF01E0YLQ.9.3.A03.1.454.CMB.1.raw
  modified_base (199)..(199): a, c, t, g, unknown or other
  misc_feature (199)..(199): n is a, c, g, or t
  modified_base (324)..(324): a, c, t, g, unknown or other
  misc_feature (324)..(324): n is a, c, g, or t
  modified_base (664)..(664): a, c, t, g, unknown or other
  misc_feature (664)..(664): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtcgaccaccggagtaaattgtgttgacacagtcctccagccacctgtccttgtctccgaaggggaancgcccaccctctcctgcgacgggccagtcagtagtgttcggccaccgtacgtacgcctacggtaaccaacacgtaactccgtcgggaccacgggcctacccgaggtcccttcctactattttagngtattcgactaactaccgaaacggacgggaccctacggtccggtacccgtacccacggtaccgtaggtttaccgaggttcgggacgtaggggttcgggtcgacggggactacggtaccttcgtacctcgtacctacactacgacacgaccgtaccgtaacggaccgtaccgttaaggttaacgtttacgttttacgtacttttaacgttttttacttaacgttcgttacaggtccgtacgtccgtacgtaccgtaggtcgtccttacgtacgttaccgttcgggacgggtacggacggtacggcggacgacgacggacgtacgtcggcgcgtcgctactntcgttataccttcgtcttccgtaccg

SEQ ID NO: 217417 - DNA, 857 bp, Homo sapiens
  misc_feature: GYAE6OF01A5HI8.9.3.A03.1.454.CMB.1.raw
  modified_base (198)..(198): a, c, t, g, unknown or other
  misc_feature (198)..(198): n is a, c, g, or t
  modified_base (265)..(265): a, c, t, g, unknown or other
  misc_feature (265)..(265): n is a, c, g, or t
  modified_base (316)..(316): a, c, t, g, unknown or other
  misc_feature (316)..(316): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaanacgcccaccctctcctgcgacgggccagtcaggagtgttggcacctacgtacgcctaggtaaccaanaggtaactccgtacggccgaggcctacccgaggtcctcctactattttagngtatcgactactacccgaaacgacgggccctaacgtcgggtacccgtaccccgaaggtacccgtagggtttacgacgggttacgggaccgttaacgggggttacggggttaccgttacgggggaaacccgtacgggttaacccttttaccggaaccctttacccgtaaccctaaaccccgtaaagttcccggaaaggacccgtaaccggtacccgttaacgggaaccgttacccgttaagggtaaacggttttaacgttttttaacggaactttttaacgtttttaacgtttaaccgttaggttaaccgtaacggtaccgtaacgggtaccgtaccggtaacccggtaaaggttccgggttactttaccggttacccggtttacgggtttaccggggaacggggtaaccggggtaaccggtaacgggtacgggtaacccgaaccggtaacggtaaaccggtaacgttcgggtaacgggcctaacggacctaacgttaccgttcgttaccgtttaccgttactacctttcccggttaccccg

SEQ ID NO: 217418 - DNA, 740 bp, Homo sapiens
  misc_feature: GYAE6OF01B5ZBP.9.3.A03.1.454.CMB.1.raw
  modified_base (204)..(204): a, c, t, g, unknown or other
  misc_feature (204)..(204): n is a, c, g, or t
  modified_base (330)..(330): a, c, t, g, unknown or other
  misc_feature (330)..(330): n is a, c, g, or t
  modified_base (368)..(368): a, c, t, g, unknown or other
  misc_feature (368)..(368): n is a, c, g, or t
tcagtgatacgtctcacgaccggtgctcgatttagagagcgtcacgagggggaggaactgctcagttaggacccagagggaaccatggaacgccccagctcagcttctcttcctcctgctactctggctccagtcgaccgaccggagaaattgtgttgacacagtctccagcccaccctgtccttgtcctccggaagggaaacncgcccaccctctccgtgcgacgggccagtcgaaggtgtgttcggaccaccgtacgtacgcctaggtaaccaagagtaactccgtacggaccgacggccctaccggaggtcctccgtactatttagngtattcgacactaccgacgacggcctacgtcggtaccncccgagtccgtacgggttcagggtcggacgttacggggtcggtacggagggtaacgacggtaccttaccgtaaccgttcctaccgaaccgtacgtcgaacgaccgtacgaccgtacggaacgttaccgtaaggtaactttacgttttacgtaactttaacgttttaacctttaacgcgtttacgacgttacgtacggtacgttacggacgtaacggtccggttacctttcgtaccgttaacgggttccgggaacgggtaaccggtaacggtacgggtaacggaaccgtaaccggacggtaaccggtaacgtgtaccgggtactccgggacctacccgtacgtccgttacgtactcctccgttcccgtacccg

SEQ ID NO: 217419 - DNA, 745 bp, Homo sapiens
  misc_feature: GYAE6OF01EP238.9.3.A03.1.454.CMB.1.raw
  modified_base (198)..(198): a, c, t, g, unknown or other
  misc_feature (198)..(198): n is a, c, g, or t
  modified_base (302)..(302): a, c, t, g, unknown or other
  misc_feature (302)..(302): n is a, c, g, or t
  modified_base (427)..(427): a, c, t, g, unknown or other
  misc_feature (427)..(427): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccgaggggaaanacgccaccctctcctgcgaggccagtcagagtgttggcacctacgtagcctggtaccaacagaactcctggccaggcctcccgaggcctcctactattttacgngtactgaccactaccgaacgacggggcccacgttcggcccgttcccaaggtcccgtaagggtttccaggttcggcgtacggttcggggtctaggggactaggtccttacgcgttctacctaaccnttaccgaacgcgtaacgtccgtacgacgtaccgttagtaagttattttacgtacgtttaatttttaacgttaccgttaggtacgtacgtacgtacggttaccgtacggtaccgtaaggtcggttacctttaccgttacccgttacgggttttcccggggaaccggggtaacgggtaaccgggtaacggggtacgggtaaaccggaaccgggtaacggaaaccgggttaaccggttacgggtacgggtaccggtaccgacccgtaccgtacttacccggtacgttttaccgttacccgttgttcccccgtttacccccg

SEQ ID NO: 217420 - DNA, 766 bp, Homo sapiens
  misc_feature: GYAE6OF01AUM8G.9.3.A03.1.454.CMB.1.raw
  modified_base (198)..(198): a, c, t, g, unknown or other
  misc_feature (198)..(198): n is a, c, g, or t
  modified_base (264)..(264): a, c, t, g, unknown or other
  misc_feature (264)..(264): n is a, c, g, or t
  modified_base (309)..(309): a, c, t, g, unknown or other
  misc_feature (309)..(309): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtcccttgtctccgaggggaaanacgcccaccctctcctgcgagggccagtcagagtgttggccaccgtacgtacgcctggtacccaanacgaactccctggacccaggccctcccgaggcctcctctatttangatgacactccaacgacgggtcccacgtcgggccctaccccgacggtccccgtagggtttccgaggttcgggctaggggttgggtccgtcgggggaactacggtacctttccgaccgttcctaccgacctagtaccacggccacggacccgtagaccgtaccgtaggtaacgttgttttacgtactttaagtttttaacttaccgttgttaccgtacgtaccgtacggtccggttacggacccgtaaagggttcggttacctttacccgttaccggtttaacccggttttcgggggaacccggggtaaccggggtaacccggtaaggggtaccgggaacggtaacccggaacggtaaccgggtaaccgttcgggtaccgggtaccgtccggtacccgacccgttactcccgtttaccgtttacccgtttaccgtaccgtttccccgttaacccccgg

SEQ ID NO: 217421 - DNA, 795 bp, Homo sapiens
  misc_feature: GYAE6OF01D03PG.9.3.A03.1.454.CMB.1.raw
  modified_base (199)..(199): a, c, t, g, unknown or other
  misc_feature (199)..(199): n is a, c, g, or t
  modified_base (311)..(311): a, c, t, g, unknown or other
  misc_feature (311)..(311): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctccagtgaccaccggaagaaattgtgttgacacagtctccagcccaccctgtccttgtctccgaaggggaaanagcccaccctctcctgcacgggccagtcagagttgttggctacctacgtagccttaggtaccaacaggaacttcccgtggcccgaggcctccccgaggcctcctctatttangatgactactaccaacgacgggccaacgtcggtaccgtcccgagcccgtaggttcagggtcggcgtaggttcgggtcgtacggggaacacggtcctttacaacgttcctaccgacctacgtcaacggtccaacggtcccgtaaggaccgtaccgtagtaaagtttacgtttttcgacctttaagtttttaacgtttaccttacgggttacctaagggtccgtacggtaccggttaccggaccgtaaagggttcggtccttttaccgttaccgttaaccgggttttccggggaaccggggtaaccgggggtaaaccgttacggggggtaacgggtaaaccccgaaccgggtaaacgggaaaacccgggttaaccggttacggggttacggggtaccctttaccgggaccccttaaacccgttaacgttcccgttttacggtttacccttttacccgttaacccgtttccccggtttacccccccg

SEQ ID NO: 217422 - DNA, 514 bp, Homo sapiens
  misc_feature: GYAE6OF01DSB9O.9.3.A03.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
  modified_base (377)..(377): a, c, t, g, unknown or other
  misc_feature (377)..(377): n is a, c, g, or t
  modified_base (503)..(503): a, c, t, g, unknown or other
  misc_feature (503)..(503): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggctcccaggctcctnatttangatgcatccaacgnggccactggctccagccaggttcagtgcagtggtctgggacngacttcactctacacatcagcagcctagacncctagagtatttgacttatttatctgtcagcagcgtcgcctaagtgcttctctacgtttcggacggtacggaccgagggtggaacgacgaggacgacgtggtgctgaccacagttctgttctcgtnttccgtacccg

SEQ ID NO: 217423 - DNA, 771 bp, Homo sapiens
  misc_feature: GYAE6OF01B3T55.9.3.A03.1.454.CMB.1.raw
  modified_base (198)..(198): a, c, t, g, unknown or other
  misc_feature (198)..(198): n is a, c, g, or t
  modified_base (262)..(262): a, c, t, g, unknown or other
  misc_feature (262)..(262): n is a, c, g, or t
tcagtgatacgtctcacgaccggtgctcgatttagagagcgtcacagggggaggaactgctcagttaggacccagagggaaccatggaacgccccagctcagcttctcttcctcctgctactctggctcccagtgaccaccggagaaattgtgttgacacagtctccagccaccctgtccttgtctccgaggggaaancgcccaccctctcctgcgagggccagtcagagtgttggccaccgtacgtcgcctaggtaccaanagaactccgtggcccaggcctcccgaggtcctcctctatttatgagtcgacactacccgaacgcgggcccagtcggccgtcccgagccgaggttccaggtcggcgtagggtcggtacgtgggaccagtactcctactccgtaccaacctatccgacgtaccacggaccttaaggccgtacgttaggtaacggtttacttttacggaccttttaagtttttacttaccgttcgtaccgtaagtccgtaggtccggttacgtaccgtaagggtttcggtccctttaccgttaccgttaccgggttttaccgggggaccgggttaaaccgggtaacccggttaaggggtaccgggaacgggtaacccggtaaagggtaaaccccggttaacggtttcggggtaaccggggtaccccttacgggaaccccgtaaacccgtttacggttaccccggtttacgggtttaccccttttacccggttaaccccgttttcccccggttaaccccccgg

SEQ ID NO: 217424 - DNA, 560 bp, Homo sapiens
  misc_feature: GYAE6OF01CPFX6.9.3.A03.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (253)..(253): a, c, t, g, unknown or other
  misc_feature (253)..(253): n is a, c, g, or t
  modified_base (291)..(291): a, c, t, g, unknown or other
  misc_feature (291)..(291): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattggtgttgacacagtctccagcccaccctgtccttgtctccgaggggaaangccaccctntcctgcagggccagtcagagtgttgcacctagtagcctggaccanagaatcctggcaggcctcccgaggcctcctcattttangatgcatccaacagggccacgtggcctccagccaggttcaggtgcaggtggctgggacagtaccttcactctacacctatccgaagccagcctagacgtccgtagaacgtagttttcgcgttaattttacttacttgtctacgtcgacgtcgtgacctaaggtcggtcttctccgtacgtttccgggcgggtagggaccgagggtacggacgacgaggacgtaacgtggtgacgtcgacactagtcttacgtcttactcgttcctcccg

SEQ ID NO: 217425 - DNA, 716 bp, Homo sapiens
  misc_feature: GYAE6OF01BJ2ES.9.3.A03.1.454.CMB.1.raw
  modified_base (198)..(198): a, c, t, g, unknown or other
  misc_feature (198)..(198): n is a, c, g, or t
  modified_base (301)..(301): a, c, t, g, unknown or other
  misc_feature (301)..(301): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccgaggggaaangccaccctctcctgcagggccagtcagagtgttcggcacctacgtagcctaggtaaccaacagaactccgtggcccaggcctcccgaggcctcctctaatttngatgcacgtaccaagacgggccacgtcggccgtcccagtccgaggtttcaggtcggctaggttgtcggttcgtggggacctaggtacccttcgaccttccgtaccacctatacccgagtaccgaacggtaccgtaacgaccggtacctaggtaaagtttaacgtttttacgaacttttaagttttttaacgttaaccgtttacggtacctaacggtacgtacggtacggttaccggtacccgtaaggttccggtacctttacccgtccgtttacccgggtttccggggaccgggtaacggggacccgtaaagggtaccgggaccgtaaaccggaacggtaaccggtaacgttgggtacggtctccgggaaccctaccgttacgttaccgtcgttacctttccgtaccttaccccg

SEQ ID NO: 217426 - DNA, 703 bp, Homo sapiens
  misc_feature: GYAE6OF01CCBEF.9.3.A03.1.454.CMB.1.raw
  modified_base (302)..(302): a, c, t, g, unknown or other
  misc_feature (302)..(302): n is a, c, g, or t
  modified_base (412)..(412): a, c, t, g, unknown or other
  misc_feature (412)..(412): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaagcgcccaccctctcctgcgacggccagtcagagtgttggcacctacgtagcctaggtaccaacgagaactccgtggccaggcctccgaggtcctcctctatttangatgcactaccgaacgacggccctacgtcgggtccacccgagtccgtaggttaccgaggttcggcgtagggttcggtcggtagggacacgtaccgttcacgtctcaactntccagcacgtcgagacgtcgtagtaagttatttgtacgttaatttttacttacttcgtacgagtacgtacgtacgtcgtaccgtaacggttcggtcgtttaccgtaccggttacccggttttccgggacggggtaacggggtaaccgtagggggtaaccggtaggaaacccggtaacgggtaaacccggtaacgggttcgggttaccgggacggttccggtaaccgtaaacccgttcgttacccggttacgtttaccgtttacccgttaaccgttttccccgttacccccg

SEQ ID NO: 217427 - DNA, 594 bp, Homo sapiens
  misc_feature: GYAE6OF01DOSU4.9.3.A03.1.454.CMB.1.raw
  modified_base (196)..(196): a, c, t, g, unknown or other
  misc_feature (196)..(196): n is a, c, g, or t
  modified_base (289)..(289): a, c, t, g, unknown or other
  misc_feature (289)..(289): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangcccaccctctcctgcagggccagtcagagtgtgcactacgtagcctggtaccaacagaatcctggccaggcctcccaggcctcctcatttangatgactactaccgaacgacggggcccacgtcgggcctcccagcccagggttcaggtggactgggtcgggtctggggaacaggtactttcacctctacaccgatcgagtcacgtccgtagacgcctagtaagtatttgacttatttacttactgtacagtctagcgtgacgtagtcgtctttctacctacggtttcgggacgggtacgggtaccgtagggtacggaacgaccgaggtaacggaacgttgggtacggacttcggacctaccgacttcgtcgttaccttctacgttcccgttacccg

SEQ ID NO: 217428 - DNA, 699 bp, Homo sapiens
  misc_feature: GYAE6OF01AFS1G.9.3.A03.1.454.CMB.1.raw
  modified_base (198)..(198): a, c, t, g, unknown or other
  misc_feature (198)..(198): n is a, c, g, or t
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
  modified_base (467)..(467): a, c, t, g, unknown or other
  misc_feature (467)..(467): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccgaggggaaancgcccaccctctcctgcgagggccagtcagagtgttggcacctacgtagcctggtacccaangaactcccgtggccaggcctcccgaggtcccttcctctatttacgngtatcggccactacccaacggacgggccctacgtcgggccctcccgagtcccgaggtttccagggttcggccgtaggtcgggtcgtagggaactcgtacctttcgaccttcacccacctatcgacggtccacggtacccgtagacgccgttaggtaagttntttttaggtacttttaagttttaactttaccgttcgttacgtacgtacgtacgtcggtacggtaccgttagggtcgttccgtttaccgtccggtaccgtttccgggggaccgggtacgggtaacccggtaggggtacggaaccgtaccgacggtaaccgaacgggttcggtaggccgttcgaccctacgttacttccgttacgttcccgttctaccgttccccgttaccccg

SEQ ID NO: 217429 - DNA, 785 bp, Homo sapiens
  misc_feature: GYAE6OF01BHA6X.9.3.A03.1.454.CMB.1.raw
  modified_base (161)..(161): a, c, t, g, unknown or other
  misc_feature (161)..(161): n is a, c, g, or t
tcagtgatacgtctcacgaccggtgctcgatttagagagcgtcacgagggggaggaactgctcagttacggacccagagggaaccatggaagccccagctcagcttctcttcctcctgctactctggctcccagtgaccacggagaattgtagttgacacngtctccagccaccctgtccttgtcctccgaaggggaaacacgcccacccttctccgtgccgagggccagtcaggtgtggttcgcacctacggtacgcctaggtaacccaagagtaacctccgtggacccacgggcctaccgaggtccttccgtacttatttagtgtaacgttcgacctacgtacccgaaaagaccgggtcccacggttcggaccccgttacccaacggtcccgtaaggggtttcaacgggttcgggaaccgtggggttcgggttacgtagggggaaccctacggttaactttcccggaactttccacccggaacctacgttacccggaacgaccgtacgtaccgttacggaacgttacccttaaggtaacggtttaacgtttttactaacgttttaacttttacgtaaccgtttcgtaccgtaagtcgtaggtcccgtgtaccggtaacggtcgtccttacggtccgttacggtttcgggaccgggtaacggtaccggagggttacgggaccctaacggacggtaaccggtaacgttgggtaccgggtaccttccgaccgtaacccgttggttcccgttacgtttagttaccctcccgtttcccgttaaccccg

SEQ ID NO: 217430 - DNA, 590 bp, Homo sapiens
  misc_feature: GYAE6OF01B89QM.9.3.A03.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
  modified_base (380)..(380): a, c, t, g, unknown or other
  misc_feature (380)..(380): n is a, c, g, or t
  modified_base (414)..(414): a, c, t, g, unknown or other
  misc_feature (414)..(414): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcctacctgtccttgtctaccgaggggaaancgccaccctctcctgcagggccagtcagngtgtgcacctagtagcctggaccanagatccgtggccaggcctcccgaggcctctctatttangatgctatcccaagcggcccagtcggcctcccgagccctagggttccaggttcggctaggttcgggtcgagggacacgtcttcgacctcncacatcgagcacgctagcgtacgtagtaacgttntttgacttatttattacgtgtacgagtacgtagcgtacgacgaaggttcgtcttcctacgtacgttcggacgggtacggacgaggtacggacgtaaccgaggaacgacggttcggtacggtacgtcggaccaccgttacttcgttcgttaccttccgtaccgttcccgttaccccg

SEQ ID NO: 217431 - DNA, 634 bp, Homo sapiens
  misc_feature: GYAE6OF01E1ENC.9.3.A03.1.454.CMB.1.raw
  modified_base (305)..(305): a, c, t, g, unknown or other
  misc_feature (305)..(305): n is a, c, g, or t
  modified_base (410)..(410): a, c, t, g, unknown or other
  misc_feature (410)..(410): n is a, c, g, or t
  modified_base (465)..(465): a, c, t, g, unknown or other
  misc_feature (465)..(465): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtcgaccaccggagaaattgtgttgacacagtctccagccaccctgtccttgtctccgaggggaagcgcccaccctctcctgcgagggccagtcagagtgttggccaccgtacgtacgcctaggtaccaacagtactcctggccaggtcctcccgaggtcctccgtctatttangatcgcactaccaacgcggcccacgtcggcctacccgagtccgtaggttcaggtcggactaggtcgggtcgtagggactagtcttcgacctctacaccgctcganacacgccgtagactccgtagaagttagtttcgactttagttttactacgtgtacncgtacgtacgtacgttcggaccgtaggttcgtcctttaccgttaccgttaccgggtttccgggacgggtaacggtaaccggtagggtacggacgtaccgaaggtacccggtaggtggtacggcgtcgacctacgcgttcttacgtaccctttcacgttcccgtaccccg

SEQ ID NO: 217432 - DNA, 722 bp, Homo sapiens
  misc_feature: GYAE6OF01CP5DW.9.3.A03.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (319)..(319): a, c, t, g, unknown or other
  misc_feature (319)..(319): n is a, c, g, or t
  modified_base (706)..(706): a, c, t, g, unknown or other
  misc_feature (706)..(706): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccacggagaattgtgttgacacagtctccagccaccctgtccttgtctccgaaggggaaacncgcccaccctctcctgccgagggccagtcaagngttgttggctaccgtacgtagccttaggtaaccaacgagtaactccgtacggcccaggcctccccgaggtccttccgtactattttacnggtactcgacactacccaagtacgggcccacgtcgggcctcccagcctaggtacgaggtcggactagggtcgggtcgtagggacacggtactttaccgactccgtaccacctataccgagtaccacgtacccgtaacggacgtacccgttaggtaaacgtttacgttttacgtacttttaacgtttttacgttacgtttacggaccgttaacggtaccgtacggtaccggtacggtacccgtaagggttcgtaccgtttccgtcgttaacccgggtttcggggaccgggtaacggtaaccggaggggttacgaccggtaacgacggaaaccgttacggtcgttcgggacccgttagaccctacgttacctcgttcgttaccttaccncgttcccgttaccccg

SEQ ID NO: 217433 - DNA, 709 bp, Homo sapiens
  misc_feature: GYAE6OF01B2GXW.9.3.A03.1.454.CMB.1.raw
tcagtgatacgtctcacgaccggtgctcgatttagagagcgtcacgagggggaggaactgctcagttaggacccagagggaaccatggaagccccagctcagcttctcttcctcctgctactctcggcctcccagtcgaccaccggagtaaattgtgttgacacagtcctccacgccctaccctgttccttgtccgtaccgaagggggaaacgacgccctaccctctccgtgcgacggccagtcaggtagtgttcggacctaccgtagtacgtccgtaggtaacccaaacgaaggtaactcccggtacggaccgtacggtccctaccgacggtcctcctactatttgcgtatcgactactaccgaacgtcggccacgtcggcctcccgagtccgtaggtccgaggtcggacggtaggggtcggtacgtacggggactacggttactccgtaccttccgtaaccacgtactcgaacgcccgtaacggtacctaacggacctaccgttaaggtaacgtttatttacgtacttttacgttttaaacgttctacggtacgttacgacggtcgtacggtcgtaacgtacggttctcttacgtccgttacgggttcggacggtacgggtacgtacgggacggaacgaccgtacggacgtacggtggcggactcgaacctcttacgtcgttcctagtccttacgttcccctaccgg

SEQ ID NO: 217434 - DNA, 743 bp, Homo sapiens
  misc_feature: GYAE6OF01B5KP4.9.3.A03.1.454.CMB.1.raw
  modified_base (146)..(146): a, c, t, g, unknown or other
  misc_feature (146)..(146): n is a, c, g, or t
  modified_base (325)..(325): a, c, t, g, unknown or other
  misc_feature (325)..(325): n is a, c, g, or t
  modified_base (722)..(722): a, c, t, g, unknown or other
  misc_feature (722)..(722): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtcgaccaccgganaaattgtgttgacacagtcctccagccctaccctgttcccttgtcctccgaaggggaaagcgcccaccctctcctgcgagggccagtcaggtagttgttcggcctaccgtacgtacgcctacggtaaccacagtaactccgtcggccacggccctcccgaggtcctcctactatttacngatgacactaccaacgacggccagtcggcctccgacgccgtaggttcaggtggctagggtcggtacgtcggggaactacggtcctttacgaccgttacctacgaacctgtacccgagaccgtaaccgtacccgttaaggccgttaccggtaaggttaacgtttcgttttacgtaaactttttactttttaacgtacgttacgtacgtacgtcgtaacggccggttaccgacggtaggtttcgtccttttccgtacggttacccggtttacggggacggtaaccggggtaccgtaaggggtaccgaaccggttaacccggaacgtaaccggtaacggttcgggtacgggtctaacgggtcccctaaaccttgttacccggttccgttaaccctttccncccggtttccccttaccccgg

SEQ ID NO: 217435 - DNA, 835 bp, Homo sapiens
  misc_feature: GYAE6OF01ESJKW.9.3.A03.1.454.CMB.1.raw
  modified_base (197)..(197): a, c, t, g, unknown or other
  misc_feature (197)..(197): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctccagtgaccaccggagaaattgtgttgacactagtctccagccacctgtccttgtcctccgaaggggaancgcccacccgtctccgtgccgacgggccagtcagtattggtcgacctaccgtacgtacgccgtaggaaccaacagaactccgtggccacggccctaccgacggtcctccgttactatttacgagtacttcgacctaacgtacccgaaacggccgggaccctaccggtccgggtacccgttacccgaggtacccggttacgggttcgtaacgggtcggacggtaggggttcgggtcgtacgggactacggtaccttcgtacctcgaccctacagtacgacgtcgacgtaccgtagtaccgtaccgtaagtaacgtttacgtttacggttaacttttaacgttttaacgttacgtacgttacgacgtaccgtacggttacgttacgtacccggttaaggttccgttacgtttacccgttacgtttaccggggttaccggggtaaccggggttaacgggtaacccgggtaaggggttacccgggtaaacgggtaaacccggttaaaccgggtaaccggttaaaccgggttcgggtttaccggggaccgttaccggtaacccccgtaaaccgttaccgttttacccgggttaccgttttacccgttaaccccgttacccgtttccccggtttaaacccccgg

SEQ ID NO: 217436 - DNA, 563 bp, Homo sapiens
  misc_feature: GYAE6OF01DDJ1K.9.3.A03.1.454.CMB.1.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaacagaatcctggccaggcctcccaggctcctcatttangatgcatccaacgagggcccacgtggcctccagccaggttcagtggcagtggtctgggacagtcttcactctcaccatcagcagcctagacgcctagaagtatttgtacttattttattactgtacagcagtcgtgactaagtcggtcttctcgtacgtttcgggacggtacgggaccgtaagggtcggaacgaccgaagaaccggaacgtggtagggtctcggaccaccgtacgttaccgttacgttactttacctacttcccgttaccccg

SEQ ID NO: 217437 - DNA, 922 bp, Homo sapiens
  misc_feature: GYAE6OF01BJ1OD.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccgaaggggaagacgccaccctctcctgcgaggccagtcagagtgtgacacctacgtagcctggtaccaacgagaactccgtaggccgaacggtcctcccgaggtccttcctacgtatttacgtagaagttcgtacctaacgtacccgaaacgtaccggggacccctaaccggttccgggtcccggtaccccgtacggtaccccgtaggggttttaccgaagggttccgggtaccgtaagggggttcggggttccggtaacggggggtaaaccgtacgggttaacctttacccgaaccgttttcccgaaccccgtaaaccccgtacggtttaaccgaacgggtaacccgttaacgggtaacccctttaacgggaacccggttaccccggttaaagggttaaacggttttaacgttttttaccgggtaaacctttttaaaacggttttttaaacgttacccgtttagggttaacccttaaggggtaccctaacgggttcccggttaacggacccgtttaaaggttcgggttaacccgttttacgtaaccggtttacccgggtttttaccggggaacccgggggttaacgggaaaccgggttaaccggggtaaccgggtaacggtaacccgtaacggggtaaaccctaaccggggttggttacccggtacgtaccggtaccctaaccgttacgggttcccttaggtttccctacctaacccgtttcccggttaccccc

SEQ ID NO: 217438 - DNA, 818 bp, Homo sapiens
  misc_feature: GYAE6OF01CSG8F.9.3.A03.1.454.CMB.1.raw
tcagtgatacgtctcacgaccggtgctcgatttagagagcgtcacagggggaggaactgctcagttaggaccagagggaaccatggaagcccagctcagcttctcttcctctgctactctggctcccagtgaccaaccggagaaattgtgttgacacagtctccagccacctgtccttgtctccgaaggggaaacgcgccacccttctccgtcgcgacgggcctagtcgagtagttggttggcctaaccgtacggtacgcccttacggaaaccaacgacgaaacttcccgtacggacccgacggaccttaccccgagggtccttccctacttaattttacgtacgtaagtcgtacctaacgttacccgaacggaccggggtacctaacggttccgggaccgttccccgaacggtcccgtaaagggtttccgacgggttcgggcgtaacgggttcgggtacgtacggggactacggtacctttacgaaccgttctaccgtaccctaagtaccgagtaccacggtaccttaaggaaccgtcgtaacgtaagtttacttttacggtactttaatttttaacgttacgttagttaccgtaacggtacgtacgggttacctacggtaaccgtaacggttccgggttacctttacgtttaccgttaaccgggtttaccgggaacgggtaaccgggttaacggacgggttaccgggaaacggtaaccgtacgggtaaccgtaacggtcggtacggtaccggtacggaccgtaaccgttacgttacgttaccgttccgtttaacctcggtttaccccgttacccgg

SEQ ID NO: 217439 - DNA, 746 bp, Homo sapiens
  misc_feature: GYAE6OF01CWVSO.9.3.A03.1.454.CMB.1.raw
  modified_base (203)..(203): a, c, t, g, unknown or other
  misc_feature (203)..(203): n is a, c, g, or t
  modified_base (324)..(324): a, c, t, g, unknown or other
  misc_feature (324)..(324): n is a, c, g, or t
tcagtgatacgtctcacgaccggtgctcgatttagagagcgtcacagggggaggaactgctcagttaggacccagagggaaccatggaagccccagctcagcttctcttcctcctgctactctggcctcccagtcgaccaccggagaaattgtgttgacacagtcctccacgcccaccctgtccttgtctccgaaggggaaancgcccaccctctcctgcgaggccagtcagtgtgttcggcctaccgtacgtacgtccgtacggtaaccaacgagaactccgtcggacctacggcctacccgaggtccttcctctattttagngtacgtcgacctacctaccgaacgacgggaccctacggtccggaccgtacccagtcccgtaggttccgaggtcggcgtacgggttcgggtacgtacgggaactacgttaccttacgtaccgtcctaccaccgtacgtaccgaagtaccgacgtaccgtaaggaaccgtccgttaaggtaacgtttacgttttacgtacttttaaagtttttacgttacgttacgtacgtacgtccgtacggtccggttacgtaccggtaaggtttccggtccttacgtttaccgtaccgggttccgggaacgggtaacgggtaaccggtagggtacggaaaccgtaacgtaccgggtaacgttacggtgggtaccgacgtacccggaccttaacgtctttaccttcgttcccttactccgttacccggtccc

SEQ ID NO: 217440 - DNA, 608 bp, Homo sapiens
  misc_feature: GYAE6OF01EFKVZ.9.3.A03.1.454.CMB.1.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaancgccaccctctcctgcagggccagtcagagtgttgcacctacgtagcctggtaaccaacagaactcctggccaggcctcccgaggcctcctctatttacngatcgcactccaacgcggggcccacgtcggccgtcccagccctaggttcaggtcgcgaggtcgggtctgggacacggtacttcgacttctaccgacctatcgagccagtaccgtagacgtacctagtaagtattttacgacttaattttacttactcgttactagctacgtcgtcgaccgtagtcggtccttctccgtacggtttcgggacgggtacgggtaacgtaagggtcggaacgacgacggacggtaacgtggtacggccgtcgacctaacctacgttcgtacgttccttactcgttcccgtaccccg

SEQ ID NO: 217441 - DNA, 699 bp, Homo sapiens
  misc_feature: GYAE6OF01A23KY.9.3.A03.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (291)..(291): a, c, t, g, unknown or other
  misc_feature (291)..(291): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcaggccagtcagngtgtggcacctacgngcctggtacccaanagaactccctggcccacggcctacccgaggtcctcctntatttacgcgtgtcactaccaacgacggaccgaccgtacggtcgtacccgcgaccgtgtacgtacgtaggcgacggtagggtcgtggacgtacgtacgttctaccgccttaccaccgtactacaccgactacgtaccgtacgtaacgctacggtaagttacgtttgttacctaatttacgtttaactacgttacgtagtaccgtcgtaaccggttcgtaccgtaaggttacgttccgttaccgtttaccgtaccgtttaccggggtacccgggacgggtaaccggtaacgggttagggaccggtaacccggaaacgtacggtaaaccgtacgggttacgggtacgccgttaacgacccgtaacgttcgttacgttcccttacgttccttcccggttccccgttacccg

SEQ ID NO: 217442 - DNA, 750 bp, Homo sapiens
  misc_feature: GYAE6OF01C5POP.9.3.A03.1.454.CMB.1.raw
  modified_base (146)..(146): a, c, t, g, unknown or other
  misc_feature (146)..(146): n is a, c, g, or t
  modified_base (207)..(207): a, c, t, g, unknown or other
  misc_feature (207)..(207): n is a, c, g, or t
tcagtgatacgtctcacgaccggtgctcgatttagagagcgtcacagggggaggaactgctcagttaggacccagagggaaccatggaagccccagctcagcttctcttcctcctgctactctggcctcccagtcgaccaccgganaaattgtgttgactacgagtcctccacgcccaccctgttccttgtcctccgaaggggaaancgcccacccttctcctgcgacggccagtcagtaggttgttcggacctaccgttacgtacgccgtacggtaaccaaacacgtaactcccgtcggacccgtacggtcccttacccgaggtccctttccctacgttattttagacgtacgttcgacctacgtacccgaaacggacccgggccctacggttcggaccccgtacccgacgtcccgtagggtttaccgaagggttccggacggttagggtacgggttcgtacggggacctacggttaccctttcgacccttcacccgtaccacgtacgaacgccgtacgtacctaggactacccgttaggttaaacgtttcgttttagtaccttttaagttttacgtagttcgtacgagtaccgtagtccggttaaccgaggttagttccggtttcttaccgtcgttaccgggttgggaccggacggtaacgtagggcgaacgcggtaaacggacgtacgtcgggacgtacgcgtaccgtaacttgtccgttactaccctttctccctttcccggtccc

SEQ ID NO: 217443 - DNA, 726 bp, Homo sapiens
  misc_feature: GYAE6OF01AH27E.9.3.A03.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtggaccaccggagaaattgtgttgacacagtctccagccaccctgtccttgtctccgaggggaancgccaccctctcctgcagggccagtcagagtgttggcaccgtacgtagcctggtaccaacagaactccgtggccaggcctcccgaggcctcctctatttacngatgctactacccaacgacgggcctacgtcggccgtcccagcccgtaggttcaggtggctaggtcgggtctggggactaggtacctttcgaccttctaccgaccctatccgacgcctacgtaccctacggacgtcccgttaggtaacgttattttacggtactttaatttttaactttacgttcgtacgtacgtacgtaggtccgtacgtaccgtaacgggttcggtcgtttaccgttaccgtaccggttttacggggaccgggtaacggggtaaccggtaacggggttacgggaaccggtaacccggtaacgggtaaccggtaaccggttcgggtacgggtaccgttccggacccgttaacccggtaccgtttaccggttaccgtttacccgtttacccgttaccgtttccccggtttacccccgg

SEQ ID NO: 217444 - DNA, 662 bp, Homo sapiens
  misc_feature: GYAE6OF01E035B.9.3.A03.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctgggtaccaacagaatccctggcccaggcctcccaggcctcctctattttangattcgactactaccaaacgcgggccacgtggccgtcccagcctaggttcaggtcggctaggtggtcgagggaccagtactttcacgtcctacgacctatccgacgtcacgtaccgtagaccgtacctagtaagttacgtttcgactttattttacttaccgtgtaccgtagaccgaggtccgtcgtaccgtaaggttcggttcctttaccgtaccgttaccgttttccggggaaccggggtaacgggtaaccgtaaggggtcggaaacgtaccggaaacggaaccggtaacgtcgggttacgggcttcggaccgtaaccttacttccgttacgtttacctttcctaccgttcccgttaacccccg

SEQ ID NO: 217445 - DNA, 824 bp, Homo sapiens
  misc_feature: GYAE6OF01DQGZ6.9.3.A03.1.454.CMB.1.raw
  modified_base (200)..(200): a, c, t, g, unknown or other
  misc_feature (200)..(200): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctccagtgaccaccggagaaattgtgttgacacagtctccacgcccacctgtccttgtcctaccgaaggggaaancgcccacccttctcctcgcgacgggccagtcaggtagtggttcggcctaccgtaccggttacgcccgttaggtaacccaaacgacgtaacgttcccgtcgggacccacgggtaccctccccgaagggtccctttacccttacttaatttttacgtaggtacttcggacctaacgttaccggaaaccggaccggggtccctaaccggttccgggccccgtacccgaacggtacccgtagggtttcgaacggttcgggcgttagggggttcgggttccggtacgggggaccctaacggtttacccttaccgtacccttccctaccgaacccttacgtaccgacgtaccgtaaccgtacgtaacggcgtacccgttaggtaaacggtttaacttttcgtaacttttaagttttactttacggtcgtacgtagacgtacggccgttaacgaccgtaaggttcggttcctttcgttaccgtccgggtttacgggacgggtacggtaacccggtagggtcggaaacgtaccgtagggtaaaccgtaccggttgggaacggttcgtaccggtaaccgtacccgtagtttacccgtttcggtacctttaacgtcccgtttcccgttaccccg

SEQ ID NO: 217446 - DNA, 909 bp, Homo sapiens
  misc_feature: GYAE6OF01ECO2Q.9.3.A03.1.454.CMB.1.raw
  modified_base (195)..(195): a, c, t, g, unknown or other
  misc_feature (195)..(195): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccgaggggaanagccaccctctcctgcgagggccagtcagagtgttggccacctacgtagcctggtaaccaacgagaactcctggcccgaggcctcccgaaggtcctcctactatttactggattgcctactacccaacggacggggccctaaccgtcgggtcccgtccccacggtaccctagggtttccaagggttcggacgtagggggttcggggttaccgtacgggggaacctacgtaaccgtttccgtaaccgttacccgttcccaaaccccgtacgttaccccgaaacggtcccaaccgggttaccctaaacgggaaccgggttacccccttaaggggttaaaaccggttttacgtttttttacggtaaccctttttaaacgtttttttaaacttttaaacccggttttcggttaaccggtaaacggttaccgtaaccggggttcggttaaccggtaacccggttaaagggtttccggttacccggtttttacccttacccggtttaaccggggtttttcccgggggaaccggggttaaccggggtaacccggtaagggggggttacccgtaaaaccgggaacccggtaaaaccgggtaaaccggttaaaccgggtttcggggtaccgggttaccgttacccgggaacccttaacccgttaacgttttcccgttagtttaccccttttccgttaacccgtttccccgtttaccccccggg

SEQ ID NO: 217447 - DNA, 962 bp, Homo sapiens
  misc_feature: GYAE6OF01D7QNZ.9.3.A03.1.454.CMB.1.raw
tcagtgatacgtctcacgaccggtgctcgatttagagagcgtcacgagggggaggaactgctcagttaggacccagagggaaccatggaagccccagctcagcttctcttcctcctgctactctggctccagtgaccaccggagaattgtgttgacacagtctccagccaccctgttccttgtcctccgaaggggaaagcgcccaccctctcctgccgacggccagtcagagttgttcgacctaccgtacgtagccgttaggtaaccaaagtagaacttcccgtcggacccgtacgggtcccttaccccgaacgggtccccttaccccgttacttaactttttaacgtacggtaacttccggtacctaaccgttaacccccgtaaaacgggaccggggtacccctaaccggttcggggtacccccgttacccccgtaacgggacccccgtttaaggggtttaccgtaacgggtttccgggacccggttaaggggtttcgggggttccggttaacggggggaaccctaaacggttacccttttcccgaaacctttcccgtaacccgaaccccgtaagtttacccgaaacggtcccgtaaccgggtacccgtaaaccggtaccggttcccgttaaagggttaacgttttaacgtttttacggtaccttttaaagttttttaacgtttaacccgtttacgttaaccgtaacggtccgtaaccggttccggttaccggtaacccgttaaacgggtttccggttaccctttacccggttaccggttaccgggttttaccgggggaacccggggttaaccggggtaaacccggttaaggggtaaccgggaaccggtaaccgaaaccggtaccggtaacgttacgggtaccgggtaccgttccggtaccaaccggttaccgtttcgtacccgtttacttaccccgttacctttcccccggttaaccccg

SEQ ID NO: 217448 - DNA, 801 bp, Homo sapiens
  misc_feature: GYAE6OF01D7E9D.9.3.A03.1.454.CMB.1.raw
  modified_base (771)..(771): a, c, t, g, unknown or other
  misc_feature (771)..(771): n is a, c, g, or t
  modified_base (784)..(784): a, c, t, g, unknown or other
  misc_feature (784)..(784): n is a, c, g, or t
tcagtgatacgtctcacgaccggtgctcgatttagagagcgtcacgagggggaggaactgctcagttaggacccagagggaaccatggaagccccagctcagcttctcttcctcctgctactctgctccagtgaccaccggagtaaattgtgttgacacagtctccagcccacccttgttccttgtcctccgaaggggaaagacgcccacccttctccgtgccgacgggccagtcagtagttggttcggacctaccgtacggtacgccgtacggtaacccaaacgaacgtaactcccgtacggacccgacgggtccctacccggaacggtcccttccttacttaatttttacgtcggtaacgttcggacctaaccgtaacccgaaaccggtaccggggaccctaaccggtcggggtccccttaccccggaacggtacccgttacgggtttaccgtagggttcgggtacggttacggggtcggggttaccgggtacggggaaccgtaacggttacctttaaccgtacccgttacccgtacccgtaaaccctacctaaccgaacggaccctaaccggtaccccgttaaggaacccggttacccgttaagggttaaacggttttacgttttttaacggtactttttaagtttttaaacctttccgttacgtacgtacgtacgtacgtcgtacggtacgtaggttcgtcttcctacgttcgtccgggacggaacgggtacgagggtacgacgacgacgacggtacgtcggagcgngactatcttcgtnttcttctctccgtaccg

SEQ ID NO: 217449 - DNA, 766 bp, Homo sapiens
  misc_feature: GYAE6OF01BYAGF.9.3.A03.1.454.CMB.1.raw
  modified_base (205)..(205): a, c, t, g, unknown or other
  misc_feature (205)..(205): n is a, c, g, or t
  modified_base (721)..(721): a, c, t, g, unknown or other
  misc_feature (721)..(721): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtgaccaccggagaaattgtgttgacacagtctccacgccacccttgtccttcgtcctaccgaaggggaaacncgccctaccctctcctgcgacgggcctagtcagtagtgttcgacctacctacgtacgtccgtaggtaaccaacgaagtaactccggtacggccaacggtccctacccgacggtccttccttactaacgttttataggaacttcgacctaaccgttacccgaaaccggtaccggggacccctaacgggtcggtcccggtaccccgacggtacccgtacgggtttcaacgggtggaccggtagggttcggggtctaggggaaccaggtaccttccgacttccaacctactatccgaacggcaacgtacctaacggacgtaccgttaagtaacgtttacttttacggtaacttttaagtttttaacttacgttacgtacgtaaggttaccgtaggtcgtacgacggtaacggttcggttcttacccgttacgtttaccgggttccggggacgggtaacgggaccgtagggtaaccggacgtacgaaaccggtagtacggtggtggtaacctcggacccncgtaccgttacttacgttacctttacgtccgttccccgttacccg

SEQ ID NO: 217450 - DNA, 674 bp, Homo sapiens
  misc_feature: GYAE6OF01A74RR.9.3.A03.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagagtgttggcacctacgagcctggtaccaacagaatcctggacccaggcctcccgaggtcctcctctatttagngtatcgcataccaacgcgggccacgtcggcctaccagccgtaggttcaggtcggacgagggttcggtcgtggggaactagtacttcactcacctaaccgatcgacgacacgtaccctaaggaccgtaccgtaagtaacgtttacttttacggactttaatttttaacttaccgttgtacgtacgtccgtaacggtccggtacgtacccgtaaggttcggtacctttccgtaccgttaccgggtttccggggaccgggtaacggggtaaccggtaacgggtgggaaccgtaccggacggtaaccgtacggttggtacgggacgttccggacctaacctcgttacgtttctacctttacgtaccgtttcccgtaccccg

SEQ ID NO: 217451 - DNA, 775 bp, Homo sapiens
  misc_feature: GYAE6OF01AH7Q9.9.3.A03.1.454.CMB.1.raw
  modified_base (206)..(206): a, c, t, g, unknown or other
  misc_feature (206)..(206): n is a, c, g, or t
tcagtgatacgtctcacgaccggtgctcgatttagagagcgtcacagggggaggaactgctcagttaggacccagagggaaccatggaagccccagctcagcttctcttcctcctgcctactctggcctcccagtcgaccaccggagaaattggtgttgacactagtctccacgccacccttgtccttgtcctaccgaaggggaanacgccctaccctctccgtgaccgacgggccagtcagtagtgttacgacctaccgtacgtgtccgtacggtaacccaacgaagtaccttccgtacgggaccctaacgggtccccttacccggagggtcccttaccgttacttactttacgtcggacttccggaaccgtaacctacccgaaacggtaccgggtcccacggtcgggtaccctacccgaacgtccgtaacgggttcgaacggtcggactggggtcggtacggtacggactaacggtctaccgtaccgtctaccgtacgactaccggtacgcctaacggtaccgtaaggtccgtacgtacgtaactttcgtttaccgtacgtttaacttttacgtaaccgtcggttacacggtacgtacgtccgtaaccgtacgttacgtcgttaccttacgttaccggtacgggtttccggaaccgggttacgtaacggtacgggtaccggaccgtacggaaacgtacgggtacgttcggaccgttggtacccgaccgttaacctcggttccgttattaccgttacgtccgttcccgtacccg

SEQ ID NO: 217452 - DNA, 747 bp, Homo sapiens
  misc_feature: GYAE6OF01AYHDO.9.3.A03.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccgaggggaanacgccaccctctcctgcagggccagtcagagtgttggcacctagtagcctggtaccaanagaactcctggccaggcctcccgaggccttcctctattttatcgatcggactaatcccgaaacgtcggggcccacgttcggccttaccccaggccctagggtttccagggttcggcgtagggttcgggtcctagggggactacggtacctttcgaaccttcctaccaaccgtatccgaacgcctaacggacccttacgacgtcccgtacggtaaacgttacgtttttaggtactttaatttttaaccgtttacgtttacgttaccgtacgtacgtacggtaccggttacgtaccgtaaacggttcggtcctttaccgttaccgttacccgggtttccggggtaccgggttaacgggtaaccccgggtaagggttaccgggaaccgtaacccggtaacggtaacccgggtaacggtacggttacgggacccgtacgacccgtaaccctacgttacgttccgttaccttacccgtaccgtttccccgttccccgg

SEQ ID NO: 217453 - DNA, 714 bp, Homo sapiens
  misc_feature: GYAE6OF01C8LTD.9.3.A03.1.454.CMB.1.raw
  modified_base (347)..(347): a, c, t, g, unknown or other
  misc_feature (347)..(347): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
  modified_base (533)..(533): a, c, t, g, unknown or other
  misc_feature (533)..(533): n is a, c, g, or t
  modified_base (545)..(545): a, c, t, g, unknown or other
  misc_feature (545)..(545): n is a, c, g, or t
tcagtgatacgtctcacgaccggtgctcgatttagagagcgtcacgagggggaggaactgctcagttaggacccagagggaaccatggaacgccccagctcagcttctcttcctcctgctactctggcctcccagtcgaccgacggaataattgtgttgacacagtcctccacgcccacccttgttcccttggtcctaccgaagggggaaacacgccccacccttcctccgtcgacgacgggccagtcgaggtaggttggttcggacctaccgtacggtacgtcccgtaggtaaccaacgaacgtaactcccgtcggccgaggtcctacccgaggtcccttaccgtnttaactttgtactagttacggacctaaccgtacccgaacggtaccgggaccctaccggtccgggccccttaacccgacgtacccggttacggttacgtaccggggttggacccggttaggtcgggtaccgaggggtaaccacgtacttaccgactcgtaccactntacgacncgactacgtagacncgtataacgttntttacgtactttatttactagttacgactaggcctaggtccgtagtaccttagggcgtttccttacgtccggttaccggttcgggaccggtaaggtacgaagggtggaaacacgaaggaactcggtgcgacgtacgctacgttcgtctacttcctacttcgcccgttcc

SEQ ID NO: 217454 - DNA, 843 bp, Homo sapiens
  misc_feature: GYAE6OF01C7PAQ.9.3.A03.1.454.CMB.1.raw
  modified_base (201)..(201): a, c, t, g, unknown or other
  misc_feature (201)..(201): n is a, c, g, or t
  modified_base (317)..(317): a, c, t, g, unknown or other
  misc_feature (317)..(317): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgttcccttgtctccgaaggggaaancgcccaccctctcctgcgacgggtccagtcaggtagtgtggcactacgtagcctggaccaagacgaactccgtcggaccgacgggcctacccgacggtcctccgttctacttttancggtatcgtactacctaacccaaccggacggtacccgtaaccggtcgggtacccgttcccggaacggtacccggttacggtttaccgaacggggttcgggaccggtacgggttcgggggttccgttacgggggaaacccgtaacggttaacccgttttcctaaccggttaccctaccctacccggtaattccggaccggtagaccgtaccgtaacggtaccgacccgttaaggttaacggtttaagtttttaccgtaacgttttttaagtttttaaccgtttacgtttccggtaacgttaacggtacgttaacgggtccggtttaacgtcccgtaaacgggttccgtttaccgtttacgtttacccggtttacgggttttaccggggacgggttaaccgggtaaccgggtaggggttaccggaaccggaaacgacggggttaacggaaccggttggaccgggtacgtaccgaccgtaacctacggtttaccttccgttaccctttacgcctttccccgttaccccg

SEQ ID NO: 217455 - DNA, 848 bp, Homo sapiens
  misc_feature: GYAE6OF01D66C0.9.3.A03.1.454.CMB.1.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
tcagtgatacgtctcacgaccggtgctcgatttagagagcgtcacagggggaggaactgctcagttaggaccagagggaaccatggaagccccagctcagcttctcttcctcctgctactctggctccagtgaccacggagaaattgtgttgacacagtctccagcccacctgtccttgtctccgaaggggaanacgcccaccctctcctgcgacggccagtcagagtgttgcacctagtcgcctggtaccaacngaactcctggccaggcctccgaggtctccgntactttanagtattgcactaccgtaacgacggaccacgtcggcctaccgacgtaccgtacggttacaggtcggacgtaggttgggtcgtacgggactacgtacgttacaccgttccgtaccacccgtaatccgaacgccgtaacggtccctaagggaccgttacccgtaaggtaaacgtttagtttttacggtacctttaaagttttttaacttaaccgggtttacgttaccggtaacggtcccgttaacgggtcccggtttacccgtaacccggggttaaacggttttccggggttacccgtttttaacccgttaccgggttttaacccgggtttttaacccgggggggaaccggggttaaacccggggggaaccccggtttaaggggttaccgggggaaaacccggttaaaacccggtaaccggggtaaaacccccggttacggtttaaccggggggttacggtacccggtttccggaaaccgttaccccgtaaaggttttccccgttaaccggtttcccttttaaacccggttccccgtttccccgtttaaaccccccg

SEQ ID NO: 217456 - DNA, 931 bp, Homo sapiens
  misc_feature: GYAE6OF01BBK3P.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtcgaccacggagaaattgtgttgacacagtctccagccacctgtccttgtctccgaaggggaanacgccacccttctccgtgcacgggccagtcaagagtggttcggaccaccgttacggtacgtccgtacgggtaacccaaacgaacgaactcccgtcgggacccgaacggtcccctacccgaacgggtcccttacccgttacttaacgtttttaacgtcggtaatcggtacccttaaccgtaacccgtaaaccggtaccggggacccctaaccggttccggggtaccccgttacccccgaaccgggtaccccgttaggggtttaccgaacgggttcggggaccgttaagggggtttccggggttacgttacggggggaacccgtaacggttacccgttttaccccgtaaccgttcccgtttacccgaaccccgttaaacgttccggaacgggacccgtaacccggtaccccgtttaaaggggaccgttcccgttaacgggttaaacggtttaccttttttacggtaacctttttaacttttttaacgtttaccgttaccgtttacgacggtaccgtacgggtaccggttacggtacccggttaacgttcggtttacccgtttaacgttcccgggtttaacccgggtttaccgggggtaacccggggttacgggtaaccgggtaaccggggtacgggacgtaacccggtaaacggtacggtaacggtcgggttacgcgtcggaccctaccgttacgttaccgtttacgttaccttaccgttaccgttcccgtaccccg

SEQ ID NO: 217457 - DNA, 689 bp, Homo sapiens
  misc_feature: GYAE6OF01BWVB4.9.3.A03.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctcgaggggaaangcccaccctctcctgcgaggccagtcagagtgttggcacctacgtgccgtggtaccaagagaactcccgtaggccaggcctcccgaggcctcctcgtattttacngtaattcgactactacccgaacgacggggaccctaacgtcggcccggtcccaggtacccgtacggtttacaggtcggaccgtaggtgggtcggtagggacacgtacgttcacgtctacccccatactcaacgctacgaccgtagacgtcgtagtaagttagttttcgtacgttacgttttaattaccgttagttcctaagtcgtacggtcgttacgtaccgtaagggttcggtacctttccgtaccgttacggttcccgggacggggtacggaacccggtaaggggtcggaacggtaaccgaggaaaccggtaacggtcggtcgggtactacggaccgtaccctagtttccgttacggttcctttaccgtaccttccccggttacccg

SEQ ID NO: 217458 - DNA, 824 bp, Homo sapiens
  misc_feature: GYAE6OF01CX0V5.9.3.A03.1.454.CMB.1.raw
  modified_base (146)..(146): a, c, t, g, unknown or other
  misc_feature (146)..(146): n is a, c, g, or t
  modified_base (162)..(162): a, c, t, g, unknown or other
  misc_feature (162)..(162): n is a, c, g, or t
  modified_base (224)..(224): a, c, t, g, unknown or other
  misc_feature (224)..(224): n is a, c, g, or t
tcagtgatacgtctcacgaccggtgctcgatttagagagcgtcacaggggagaactgcgtcagttaggaccagaggaaccatggaacgcccagctcagtcttctcgttcctcctgctactctcggcctccagtcgaccgaccgganaaattgtgttgacacngtcctccacgacccaccgttcgtccttcgtcgtaccggaagggaagaccgacccacccttcnccgtacgaccgacggacctagtacgagtacgttcggttcggacctaaccgtacgtacgtaccgttacggaaaccaacgtaacgtaacgttcccgtcggacccgtacgtacccttacccgcggttacccttaccttacgtaactttacgacgtaactcgactaacctaccaacggtacggtccacggtcgaccgtacccgacggtacgtacgttcgaggtcgtcgtggttcggtcgtacggtacacgttaccttacgccttcgactacgtactacgacgtcccgaacttccgtaacgaccgttacgtacggtaacgttagtttacgttacgtttaacgttttaacttacggtcttacgtaacgtaccgtagtaccgtacggttaacgtacgtttcggttacttaccgttacccgttacgggtttaccggggtaccgggtaccgggtaacgggtacgggtacggttaaacccgggaacgtaaccgggttaacggtaaccgggtttcggtaccgggttacgtaaaccggtaaccccttacgggttacctttacccgtacccggtttacctttaaccccgtcccgttttccccggtaaaccccg

SEQ ID NO: 217459 - DNA, 657 bp, Homo sapiens
  misc_feature: GYAE6OF01BMDMK.9.3.A03.1.454.CMB.1.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
  modified_base (640)..(640): a, c, t, g, unknown or other
  misc_feature (640)..(640): n is a, c, g, or t
tcagtgatacgtctcacgaccggtgctcgatttagagagcgtcacagggggaggaactgctcagttaggacccagagggaaccatggaagccccagctcagcttctcttcctcctgctactctggcctcccagtgaccaccggagaattgtgttgacacagtctccagcccaccctgtccttgtcctccgaaggggaaancgcccaccctctcctgcgagggccagtcagagtgtgcacctacgtgcctggtaccaacagaactccgtcggccacggccctcccgaggtccttcctacgtatttacgnggacttcggacaccgttacccgaaacggaccggggccctacggtccgggacccggtacccgacggtacccgtagggttcgacgggtcggacgtagggttcgggtcgaggggaaccacgtaccgttaccacttccacctaccagtccacggtccacggtaccgtaacggacgtaccgtaggtaagtttagttttcgtactttagttttactacgttcgtacgagtccgacggtcgtacgaccgtagtcgtcttacgtcgtacgttcgggacggtacggacgagggagacgacgagacgtacgtcggtagcgtcgactaccagttcgtacgttntactcgttccctacccg

SEQ ID NO: 217460 - DNA, 664 bp, Homo sapiens
  misc_feature: GYAE6OF01EIAIS.9.3.A03.1.454.CMB.1.raw
  modified_base (316)..(316): a, c, t, g, unknown or other
  misc_feature (316)..(316): n is a, c, g, or t
  modified_base (425)..(425): a, c, t, g, unknown or other
  misc_feature (425)..(425): n is a, c, g, or t
tcagtgatacgtctcacgaccggtgctcgatttagagagcgtcacgagggggaggaactgctcagttaggacccagagggaaccatggaagccccagctcagcttctcttcctcctgctactctggctcccagtgaccaccggagaaattgtgttgacacagtctccagccaccctgtcccttgtcctccgaaggggaaagacgcccaccctctcctgcacgggccagtcagagtgttggcacctacgtagcctggtaaccaacacggaacttccgtggaccacggtcctacccgaggtccttcctactattttanggtaattcggacacgtaccaacgacggggcccaacgtcggccgtccacgccgtaggttcaggtcggctaggtcggtcgtagggacacgtacttcactctcacgatcgancgacgctacgacgaccgtagtaagtatttacgacttaattttacttacgttacgtactacgtcgtacggtcgtacgacgtaacggttcgtactttacgtccgttaccgggtttacgggacgggtaacgggtaccggtaagggtacgggaaccgtaaccgtaacggaaccgtacggtacggttacggcgtacggaccaccgtacgttacgttcttaccttctaccgttcccgttaccccg

SEQ ID NO: 217461 - DNA, 791 bp, Homo sapiens
  misc_feature: GYAE6OF01EB0A6.9.3.A03.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccgganaaattgtgttgacacagtctccagccacctgtccttgtctccgaaggggaanacgccaccctctcctgcagggccagtcagagtgttggcacctacgtagcctggtaccaacagaactcctggccaggcctcccgaggccttccgtctaattttacagtattgactactaccaacgacgggccacgtcggccgtcccagcctaggttcaggtggactaggtcgggtacgtggggactacggtactttcgaccttcctaccgacctaactcgaacgtcctaacggtccgttaacggaacgtcccgtaaggtaagtttacgtttttaggtacctttaagttttttaacgttaccgttagttacccgtaagtaccgtacggttaccggtacgtaacccggtaaacgggtttcgtacccgttttaccttacccggttaccgggtttttaccgggggaaccgggttaaccggggtaaacccggtaaggggttaccggggtaaacccgaacccgggttaacgggaaaacccgtttacccgggttagggtaccgggttacccgttacggaaccccgttaaccccgttaacgtttaccgtttacccgggtttacccttttacccgtaacccgttttcccccggttaaccccccgg

SEQ ID NO: 217462 - DNA, 752 bp, Homo sapiens
  misc_feature: GYAE6OF01EAEFJ.9.3.A03.1.454.CMB.1.raw
  modified_base (332)..(332): a, c, t, g, unknown or other
  misc_feature (332)..(332): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtcgaccacggagtaattgtgttgacacagtctccacgcctaccctgttcccttgtccgtaccgaaggggaaagacgccccaccccttctcctgcgacgggccagtcagagttgttcggctacctacgtacgccgtaggtacccaaacagaactccgtcggaccgacggcctacccgacggtccttcctacttatttacngtaattcgacctactacccaacggtccggggacccacggtcgggccctccgacgccgtaggttccgaggtcggctacgggtcgggtacgtacgggacacgtaccttcaaccttcgtaccacctacgtacacggacctacggtaccgtacgtacgtacccgtaaggtaacgtttattttaccgtactttaacgtttttacgttacgttggtaccgacgtcgtaacggtccgtacgtaacgtacgggtcggttaccctttaccgttaccggtttacggtttaccggggacgggttaaaccggggaccggtaagggtaccggtaacgaccggaaacggttaccggtaaacgtcgggtcggtaccggtacgacccgtaccctacgttctaccggttcccttacgtacccgttccccgttacccg

SEQ ID NO: 217463 - DNA, 890 bp, Homo sapiens
  misc_feature: GYAE6OF01AYUS2.9.3.A03.1.454.CMB.1.raw
  modified_base (197)..(197): a, c, t, g, unknown or other
  misc_feature (197)..(197): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccacctgtccttgtctccgaggggaaancgcctaccctctcctgcacgggccagtcagtagtgttggcctaaccgtacggtagcctaggtacccaacagtaactccgtaggccaaggcctaccccgaggtcccttcctaccgtaatttacgtacgtatcggcctaacttaccccgaaacggtacggggaccctcgtaccggggtcccgtccccgaaggcccgttagggttaccgtaggtcggtacgtacggggttcgggttctacgggggactaaccgggtaccttttccgaccgttactaccccgtaaaccgtacgttaccgtaacgtacccggaaccgtccggttaacggtaaccggtaccgtacgggttaaacgtttacgtttttaccggaaccttttaaacgttttttaaccgtttaaccgttttacgggtaccgttaacgggttaacccttaccggggtaccgtttaacccgggacgttaaaccgggttccggttaccgttttaacccgttacccggttaacccgggtttttacccgggggaccggggttaaacccgggtaaacccgggtacgggttaaccggggtaaccggtaaccggtaaaccgggtaaccgggtaaaccggttcggggacgggttcccggtacggtacccgttaaccgttcggttacccgtttcggtttaacctttccggttaacctccccggtttaccccgg

SEQ ID NO: 217464 - DNA, 656 bp, Homo sapiens
  misc_feature: GYAE6OF01BMASR.9.3.A03.1.454.CMB.1.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (318)..(318): a, c, t, g, unknown or other
  misc_feature (318)..(318): n is a, c, g, or t
  modified_base (427)..(427): a, c, t, g, unknown or other
  misc_feature (427)..(427): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccgagggaaancgccaccctctccngcagggccagtcgagagtgttcggaccaccgtacgtacgccttagggacccaaacgagaacttcccgtggaccgaggccctacccgaggtccctcctacgtattttacnggtatcgtactacgtacccaacggacggtcctaacgtcggccgtacccgtaagcccgtaaggttccaaggttcggacgtaggtcggtcgtgggactagtcttcacttcncactactacacgcaccgtcgacgtcgtacgtaagacgttatttcggactttagtttactacgtgtacgacgcgtagtcgcgtacgtagttcgtcctttacgccttacgggttccggaacgggtaacggacgtacgggtaggaccgtacggtaaacgaccggttaagtcgggtacgccgtagacctacgtcgtttcctacggttaccttaccgtccgttcccgttacccg

SEQ ID NO: 217465 - DNA, 814 bp, Homo sapiens
  misc_feature: GYAE6OF01ANRLV.9.3.A03.1.454.CMB.1.raw
  modified_base (420)..(420): a, c, t, g, unknown or other
  misc_feature (420)..(420): n is a, c, g, or t
tcagtgatacgtctcacgaccggtgctcgatttagagagcgtcacaggggaggaactgctcagttaggacccagagggaaccatggaagccccagctcagcttctcttcctcctgctacctcgtcgcctccagtcgaccgacggaagtaagttgttgtagaccacagtcctcgacgccctacccgtcgttccttcgtccctaccggaaagggggaaacgaccgaccccctaccccgttccgttcccgtcggaccggaccggggaccctagtaccgaaggtacggttggtttaccggaccctaacccgttaccggtaccgtcccggttacggtaaacccaaacgtaacggtaacccttcccggtaccggacccgacggtccccttaccccggacggtcccttacccgtattacttttacgngtacgtcgacctacctacccgaacggtaccggtaccctacggtccgggtccccgtacccacggtaccgttacggttaccgagggtcggacgtaggggttcggtacgtgggaacacgttccttaccgacttcctacccaacctgtaccgacgaccacggtaccgtaggaccgtccgtaaggtacgtttagtttaccgtaacttttaacgttttaacgttcgttaccgtagaccgtacgtccgggtactaccgaccgttagggttacccgttcgttacctaccggtttaccggttcgggacggtacggaaccggtaggtacgacgaccgaagtaccggaagtcgagtcgaccgactacccgtagttccgtattaccctcttcccgttcccgtaccg

SEQ ID NO: 217466 - DNA, 685 bp, Homo sapiens
  misc_feature: GYAE6OF01CDKS0.9.3.A03.1.454.CMB.1.raw
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
  modified_base (313)..(313): a, c, t, g, unknown or other
  misc_feature (313)..(313): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccgaaggggaaangcccaccctctcctgcagggccagtcagagtgttggcaccgtacgtagcctggtaccaanagaatcctggccaggcctcccgaggcctcctctatttatgatgcatcccaacgngggccacgtggccgtcccagcctaggttcaggtggcaggtggtctggggacagtccttcgacttctcacctatcgaacgcaacgtccgtaagacgtaccgtagaagttagttttacgacttaagttttaacttacgttcgtacgtacggtacgtacggtaccgttacgtaccgtaaggttcggttacctttacgttccgttaccggttttccggggaaccgggtaacgggtaacccggtaaggggtacgggaaccgggtaacccgaacgggtaaccggtaaccggttcgggtacggtaccggttacgggaccctaacccgttacgttaccggttacgttaccgtttccgtaccgtttccccgttacccccgg

SEQ ID NO: 217467 - DNA, 881 bp, Homo sapiens
  misc_feature: GYAE6OF01BGREN.9.3.A03.1.454.CMB.1.raw
  modified_base (231)..(231): a, c, t, g, unknown or other
  misc_feature (231)..(231): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtcctaccgaaggggaaagcgcccaccctctcctgcgacggccagtcagngtgttggcacctacgtacgcctggtaaccaacagaactccgtggaccaggcctcccgaggtcctcctactatttatgatcgactactaccgaacggacggacccacggtcggcccgtaccgagaccgtaggtacgtaggtggaccgtaggggttcgggtacggtacgggaaccgtacggtaaccttttaccgaacccgttccctaacccgtaacccgtaacgttacccggaaccgaacccggtaccggtaacccgttaacgggaaccggttaacccggttaagggttaaacgtttttaacgtttttaccggttaaacctttttaaacgtttttttaaaccgtttaccgtttacggttaccgtaacgggttacccgtaacgggttacccgggtttacggaacccggtttaacgggtttaccggttacccgttttacccggtttaccggtttaaccggggttttaccccggggggaacgggggttaaacccggggaaccgggttaaacgggggtacgggaaaccgggtaacccgtaaacggggtaaaccgttaccggttaggggttacgggtacccgttacggaaccccgtaccgttacgtttcccggttacgttttcccgtacccgttacgtttcccccggttaaccccgg

SEQ ID NO: 217468 - DNA, 716 bp, Homo sapiens
  misc_feature: GYAE6OF01EYF2F.9.3.A03.1.454.CMB.1.raw
  modified_base (195)..(195): a, c, t, g, unknown or other
  misc_feature (195)..(195): n is a, c, g, or t
  modified_base (306)..(306): a, c, t, g, unknown or other
  misc_feature (306)..(306): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccgaggggaancgcccaccctctcctgcgagggccagtcagagttgttggcctacctacgtacgcctaggtaaccaacagaactccgtggccaggcctcccgaggtcctcctactattttangtatcgcactaccgaacgacgggcccacgtcgggcccgtacccaggcccgtaggttcgaggtcggactaggggtcgggtacgaggggacaggtacctttcgactccacaccatcgacgaccacgtccgtagacgtacctaggtaacgtttattttacgtactttaattttaacgttacgttacgtacgtacggtacgtacggtccggttacggtaacccgtaagggttcggttacctttaccgttacccgttaccgggtttaccggggaccggggtaacgggtaacccggtaaggggtacggtaacggaacccggtacgggtaaaccggtacggtcgggttacggaccgtacggaccctacgttacgttccgttacgtttaccctaccgtacccgtttcccgtacccccg

SEQ ID NO: 217469 - DNA, 840 bp, Homo sapiens
  misc_feature: GYAE6OF01E0HON.9.3.A03.1.454.CMB.1.raw
  modified_base (197)..(197): a, c, t, g, unknown or other
  misc_feature (197)..(197): n is a, c, g, or t
tcagtgatacgtctcacgaccggtgctcgatttagagagcgtcacgagggggaggaactgctcagttaggacccagagggaaccatggaagccccagctcagcttctcttcctcctgctactctggctccagtgaccacggagaattgtgttgacacagtctccacgccaccctgtccttgtctccgaaggggaaancgccaccctctccgtgcgagggccagtcagagtgttcggacctaccgtacggtacgcctagggtacccaaacgagtaacttccgacggtcccgaagggtcccttccccgaggtcccttaccgtactaactttttacgaggtaacttacggacctaaccgttacccgaaaccggtacggggacccttaaccggtccggggtacccgtacccccggtaacgacccggttaacgggtttaccgaacggggtttacgggaccgttaacggggtttcggggtaccggtttaagggggaaccgttaaccggtaccgtttttaccgaaaccgttttcccggtaaccctaaacccggtacgtaccgaaacggtacccgtaacggtaccgttacggaacggtaacccttaaggtaaacgtttacgtttttaacggtactttaaacgtttttacgttaaccgtttcgggtaacgtacgttaccggtaacggttccgtaacgtacccgtaagggttccgtactttacgttcgtaccggtttcgggacggtacggaccgtaaggggtcgaacggtaccgtaagggaaccgttagtcggtaggtccgtagaccgtaaccgtattccgtcttaaccgttcctacgtccgttaccccg

SEQ ID NO: 217470 - DNA, 714 bp, Homo sapiens
  misc_feature: GYAE6OF01AW0BN.9.3.A03.1.454.CMB.1.raw
  modified_base (674)..(674): a, c, t, g, unknown or other
  misc_feature (674)..(674): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagtaaattgtgttgacacagtctccacgcccaccctgttccttgtctaccgaaggggaaagacgcccaccctctcctgcgacggccagtcaggtagtggttcggcctacctacggtacgaccgtacgggtaacccaaacgagtaacgtcccgtacgggacccgaacgggtcccctacccggacggtcccttacccgttacttaattttaacgtcgacgttacgacctaacgtaacccgaaccggtacggggacccctacggttccggacccgtaccccgacggtacccgtacgggttcgacgggttcggcgtaacgggttgggtaccgtacgggactacggttacctaccgtactccgtaccgacctatcgacgtcgacgtaccgtagtacgtacgtagtacgttagtttacgtatttacgttttactacgtcgtacgtacgcgtacgtcgtacgtacgtaagtcgttctaccgttcgtaccggttcgggacgtacggacgtagggtcgacgagacgacgtacgtcgtgtcncgacgtacgtattccgtacttctacctcgttcccgtaccg

SEQ ID NO: 217471 - DNA, 671 bp, Homo sapiens
  misc_feature: GYAE6OF01EZVQX.9.3.A03.1.454.CMB.1.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
  modified_base (319)..(319): a, c, t, g, unknown or other
  misc_feature (319)..(319): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaattgtgttgacacagtctccagcccacccttgtccctttgtcctccgagggggaaancgcccaccctctcctgcgagggccagtcgagagttgttcggacctaccgtacggtagcctaggtaacccaaacagaactccnggccaggtcctcccgtggcctcctactattttacngtatcgacactccgaaccgacggggccctacgtcggcccgtcccacgccgtaggttcaggtggcgtaggttcgggtacgtggggactaggacctttcgaccttcctcaccgatcgacgacgacgtacgtagacgtcctagtagttatttacgtactttattttaacttacgttagtacgagtacgacggtacgtcgacgtaagtcgttcttccttaccgttacggttaccggggacggtaacgggaacccggtaacgggtaggaccggtaaccgaacggaacgtaacggtagtcgggaccgtcgaccctaacgtacttccgttcgttacctttcctaacttcccgttacccg

SEQ ID NO: 217472 - DNA, 578 bp, Homo sapiens
  misc_feature: GYAE6OF01AOANS.9.3.A03.1.454.CMB.1.raw
  modified_base (197)..(197): a, c, t, g, unknown or other
  misc_feature (197)..(197): n is a, c, g, or t
  modified_base (419)..(419): a, c, t, g, unknown or other
  misc_feature (419)..(419): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagngccaccctctcctgcagggccagtcagagtgttgcacctacgtagcctggtaccaacagaactccgtggccaggcctcccgaggcctcctcatttatgatcgcactcccaagcgggccacgtcggccgtcccagccaggttcaggtggcgaggtcgggtcgtacgggacaggtaccttcgacctcgtaccaccatcagctacgcctagcgtcctagaagttntttgacttattttagtactgtactaggtctagcgtcgacgtagtcgtcttctcgtacggttcggacggtacgggaccgtaagggtcgacgacgtacgaccgtaagtcggtaggcgtcgaccgtacgtattccgtcttccttactccgtcccgttacccg

SEQ ID NO: 217473 - DNA, 564 bp, Homo sapiens
  misc_feature: GYAE6OF01E1COU.9.3.A03.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (423)..(423): a, c, t, g, unknown or other
  misc_feature (423)..(423): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagccaccctctcctgcagggccagtcagagtgttggcacctacgtagcctggtaccaacagaactcctggccaggcctcccgaggcctcctctatttangatgcatccaacgcgggccacgtcggcctccagccgaggttcagtggcaggtggtctgggacagtacttcacttctcacctatcagcagcctagacgtcctgaagttatttgacttattttatactntacagtctagcgtcgacctagtgtcctttacgtcctacgtttcgggcggtacgggtaccgagggtcggagaaccgaggaacgtacgtggtacggtcgtgacctaccgacttcgttacgttacctcttctcccgttaccccg

SEQ ID NO: 217474 - DNA, 808 bp, Homo sapiens
  misc_feature: GYAE6OF01CGQUU.9.3.A03.1.454.CMB.1.raw
  modified_base (332)..(332): a, c, t, g, unknown or other
  misc_feature (332)..(332): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaattgtgttgacacagtctccagcccacctgtccttgtctccgaaggggaaacgacgccctaccctctccgtgcgacgggccagtcaggagtgttcgcctaccgtacgtcgccgtacggtaaccaacagaacttcccgcggcccgtaagggcccttacccgacggtccttccctacgtaacttttagngtactgacctaacgtacccgtaaccgacggggtcccaacggtcgggtcccgtaccccgacggtacccggtacgggtttaccggagggtcgggaccgtagggggttacgggttacggacggggtaaccgtacggttacctttaccgtaccttacctaaccgaccctacgttacgaacggtaccgaccggttacccgtaaggtacccgtaccggttaagtaaacgtttacgtttttacgtaaacttttaatttttaacgtttacgtacgttacggaacgttcggacggttcgtaaccggtaccgttacggttcggttcctttaccgtaccggttaaccgggtttcggggaaccgggttaaccgggtaaccggtaggggtaacggaaccggtaacgacggtaaccggtaacggtcggtaggtacctcgaccctaccgttacgttccgttcgttaccttcccgttcttccccggttaccc

SEQ ID NO: 217475 - DNA, 786 bp, Homo sapiens
  misc_feature: GYAE6OF01BFLUI.9.3.A03.1.454.CMB.1.raw
  modified_base (201)..(201): a, c, t, g, unknown or other
  misc_feature (201)..(201): n is a, c, g, or t
  modified_base (749)..(749): a, c, t, g, unknown or other
  misc_feature (749)..(749): n is a, c, g, or t
  modified_base (763)..(763): a, c, t, g, unknown or other
  misc_feature (763)..(763): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagtaaattgtgttgacacagtctccagccaccctgttccttgtcctaccgaggggaaancgccaccctctcctgcgacgggccagtcagagtgttcggccaccgtacgtacgccgttacggtaacccaacgagtaactcccgttacggacccacgggtcccttaccccggaacggggtcccttcccgtaccttaagtttttaagtcggtaagttcggtaccaaccgttaaccccgaaacggaaccggggtacccccaacgggttaccgggaccccggttacccccgaaccgggtacccgttaacggggtttccgaacgggttgggaccgtaggggttcggggttaccggtacggggaacccgttacggacccgttttacctaaccgttcctaccctaaccctagtaccctacggaccgtaccggtaccgtacgacggtacccgtaagtaacgtttagttttcgtaacctttagtttttaacttaaccgttacgtttacgacgtacgtacgggtcgtacgtaccgtaggtacggtccttcgtacgtacggttccgggacgggtacggaccgtagggtacggaacgtacacggagtaccgtggtacggngtcacgtacacgtntccgttctactcctccgtacccg

SEQ ID NO: 217476 - DNA, 885 bp, Homo sapiens
  misc_feature: GYAE6OF01CJNAA.9.3.A03.1.454.CMB.1.raw
  modified_base (198)..(198): a, c, t, g, unknown or other
  misc_feature (198)..(198): n is a, c, g, or t
tcagtgatacgtctcacgaccggtgctcgatttagagagcgtcacagggggaggaactgctcagttaggacccagagggaaccatggaacgccccagctcagcttctcttcctcctgctactctggctcccagtcgaccacggagaaattgtgttgacacagtctccacgccacctgtccttgtctccgaagggaaancgccaccctctcctgcgacgggccagtcagtagtgttcggctaccgtacgtacgcctaggaaccaagaacgaactccgtaggcccacgggcctacccggacggtccttccgtactattttacgtcgtaacgtcggtacctaaccgtaacccgaaacggaccggggtaccctaacgggtccgggtaccctaccccgacggtacccggtaacgggtttcgaacgggttcggcggttaacggggttcggttccggtaacggggtaacctacggtaacctttccgtaaccttccgttaacccgaaccgttaacgtccggtaaacggccgttaaaccggtaacccggttaacggtaaaccggttaccggttaaggttaaaacgtttttcgttttacccggtaaatttttaacgttttttaaacgttccggttacggttaccgtaacggtaccgttaacggtccggttaaccgtaaccgttaacgggtttccgttaccgtttaccggtaaccgtttacccggggtttaccggggaacggggttaaaccggtaaccgggtaaacggggtacggaacccgggtaaacctaaacgggtaaccggttaaacggttcggtacggacccgttacgaacccgttaaaccgtcgtttccgttaaccggttccttaaccgttcccgtttcccgtaaaccccg

SEQ ID NO: 217477 - DNA, 788 bp, Homo sapiens
  misc_feature: GYAE6OF01EQ88Y.9.3.A03.1.454.CMB.1.raw
  modified_base (206)..(206): a, c, t, g, unknown or other
  misc_feature (206)..(206): n is a, c, g, or t
tcagtgatacgtctcacgaccggtgctcgatttagagagcgtcacagggggaggaactgctcagttaggacccaggagggaaccatggaagccccagctcagcttctcttcctcctgctactctggctcccaggtcgaccaccggagaaattgtgttgacacagtcctccagcccacccttgttccttgtcctccgaaggggaaancgccctaccctctcctgcgagggccagtcagacgttgttcggcctaccgtacgtacgccctaggtaacccaaacgagtaacgttcccgtacgggcccgacgggtccctaccccgagggtcccttaccctcttaatttttacgtgtaacttcgacctaaccgttacccgaaacggaccggggtccctaacggtccgggtaccccgtacccgacggtcccgtaggtttacgaggttcggcgtagggttcgggtcgtaggggaaccacgttacgtttccaaccgttctaccaccgtactacgacgtccgtaacgacccgttaagaccgtaccgttaaggtaacgtttacgttttcgaacttttatttttaacgttacgttcgtacgtacggtaccgtacgtccgtacggtaccgtaggttcggttaccctttcgttaccggttaccgggtttaccggggaccgggtaacggtaaccggaaggggtccggaaacggaccgtacgggaaccgttaaggtcgggtacgtaccggtcggaccctaccgttacgtttcgttacttccttacttccgttccccgttacccg

SEQ ID NO: 217478 - DNA, 934 bp, Homo sapiens
  misc_feature: GYAE6OF01AO9D0.9.3.A03.1.454.CMB.1.raw
  modified_base (200)..(200): a, c, t, g, unknown or other
  misc_feature (200)..(200): n is a, c, g, or t
tcagtgatacgtctcacgaccggtgctcgatttagagagcgtcacagggggaggaactgctcagttaggacccagagggaaccatggaagccccagctcagcttctcttcctctgctactctggctcccagtgaccaccggagaaattgtgttgacacagtctccagcccaccctgtccttgtcctaccgaaggggaaanacgcccaccctctcctggcgacgggccagtcagtagtgttggacctaccgtacgtacgcctaggtaaccaagagtaactccgtaggtaccgacggtccctacccgacggtcccttaccctacttaacgttttactggtaacttcggacctaaccgttaaccccgaaacggtaccggggtaccccaaccggttccggggaccccgtaccccgtacggtacccggttaacgggtttaccggtaacggtcgggaccggtaacgggggtttccggggttaccggttacgggggtaaccctaaccgggttaaccttttacccgtaacccggttaccctaacccggaaacccttaaacggttacccgaaaccgggtacccgtaaaccgggttaccccgttaaacggggtaacccggttaaccggtttaacgggttaaacggttttaacgtttttaaccggtaacctttttaaacgtttttaacgtttaacccgttacggttaccgtaacggtaccggttaaccggtacgggttaacccgtaccggttaaagggtttccgttaacccgtttaccgttaccgggttaccgggtttaccgggaccggggtaaacgggtaaccggtaacggggttaccggaacggtaaccggtaaacggtaaccggttaacggtggtacggtacgtccggacctaacgtcgttaccgttacgttacctttccctaccggttccccgttaccccg

SEQ ID NO: 217479 - DNA, 701 bp, Homo sapiens
  misc_feature: GYAE6OF01B1QAM.9.3.A03.1.454.CMB.1.raw
  modified_base (326)..(326): a, c, t, g, unknown or other
  misc_feature (326)..(326): n is a, c, g, or t
  modified_base (370)..(370): a, c, t, g, unknown or other
  misc_feature (370)..(370): n is a, c, g, or t
tcagtgatacgtctcacgaccggtgctcgatttagagagcgtcacagggggaggaactgctcagttaggacccagagggaaccatggaagcccccagctcagcttctcttcctcctgctactctggctcccagtgaccaccggagaaattgtgttgacacagtcctccacgcccacccttgtccttgtcctccgaggggaaagacgccaccctctcctgcgacgggccagtcgagtagtgttggcctaccgtacgtacgccgtaggtaaccaacgagtaactccgtcggacccgaggccctccccgacggtcctcctctatttacngtatgacactaccgaaacgccggaccacgtcggccgtaccccgngtacccgtaggttcgaggtcgggacgtgggttcggtcggtacggggaactacggttacctccgaccttccgtaccacctactcgacgtaccacgtaccgtaacggtcgtaccgtaaggtaacgtttactttacgttaactttaatttttaacgttacgttcgtacgtacgtcggtacgtcgtacgtacgtaagttcggtcctttacgtccgttacggttaccgggacggttaacggacgtagggtacgacggtaaccgtacgaacgtacgtacggtacgtccgtcgtaccgtacctacgttctccgttactaccgttcttcccgtaccccg

SEQ ID NO: 217480 - DNA, 849 bp, Homo sapiens
  misc_feature: GYAE6OF01D5QVY.9.3.A03.1.454.CMB.1.raw
  modified_base (146)..(146): a, c, t, g, unknown or other
  misc_feature (146)..(146): n is a, c, g, or t
tcagtgatacgtctcacgaccggtgctcgatttagagagcgtcacgagggggaggaactgctcagttaggacccagagggaaccatggaacgccccagctcagcttctcttcctcctgctactctggctcccagtcgaccacgganaaattgtgttgacacagtctccacgcccaccctgttccttgtcctaccgaaggggaaacgcgccctaccctcctccgtacgccgacgggaccagtcgaggtacggttcggttacggacctaccgttaacggtacgcccgttaacgggtaaaccctaacgtaacggtaaaccttcccggtacggacccgtaacgggtcccctaccccgaacgggtcccctttaccttacctttaacgttttacgtacgtaacgttcggacctaaccgtaaccccgtaaaaccggggaccggggtacccctaaccgggttccgggtaccccggtaccccgaacgggtacccggttaacggggtttaccgtaacgggttccggggtaccggttacgggggtttacggggttccggttaacggggggaacctaaccgggttacctttaccctaccgtttacccgtaaccgtaaacccgtacggtaccgaaccggacccgtaccgggtaccgtaacggaccggtaccgttaaggtaacgtttcgttttacgtacttttaacgttttacttacgttacgtacgtacgtacgtacgtacgtcgacgtagtcgttcttacgtcgtacgggttcgggacggtacggacgtagggtacgaacgacgacgtacgtaggtcgtacgcgtcgacctacgtctcgtacgtcttcgtctcccgtaccg

SEQ ID NO: 217481 - DNA, 742 bp, Homo sapiens
  misc_feature: GYAE6OF01CL9WY.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccgaaggggaaacgcgcccaccctctcctgcgacgggccagtcagagtgttggcacctagtacgccgtggtaccaacagaactccgtggacctcgggacctcccgaggccttcctactatttatggtatcgactacgtaccgaacgcgggccacgtcggccgtacccagtccgtaggttccaggtcggcgacgggttggtcgcggggaacacgtaccgttctacctccgtaccacctaatccgaacgtcgtaaccggtaccgtaaggaccgtaccgttaaggtaacgttttacttttacgtacttttaactttttaacgttacttcgggtacctagtccgtacggtcgttaccgtacgtaacgggttcggttcctttccggttaccgttaccggggtttcgggaaccggggtacccggtaaacgggtagggtaacggaaccggtaacgaacggtaaccggtaaacggttgggtaccgggacgttccggtaccctaaacccgttcgttaccggtttacgttaccccgtttaccgttcccgttttaccccgttacccccg

SEQ ID NO: 217482 - DNA, 901 bp, Homo sapiens
  misc_feature: GYAE6OF01DBTCQ.9.3.A03.1.454.CMB.1.raw
  modified_base (145)..(145): a, c, t, g, unknown or other
  misc_feature (145)..(145): n is a, c, g, or t
  modified_base (197)..(197): a, c, t, g, unknown or other
  misc_feature (197)..(197): n is a, c, g, or t
tcagtgatacgtctcacgaccggtgctcgatttagagagcgtcacgagggggaggaactgctcagttaggacccagagggaaccatggaagccccagctcagcttctcttcctcctgctactctggctcccagtgaccaccgganaaattgtgttgacacagtctcagcccacctgtccttgtctccgaggggaaancgtcccacccgtctccgagcgagggcctagtccgtaagtacggttaggttcggcctaaccgttaccggtacgtcccgttacgggtaaacctaaacgacggtaaacttcccggtagggccccgtaagggtccccgttaccccggaaggggtcccttacccgttacgttaatttttagacgtaaggttcggacttaaaccggttacccggaaaccggggtaccgtaccggtaacggtcccggtaccacccggtacgttccgggtttagaccggtgggtcgtaacggttcgggggttccgtgggtacggtaaccgtacggtttaccaccgttacccgtacacccgacgtagtaccggacgtaccggaaccggttaccgtaacggtacccgtaggtttacgtagtttacgttactttacgttttaactttagtccgtacgtaagtaccggtaacgtacgggtaccggtacgtaacgggtacccggttactttcgtaccggtttaccgtttaccggggggtccggttaaaccgggggaacgttaacggggttacggggaaccgtaacccggtaaacggggtaacccggtaaccggtaacgggttccggggtacccggtaccctaaaccggaccccgtttaaaggtttcccgttaccggttaccggtttaacccctttcccgacccggttttaccccgttaaccccgggg

SEQ ID NO: 217483 - DNA, 766 bp, Homo sapiens
  misc_feature: GYAE6OF01DB3XZ.9.3.A03.1.454.CMB.1.raw
  modified_base (212)..(212): a, c, t, g, unknown or other
  misc_feature (212)..(212): n is a, c, g, or t
  modified_base (504)..(504): a, c, t, g, unknown or other
  misc_feature (504)..(504): n is a, c, g, or t
  modified_base (580)..(580): a, c, t, g, unknown or other
  misc_feature (580)..(580): n is a, c, g, or t
tcagtgatacgtctcacgaccggtgctcgatttagagagcgtcacgagggggaggaactgctcagttacggacccaggagggaaccatggaacgccccagctcagcttctcttcctcctgctactctcgctccagtcgaccacggagtaaattgtgttgacactacgttctccacgcccacccttgttccttcgtctaccggaaggggaaanacgccctacccttcctccgtcgacgacgggccagtacgaggtagttggttcggacctaccgttacggtacgaccgtacggtaaccaacgtacgaactccgtacggaccgacggtccctacccgacggttcctaccttacttagtttacgcgtacgttcgacctaacctaacccggaaccggacggtccctacggtccggcccggtacccacgtccgttacggttacggtaggtcggacgttacgggtcggtacgtacgggtacacggttacttccgactcctaccacgtacncgaacgacctacgtacgtaggacgtaccttaaggtactttacgtttacgtacgtttattttacgtacgttcgtacncgtacgtacggtccgtacgtaccgttagggttcgtacctttacgtacccggttcgggttaccgggacggggtaaccgggtaggtaaccgggacggtaaccgaccggtacggaaaccgttcggtcggtcggaccttcgaacgttccgtacgtttccttacgttacctcttcccggttccccgtaccg

SEQ ID NO: 217484 - DNA, 656 bp, Homo sapiens
  misc_feature: GYAE6OF01BJ86V.9.3.A03.1.454.CMB.1.raw
  modified_base (199)..(199): a, c, t, g, unknown or other
  misc_feature (199)..(199): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaattgtgttgacacagtctccagcccacctgttccttgtctccgaagggggaaanacgcccacccttctcccgtgcgagggccagtcagagtgttcggccacctacgtcgcctaggtaacccaacaggaacttcccgtggacccgacggtccctaccccgacggtccttcctcgtaattttagcgtacttcgaccatacccaaacggccggggcccacgtcgggccctacccgaggacccgtagggtttccaggtcggaccgtagggttcggtacgtcggggacacggtactttccacttcgtacctaccagttccagcacgtacctaggcgtaccgttagaagtttactttcgtactttatttttacgttactagttcacgtcgtacgtcggtacgacgtaacggtcggtcttacctccgttacgttcgggacggtacggacggtaggtacggacgacgacgacgtacgtgtcggctcgactacacgttcgtcttacctctctccgtcccg

SEQ ID NO: 217485 - DNA, 894 bp, Homo sapiens
  misc_feature: GYAE6OF01C2IBD.9.3.A03.1.454.CMB.1.raw
  modified_base (147)..(147): a, c, t, g, unknown or other
  misc_feature (147)..(147): n is a, c, g, or t
  modified_base (201)..(201): a, c, t, g, unknown or other
  misc_feature (201)..(201): n is a, c, g, or t
tcagtgatacgtctcacgaccggtgctcgatttagagagcgtcacagggggaggaactgctcagttaggacccagagggaaccatggaagccccagctcagcttctcttcctcctgctactctggcctcccagtcgaccaccggganaaattgtgttgacacagtctccacgccaccctgtccttgtctccgaaggggaancgcccaccctctcctgcgacggccagtcagtagtgttcgctacctacgtacgctacggtaaccacagaactccgtcggccacggcctacccggacgtccctacctactaacttttagtagtacgttcgcctaactaacccggaaacggtaccggggaccctaacccggggttccggggacccgttaccccggaacgggttacccggttaacgggttacccggaacgggtttccggacggttaacgggggttcggggtaccggtacgggggtaaacaccggtttaccttaccggtaacccttaccgtaacccgtaaccttaacgacccgtaacgtacccgtaaccggtaccgttaaacgggtaccgtacccggttaagggtttaaaccgttttagttttacggttactttttaaacgtttttaacgtttaccggttacgttaacggttacggaccgttacgggttccggttacggtaacccgttaagggttcccggttaactttcccgttaacggttttacccgggttacgggggaaccggggtaaccggtaacggggtaacgggtacggggaaacccgtaaaccgggaaccggtttaacgggacggtttccgggtacgggtccgtaaccgacccgttaacttccgttccgtttaaacgttccctttaccgtaccctttccccggttaaccccg

SEQ ID NO: 217486 - DNA, 882 bp, Homo sapiens
  misc_feature: GYAE6OF01B3KF0.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggcctcccagtgaccaccggagaattgtgttgacacagtctccacgccaccctgtccttgtcctccgaaggggaacacgcccaccctcctcctcgacgacgggccagtccagtagtgttcggtacctacgtacgccgtacggtaaccaacgagaactccgtggccgacggcctcccgaggtcctcctactatttagtagtacgtcgtctaactaccgaaccggtaccggaccgtaccgtcgggcccgtacccgacggcccgtacggttcgacggtggccggtagggtcgggtacgtaggggtaacacggttaccttcgaacccttctaccctaacctacgttaccaccgtacgaacgtcccgtaacggtaccgtacccgtaaggttaacggtttacttttacggtaacgttttaaacgtttttacgtttaaccgttacgttaccgtaacggtaccgtacggttacccggtacggtaacccgttaacgggtttccgttaccgttttcccggttaaccgggtttaccccggggtttaccggggggtaacccgggggttaaccggggtaacccgggttaacggggttaaccgggtaaccggtaaacccgggtaaaccgggttaaaccgggttaacccggtttaccggggtaacgggttccccggtaccggttaaaccccgaccggtttaacccggtttccgtttaaccgtttacccgtttacccgttaccccgttttaacccccgttccccggttaacccgg

SEQ ID NO: 217487 - DNA, 825 bp, Homo sapiens
  misc_feature: GYAE6OF01ADAPU.9.3.A03.1.454.CMB.1.raw
tcagtgatacgtctcacgaccggtgctcgatttagagagcgtcacagggggaggaactgctcagttaggacccaggagggaaccatggaagccccagctcagcttctcttcctcctgctactctggctcccagtcgaccgaccggagtaaattgtgttgacactagtcctccacgtcccaccctgttccttgtcctaccggaaggggtaacacgccctaccctctccgtgaccgacgggaccacggtacgaggtaggtttggtaccggacctaacccggttaccggtacgtcccgttaacggtaaacccctaaacgaacgtaccgttcccggccgacccggaacgtcccgtacccggaccggtacccttacccttacttacttttaacgtgtaactacgtaccaaccttaccgaaccggtaccgcccgtacggtaccgacccggttaccccgacggtaccgtaacggttccgaggggttacgccgttaggtccggggttaaccggacggggaacttaccggttactaccctacgtacccttaccggaacctacttacgacggaccgtaacgtacccggtaagtacccgtaggttaacgttaaagtttccgttagttacttttaaacgtttactacgtactacgtaccgacgtcgtaacgtccgtattaccgggtccttaccgttaccgaccggtttacggggtacggaacggtcccgggtaaacggacgggtaccgggtaactacggaaacccgtaggttaccgtgggtacgtacttcccggacccttaggctttacgttctaatcccgtaccgttgtaaccccg

SEQ ID NO: 217488 - DNA, 907 bp, Homo sapiens
  misc_feature: GYAE6OF01DPROO.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctccagtcgaccaccggagaaattgtgttgacacagtctccagccacctgtccttgtctccgaaggggaaagcgcccacctctcctgcgagggccagtcagtagtgttcggcacctacgtacgccgttacggtaaccaacgacggaaacttcccgtacggacccgacgggtacccttaccccggaacgggtcccttacccgttacttaacgtttttaagtcggttaacgttaccgggtacctaaaccgttaccccggtaaaccggtaaccggggggaccccttaaaccggttccggggtaccccggttacccccggtaacgggttacccccggtaaacggggttttccgaaacggggttccggggtaccctaagggggtttcggggtaccgtacggggggaactacggttaccgtttacgtaccgttacctaaccgtacctacaccgtaacggacctacggtacccgtaaggaaccgaccgttaagggtaagtttacgttttagtaacctttaagtttttacgtaccgtttcgtaactacggtacgtacggtccgttacggacgttaacgggttcggttaccctttacgttacccggttaacggtttaccgggggaacccggggtaacgggttaaaccgggtacggggtaacgggaaccgtaacccgggaagggtaacccggttaaacgttcggggtaaccggtccgtaccggaaacccgttaccgtacgtttaccggtttacccgttacctttaccgttacccgtttccccgtacccccgg

SEQ ID NO: 217489 - DNA, 733 bp, Homo sapiens
  misc_feature: GYAE6OF01DVF9H.9.3.A03.1.454.CMB.1.raw
  modified_base (210)..(210): a, c, t, g, unknown or other
  misc_feature (210)..(210): n is a, c, g, or t
  modified_base (475)..(475): a, c, t, g, unknown or other
  misc_feature (475)..(475): n is a, c, g, or t
tcagtgatacgtctcacgaccggtgctcgatttagagagcgtcacgagggggaggaactgctcagttaggacccaggagggaaccatggaacgccccagctcagcttctcttcctctgctactctgctccagtcgaccaccggagtaattgtgttagacactagtcctccacgccctacccttgttccttagtcctaccgaaggggaaanacgccctacccgtctcctgcgacgggccagtcaggtagttggttcgcctaccgtacgtacgcccgtaggtaacccaacgtacgaactcccgtaggacccgaggtccctaccccgaggtcccttctacgttatttagagtactcgactacctaccgaacggcgggcctacggtccggcctaccgagtcccgtaaggttccgaggtgcgtaggggttcggtacgtgggaactggtaccttaccggacttccgactaccgtacaccgnggtaccacggtaccgtacgacgtactaggtaagtttgtttacgtacgtttaattttacgtacgttagtacgtacgtacgtacggttaccgtcgttaacgtacgttcgtttaccgttccggttaccggttaccggtttaccggggaacggtaacggtaaccggtaagggtaccggtaacggaacccgacggtaaccgtaacggttcggtaggtactccgacgtactacgtcttacgtaccttaccgtccgtcccgtccg

SEQ ID NO: 217490 - DNA, 827 bp, Homo sapiens
  misc_feature: GYAE6OF01DBU4U.9.3.A03.1.454.CMB.1.raw
  modified_base (120)..(120): a, c, t, g, unknown or other
  misc_feature (120)..(120): n is a, c, g, or t
  modified_base (243)..(243): a, c, t, g, unknown or other
  misc_feature (243)..(243): n is a, c, g, or t
  modified_base (467)..(467): a, c, t, g, unknown or other
  misc_feature (467)..(467): n is a, c, g, or t
tcagtgatacgtctcacgaccggtgctcgatttagagagcgtcacgagggggagaactgctcagttaggacccagagggaaccagtggaacgccccagctcagcttctccttccctcctncctactctggcctcccagtcgacccgaaccggaagtaattgtgttacgacacagttccctccacgccctacccgtgttcccttgtccgaccggaagggaacacgcccctaccccgttctccgngccggacggccaggtcgaaggtacggttcggtacggaccctaaccgtacggttacgcccgttacggaaaccccaagacggtaaccttcccggacgggaccgacggtccctacccggaggttcccttaccgttactttaattagtcgatacgtccaaaccggtaccaaccggtacggccctaccggttcggaccccaacccgaggtaccggtttagggtaaccgngggttcggaggtcggggttcggttaacggacggtaacctcggttaaccctttcacccgtaccttaacgaacccttagcccgaagccgtaacgaccgtacgtaccgtaccgttaagttaacgtttagtttacggttaacttttacgttttacttacgtacgtacgtactacggtcgtacgtccgtactcgggttaccgttacgttcgttaccgtaccgggtttaccgggacgggttaaccgggtaccggttaacgggaacggtacggaacccctaagggaaccgttacgggtcggtaccggcgtacccgtacctacgttacgttcttacgtaccctttacgttacccgtcccgttaccccg

SEQ ID NO: 217491 - DNA, 790 bp, Homo sapiens
  misc_feature: GYAE6OF01A1P7B.9.3.A03.1.454.CMB.1.raw
tcagtgatacgtctcacgaccggtgctcgatttagagagcgtcacgagggggaggaactgctcagttaggacccagagggaaccatggaacgccccagctcagcttctcttcctcctgctactctggcctcccagtcgaccaccggagtaattgtgtgacacagtctccagcccaccctgttccgttgtctaccgaaggggaaacgcgcccaccctctcctgcgacgggccagtcaggtacgttggttcggacctaaccgttacggtacgtccgttacgggtaaaccaaacgaggtaacttcccgtagggacccacgggtccctcccgacggtccttccctataacgttttagtagtactcgacctaccgttaacccgaacggaaccggggtccctacggtccgggtcccgtacccgacgtacccgttagggttaccgacggtcggtaccgtaggggttcgggtaccgtaggggtaaccgaacgtacctttccgaccttcctaccgtaaccctacgttaccgaacggtccgtaaccggacctacggacgtaccgtagtaacgtttgttttacgacttttaacgttttaacgtaccgttacggttacaacgtccggtacgtccggtacgtacgttacgggtccgttccgttaccttcggtaccgggttacggggaaccgggtagggtaacccgtaaggggtcggaacgtaaccgacggtaacggtacggtcggtacggacctcggaccctaacggtccttagttacgttccctattcccgtcccggtaccc

SEQ ID NO: 217492 - DNA, 836 bp, Homo sapiens
  misc_feature: GYAE6OF01ADXE1.9.3.A03.1.454.CMB.1.raw
  modified_base (207)..(207): a, c, t, g, unknown or other
  misc_feature (207)..(207): n is a, c, g, or t
tcagtgatacgtctcacgaccggtgctcgatttagagagcgtcacgagggggaggaactgctcagttaggacccagagggaaccatggaacgccccagctcagcttctcttcctcctgctactctggctcccagtcgaccaccggaagaattgtgttgacactagtctccacgccctaccctgttccttgtcctaccggaggggaanacgcccaccctctcctgcgacgggcctagtcgaggtagttgttcggcctaccgtacgtacgtccgtacggtaacccaacgacggtaaccttcccggtacggcccgtaacgggtcccttaccccggacggttcccttccttacgttaatttactaggtacttacgacctaaccgtacccaacgggaccgggtacctacggttaccgggtaccctaccgaccgggttacccgttaagggttaccgtagggttccggacgttacggggtcgggttcggtaacggggtactacggttacctttacccgaccgtttccgtacctaacccgtacgttaaccgacggtacccgtaacggttaccgtaacgggtacccttaccgggttaagtttaaacggttttccgtttttaggttaacctttttaagttttaaccggttacgtacccgggtttagaaccggtcgtacgggtaccgttacggtaaccggttacggttcggtaccctttacgttaccgggtcgggtttaccgggaccgggtacggtaaccggtagggacgtaacgtacgtacggaccgtaggtcggtaggactcgaccttaccgtcgttacttcgttacctcttccggtcctacccg

SEQ ID NO: 217493 - DNA, 632 bp, Homo sapiens
  misc_feature: GYAE6OF01E09LD.9.3.A03.1.454.CMB.1.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
tcagtgatacgtctcacgaccggtgctcgatttagagagcgtcacagggggaggaactgctcagttaggacccagagggaaccatggaagcccccagctcagcttctcttcctcctgctactctggctcccagtgaccaccggagaaattgtgttgacacagtctccagccaccctgtccttgcctccaaggggaaangcccaccctctcctgcagggccagtcagagtgttggcacctagtagcctggtaccaaanagaactcctggccaggcctcccaggcctcctctatttangatgcatccaaacgacgggccacgtcggcctcccagccgagttcagtggcaggtggtcngggacagacttcactctcaccatcagcagcctagacgctagaagtatttgtacttattttacttactgtacagtcagtcgtcgacctagtcggtcttcgtaccgttacgttttccgggacgggtaacgggtaaccgtaaggggttacggaacggtaacccgtaaacggtaaacccggtaaacggttcgggttacgggtaccgtacggacccgtaacccgttaacgttacctttcggttaacccgttttcccttaaccgtttccccgtttaacccccg

SEQ ID NO: 217494 - DNA, 811 bp, Homo sapiens
  misc_feature: GYAE6OF01EY2Q2.9.3.A03.1.454.CMB.1.raw
  modified_base (246)..(246): a, c, t, g, unknown or other
  misc_feature (246)..(246): n is a, c, g, or t
tcagtgatacgtctcacgaccggtgctcgatttagagagcgtcacgagggggaggaactgctcagttaggaccagagggaaccagtggaacgccccagctcagtcttctccttcctcctgcctactctggcctcccgagtcgacccgacggaagtaaatttcgtagttacgaacacgtacgtcctccacgccctaccgttcggtccttcgtacgtccggaaaggggaacacgccctaccctctcgngcgacggcagtcgagtgtcggtcgactaccgtacggtcgtaccgtacggaacctaacgacgtaacctccggtacggaccgtacgggtccctaccgtaccggtccttaaccgttcttaagtttcgtacgtacgtaccggtacctaacgttaacccgaaacgggtacccgggtacctaccgggtaccggtaccccggtaaccgtacgttacccggggttacgttaccggtacgggtgggtaccggttacggggttcgggtaccggttaacgggaccttacggttaccttcccgtaaccgttcctaaccctaacctacgtacgtaacgaccgtaccgtaacgtaaggtcccggtaatttaacggtaacgttttacgttacgtttaccttttaggtttaacctttacgtacgttcgtaagtccgagtccgtaacgtcgtacgttcgttacctacgtccgttacgggtaccgggtacgggaacgttagggaccgtcggaaacgtccggtaaagacgtaggtcgtcgacctcgactaccgtactcgttcctacttcgtcctcccggttacc

SEQ ID NO: 217495 - DNA, 836 bp, Homo sapiens
  misc_feature: GYAE6OF01EPXNZ.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctccagtcgaccacggagtaaattgtgttgacactagtctccacgcccacccttgttccttgtcctaccggaaggggaaacgacgcccaccctctcctgacgacgggaccagtacaggtagttggttcggacctaacccttacggtacgtccgtacgggtaaaccaaacgaacggtaactccgtacggacccgtacgggtccctacccgacggtcccttcctacttatttagtagtactcgactaactaccgaacggtacggacctacgtcggaccgtacccgagtccgttacggtcgaggtcggacgtagggtcgggtcggacgggactaacgtaccttccgacttccaacctacacgtaccgacggtacaacggttacccgaaggtaccgttacccggttaagggttaaactttttacgtttttacgtaaaccgttttttaagttttttaacctttaccggttacggttaccaacgtttaccgggaacgtttccgggtaacgttaccggtaaagggtttcccggtttaccttttacccggttaccggtttaccggggttaccggggaacggggaaccgggttaacggaacggggttacgaaaccggtaaccgtaaggtaaccgacggggtttcggtagggtacctccgaaccgtaccgttacgtttccgttaccgtttaccctaccgtttcccgttccccggtaacccg

SEQ ID NO: 217496 - DNA, 506 bp, Homo sapiens
  misc_feature: GYAE6OF02G6ORV.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggcctcccaggctcctcatttatgatgcatccaacagggccactggcgtcccagccaggttcagtggcagtggtctgggacagacttcactctcaccatcagcagcctagacgcctgaagtattttgctatttattactgtcagcagcgtgccaagtgcttctctacgtttcggcggtagggaccaaggtggagaccagacgacgtggtggctgcacatctgtcttcacttcctcccg

SEQ ID NO: 217497 - DNA, 540 bp, Homo sapiens
  misc_feature: GYAE6OF02GSH74.9.3.A03.1.454.CMB.1.raw
  modified_base (294)..(294): a, c, t, g, unknown or other
  misc_feature (294)..(294): n is a, c, g, or t
  modified_base (402)..(402): a, c, t, g, unknown or other
  misc_feature (402)..(402): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggcctcccgaggcctcctctatttangatgcatccaacgcgggccacgtggccgtcccagcctaggttcaggtggcaggtggtctggggacagtacttcactctcaccatcagcagcctagacgcctagaagtntttgcttaattttatactgtcagcagcgtgacctaggtcgtcttctctacgttcgggacggacggaccgaggtggacgaccgagacgtaacgtggtcggctgaccaccgtattcgtcgttcttactacttcctccccg

SEQ ID NO: 217498 - DNA, 501 bp, Homo sapiens
  misc_feature: GYAE6OF02IZ04R.9.3.A03.1.454.CMB.1.raw
  modified_base (290)..(290): a, c, t, g, unknown or other
  misc_feature (290)..(290): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttangatgcatccaacagggccactggccgtccagccaggttcagtggcagtggtctgggacagacttgactctcaccatcagcagcctagagcctgaagtatttgctatttattactgtcagcagcgtgccaagtcgcttctcacgtttcgggcggagggaccaaggtgagaccgagacgaacgtgtaggctgcacatctgtcttcatctcccg

SEQ ID NO: 217499 - DNA, 534 bp, Homo sapiens
  misc_feature: GYAE6OF02IMGOK.9.3.A03.1.454.CMB.1.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttangatgcatccaacngggccactggcgtcccagccaggttcagtggcaggtggtctgggacagacttcactctcaccatcagcagcctagacgcctgaagtatttgctatttattactgtcagtcagcgtgccaagtgcttctctacgtttcggcggtacgggaccgtaaggtcgggaagaccgaggaacgtaaccgtggtcggcgtgacctaccgattcgtcgttccttactacgttccttcccg

SEQ ID NO: 217500 - DNA, 578 bp, Homo sapiens
  misc_feature: GYAE6OF02H8HXI.9.3.A03.1.454.CMB.1.raw
  modified_base (195)..(195): a, c, t, g, unknown or other
  misc_feature (195)..(195): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccaggggaaangccaccctctcctgcagggccagtcagagtgttggcacctacgtagcctggtaccaacagaactcctggccaggcctcccaggcctcctcatttatgatgcatcccaacgagggccacgtggccgtccccagcccaggttccaggtcggcaggtcgggtctggggactagacctttcgactctcaccatcagcacgcctagacgccgtgaagtattttgacctattttaacttacttgtaccagtacagccgttgaccaaggtgtccttctctacgtttcgggacggtacgggaccgtaaggtcggaacgaccgtaggaccgtaacgtggtacggcgtacgaccgtaccgtacgtcgttcgttccttactacgtccttccccg

SEQ ID NO: 217501 - DNA, 570 bp, Homo sapiens
  misc_feature: GYAE6OF02GZ3RF.9.3.A03.1.454.CMB.1.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttangatgcatccaacngggccactggctcccagccaggttcagtggcagtggtctgggacagacttcactctcaccatcagcagcctagacgcctagaagtatttgcttagttttattactgtactagctagcgtcgaccagtgcttctctacgtttcgggcggtacgggaccgtaaggtcggaacgaccgtaggaccggaacgttgggtacggtcgttacggacccgtaacccgtagttccgttacggttaccctttaccgtactttcccgtttacccccgg

SEQ ID NO: 217502 - DNA, 499 bp, Homo sapiens
  misc_feature: GYAE6OF02HMRZC.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttatgatgcatccaacagggccactggctcccagccaggttcagtggcagtggtctggggacagactttcactctcaccatcagcagcctagagcctgaagattttgctatttattactgtcagcagcgtgccaagtggcttctcactttcggcggagggaccaaggtggagaccagacgaacgtgtggctgcacatctgtcttcatctcccg

SEQ ID NO: 217503 - DNA, 539 bp, Homo sapiens
  misc_feature: GYAE6OF02GRXF3.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggcctcctcatttatgatgcatccaacgacgggcccacgtggccgtcccagcccagggttcaggtggctaggtggtctggggacagacttcactctcaccatcagcagcctagacgctagaagtatttgcttatttatactgtacagcagcgtcgaccaggtcgtcttcgtctacgtttccgggacggtacgggaccgaggtcggacgaccgaggacgacgtggtaggctgcacgtactcgtcgtccttctactccgttcccg

SEQ ID NO: 217504 - DNA, 577 bp, Homo sapiens
  misc_feature: GYAE6OF02GNSEP.9.3.A03.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaanagaatcctggccaggcctcccaggcctcctcatttangatgcatccaacngggccacgtggccgtcccagccaggttcaggtggcaggtgggtctggggacaggacttcacttctcaccatcagcagcctagacgcctagaagtattttggctaattttacttacttgtcagcagtcgtgacctaaggtcgtcttctctaccgtttcgggacggtacgggaccgtaaagggtggacgaccgaggaaccggtaacgtgggtcggcgttacggaccgtaccgtaacgttccgttaggttcctttactaccttcccgttacccccg

SEQ ID NO: 217505 - DNA, 516 bp, Homo sapiens
  misc_feature: GYAE6OF02ISW21.9.3.A03.1.454.CMB.1.raw
  modified_base (291)..(291): a, c, t, g, unknown or other
  misc_feature (291)..(291): n is a, c, g, or t
  modified_base (392)..(392): a, c, t, g, unknown or other
  misc_feature (392)..(392): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggcctcccaggctcctcatttangatgcatccaacacgggcccactcgggccgtcccagcccgaggttcaggtggcaggtggtctggggacaggtactttcactctcaccatcagcacgctagngcctgaagtatttgctattttatacttgtcagcagcgtgccagtgcttctctacgtttcggcggacggacaaggtgacgaccaggacgacgtggtcgctgcacgatctgtctctactcctcccg

SEQ ID NO: 217506 - DNA, 520 bp, Homo sapiens
  misc_feature: GYAE6OF02INSI7.9.3.A03.1.454.CMB.1.raw
  modified_base (196)..(196): a, c, t, g, unknown or other
  misc_feature (196)..(196): n is a, c, g, or t
  modified_base (499)..(499): a, c, t, g, unknown or other
  misc_feature (499)..(499): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaacagaatcctggccaggcctccccaggcctcctcatttatgatgcatccaacagggccactggcgtcccagccaggttcagtggcaggtggtctgggacagacttcactctcaccatcagcagcctagagcctagaagtatttgctatttattactgtctagcagtcgtgccaaggtcggcttctctacgtttcggcggacggtaccgaaggtcggagaccgagacgacgtggtcggctgccacgtntctcgtcttctatccttcccg

SEQ ID NO: 217507 - DNA, 887 bp, Homo sapiens
  misc_feature: GYAE6OF02HE4S9.9.3.A03.1.454.CMB.1.raw
  modified_base (344)..(344): a, c, t, g, unknown or other
  misc_feature (344)..(344): n is a, c, g, or t
tcagtgatacgtctcacgaccggtgctcgatttagagagcgtcacaggggggaggaacgtgcctcagttaggacccaagagggaaccgattcggaagtccccgagctcagcttctcttacctcctgcgtactctcggctcccgagttgaccaccggaataagtttcgtgtttgactacttagtctccacgcctaccctgtccgttgtcctccgaggggaagaggcctacccttcggtccgtgcgacgggccacgtcgagtacgtggttggcctaccgttacgtagcctggtaccaacagaactcctggacctaggtcctacccaacggctccgtctaatttacngattggccactccgaactacgggaccacgtacggggcccgttcccggaaggtcccggtaagggttcaaggtttcggtcgttaggttacggttacgtagggaactaggtaaccttttacgaacgttcgtaccaaccgtaagttcccgaaaggtacccgaacgtacccgttacgaaccgtacccgttacggtaaacgttaacgtttttacggaacctttaaacgttttttaaccgtttaaacgtttacggtttaaccgtttaacggtaccgttaacggttaccggttaacggtaacccgttaaacgggttacggttacccgttttacccgtttaccggttaaaccggtttttaccgggggtaacccggggtaaacgggggtaaaccccgttaaacggggttaccgggtaaaccggtaacccggttaacggttaacccggttaaaccggttcgggttaccgggtaccgttaacgggaacccgtaacccggtaacggttacggttacgtttaccggtttaaccgtacggtttacccggttaccccgg

SEQ ID NO: 217508 - DNA, 611 bp, Homo sapiens
  misc_feature: GYAE6OF02IMASU.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggcctcccaggctcctcatttatgatgcatccaacagggccactggcctcccagcccaggtttcgaggtcggcgtaggttcggtcgtagggacacggtactttacgaccttctaccaaccctataccacgacaccgtacctaaggacgtacctagaaacgtttatttcgtactttattttaacttacgttgttacgtagtacacggtcgtcgacgtagttcggtcctttactacgtacggtttcgggacgggtacggtaaccgtaggacggaacgaccgagaacgtacgtggtacggctacgacctaccagttccgttacgttcctactccgttccttccccg

SEQ ID NO: 217509 - DNA, 540 bp, Homo sapiens
  misc_feature: GYAE6OF02GXGUK.9.3.A03.1.454.CMB.1.raw
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggcctcccaggcctcctcatttangatgcatccaacagggccactggccgtcccagccaggttcagtggcaggtggtctgggacngactttcactctcacatcagcagcctagacgcctagaagtatttgactattttattactgtacagcagtcgtgtcctaaggttcggcttctcgtacgtttcgggcgggtaacgggtacccgtaagggtaggacgaccgaggaaccgtaacgtggtggcgtgccacatctgtcttctactccttcccg

SEQ ID NO: 217510 - DNA, 521 bp, Homo sapiens
  misc_feature: GYAE6OF02JV0T1.9.3.A03.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (393)..(393): a, c, t, g, unknown or other
  misc_feature (393)..(393): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaacagaatcctggccaggctcccaggctcctntatttangatgcatccaacgagggccacgtggccgtcccagccaggttcaggtggctagtggtctggggacagacttcactctcacatcagcagcctagacgctgaagtntttgctatttatactgtcagcagtcgtgaccaagtgtcttctctacgtttcggcggtaggaccgaggtggacgaccgagacgacgtggtaggcgtcgactaccgatcgtgtcttactatcccttcccg

SEQ ID NO: 217511 - DNA, 535 bp, Homo sapiens
  misc_feature: GYAE6OF02JASQR.9.3.A03.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
  modified_base (359)..(359): a, c, t, g, unknown or other
  misc_feature (359)..(359): n is a, c, g, or t
  modified_base (398)..(398): a, c, t, g, unknown or other
  misc_feature (398)..(398): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggcctcccaggctcctcatttangatgcatcccaacgagggcccacgtggccgtcccagcccaggttcaggtggcaggtggtctggggacngacttcactctcacatcagcagcctagacgcctgaagtntttgctattttatactgtcagcagtcgtgcctaaggtcggtcttctcgtacgtttcgggacgggtacgggaccgtaagggtcggaacgcgagacgaacgtggtcggctcgctaccgatctgtcttctactcctcccg

SEQ ID NO: 217512 - DNA, 569 bp, Homo sapiens
  misc_feature: GYAE6OF02I84ST.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggcctcccgaggcctcctctatttatgatgacactaccaacgacgggccaacgtggccgtaccccagccaggttcaggtggcaggtgggtctggggactaggtacttcactctacacatcagcagcctagacgctagtaagtattttgacttattttacttacgttgtacgtagcacggtcgtcgaccgtaaggtcgtcttcgtcgtacgttcgggacggacgggtaccaagggtcgaacgccgagaaccgtacgtggtgactgaccaccgtagttccgtgttctctacttcccgttcccg

SEQ ID NO: 217513 - DNA, 556 bp, Homo sapiens
  misc_feature: GYAE6OF02GTAC9.9.3.A03.1.454.CMB.1.raw
  modified_base (310)..(310): a, c, t, g, unknown or other
  misc_feature (310)..(310): n is a, c, g, or t
tcagtgatacgtctcacgaccggtgctcgatttagagagcgtcacagggggaggaacctagctcacgtttaggacccagagggaaccatcggaagccccagctcagcttctcttcctcctgctactctggctcccagtgaccaccggagaaattgtgttgacacagtctccagccacctgtccttgtctccgaggggaaagagccaccctctcctgcagggccagtcagagtgttggcacctacgtagcctggtaccaacagaactcctaggccaggctcccgaggctcctcatttatgatgcatccaanagggccacgtggccgtcccagcccagggttccaggtcggctaggttgggtactggggaacaggactttcgactctcaacctatacagcaagcctaggacgcctgaagtattttgctattttattactgtcagcagctgctaagtcggcctttgtctacgtttcggcggacgggtaccgagggtcggacgaccgagacgtacgtggtcgctggcctacgacgtccgtgtccttctaccttcctcccg

SEQ ID NO: 217514 - DNA, 534 bp, Homo sapiens
  misc_feature: GYAE6OF02F0ZPV.9.3.A03.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtacccaacagaatcctggccaggcctcccaggctcctcatttangatgcatccaacagggccagtggccgtcccagccctaggtccaggtggctaggtgggtctggggacaggtacttcactctacaccatcagcagcctagagcctagaagtatttgacttatttatactgtctagcagcgtgcctaaggtcgtcttctctacgtttcgggcggagggaccaggtgacgtaccgagacgacgtggtggcgtcgcaccgtattcgtagtccttacgactccttcccg

SEQ ID NO: 217515 - DNA, 542 bp, Homo sapiens
  misc_feature: GYAE6OF02IB7FJ.9.3.A03.1.454.CMB.1.raw
  modified_base (195)..(195): a, c, t, g, unknown or other
  misc_feature (195)..(195): n is a, c, g, or t
  modified_base (290)..(290): a, c, t, g, unknown or other
  misc_feature (290)..(290): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaanagccaccctctcctgcagggccagtcagagtgttggcacctacgtagcctggtaccaacagaatcctggccaggctcccaggcctcctcatttangatgcatccaacagggccactcggcctcccagccaggttcagtggcagtggtctgggacagacctttcactctcaccatcagcagcctagacgcctagaatattttgactattttattacttgtcagcagcgtgccaagtggtcttctctacgtttcgggacggtacgggaccgtaaggtcggaagaccgaggaccgaacgtggtcggtctgaccaccgtactcgttgttcctttactacttcccgttcccg

SEQ ID NO: 217516 - DNA, 522 bp, Homo sapiens
  misc_feature: GYAE6OF02FREB8.9.3.A03.1.454.CMB.1.raw
  modified_base (370)..(370): a, c, t, g, unknown or other
  misc_feature (370)..(370): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggcctcctcatttatgatgcatccaacgagggccacgtggcgtcccagcccagggttcaggtggcaggtggtcgtgggacaggtacttcactcncaccatcagcagcctagacgcctagaagtatttgctatttattactgtcagcagtcgtgccaagtcggtcttcgtctacgtttcggcggagggtaccaggtgagaccgagacgacgtgtacgcgtgcacagtcgtgtcttctactcctcccg

SEQ ID NO: 217517 - DNA, 504 bp, Homo sapiens
  misc_feature: GYAE6OF02GD2MY.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggctcccaggctcctcatttatgatgcatccaacagggccacgtggcgtcccagccaggttcagtgcagtggtctggggacagacttcactctcaccatcagcagcctagacgcctgaagtattttgctatttatactgtcagcagcgtgccaagtgcttctctacgtttcggcggtagggaccaggtggagaccgagacgacgtgtggctgcacgatctgtcttctactctcccg

SEQ ID NO: 217518 - DNA, 533 bp, Homo sapiens
  misc_feature: GYAE6OF02GWV1X.9.3.A03.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggcctcccaggctcctcatttangatgcatccaacgngggccactggcctcccagccaggttcagtggcaggtggtctgggacngacttcactctcaccntcagcagcctagacgcctagaagtatttgctattttattactgtcagcagtcgtgcctagtcggtcttctctacgtttcggcggtacggacgaggtggacgaccgagacgtacgtggtacggctcggaccaccgtactcgttcgttcttctacttccttaccccg

SEQ ID NO: 217519 - DNA, 562 bp, Homo sapiens
  misc_feature: GYAE6OF02H2HWQ.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggcctcccaggcctcctcatttatgatgcatccaaacgagggcccacgtcggccgtccccgagcccaagggtttccaaggtcggcaggtgggtctggggacagtacttcactctcaaccatcagcacgctagacgcctagaagtatttgcttatttattactgtcagcagcgtgacctaaggtcgtcttctctacgtttcggacgggtacgggaccgaaagggtcggacgaccgaggacgtaacgtggtcggctcgaccacctatccgtagtcctttactacttcccttccccg

SEQ ID NO: 217520 - DNA, 511 bp, Homo sapiens
  misc_feature: GYAE6OF02GKB9B.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggctcccaggctcctcatttatgatgcatccaacagggccacgtggcgtcccagccaggttcagtggcagtggtctgggacagacttcactctcaccatcagcagcctagagcctagaagtattttgctattttattactgtcagcagcgtgcctaagtgtcttctctacgtttcggcggtacggaccaggtggacgaccgagacgaagtggtggctgcacgatctgtcttctactcctcccg

SEQ ID NO: 217521 - DNA, 554 bp, Homo sapiens
  misc_feature: GYAE6OF02IWXU6.9.3.A03.1.454.CMB.1.raw
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (413)..(413): a, c, t, g, unknown or other
  misc_feature (413)..(413): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctcncctgcagggccagtcagagtgttggcacctacgtagcctggtaccaacagaatcctggccaggctcccaggctcctcatttangatgcatccaanagggccacgtggcgtcccagccaggttcaggtgcagtggtcnggacagacttcactctcacntcagcagctagagctgaagtatttgctatttatactgtcagtcagcgtnccgtaagtcggtacttcgttactacgtttccggacgggtacgggaaccgtagggtacggaacgaccgaggaccgtaacgtcggtaggccgtagccgtaaccgtacgttacgtagttccgtttacgtacccttcccgtaccc

SEQ ID NO: 217522 - DNA, 523 bp, Homo sapiens
  misc_feature: GYAE6OF02HSJFE.9.3.A03.1.454.CMB.1.raw
  modified_base (196)..(196): a, c, t, g, unknown or other
  misc_feature (196)..(196): n is a, c, g, or t
  modified_base (502)..(502): a, c, t, g, unknown or other
  misc_feature (502)..(502): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggcctcccaggctcctcatttatgatgcatccaacgagggccacgtggccgtcccagccaggttcagtggcaggtggtctgggacagtacttcactctacaccatcagcacgcctagacgcctagaagtattttgacttatttattactgtacagtcagtcgtcgcctaaggtgtcttctctacgttcggcggacgggaccagggtcgagaccgagacgacgtgtggctgcacntctgttctacacttcctcccg

SEQ ID NO: 217523 - DNA, 573 bp, Homo sapiens
  misc_feature: GYAE6OF02HOPYN.9.3.A03.1.454.CMB.1.raw
  modified_base (255)..(255): a, c, t, g, unknown or other
  misc_feature (255)..(255): n is a, c, g, or t
  modified_base (393)..(393): a, c, t, g, unknown or other
  misc_feature (393)..(393): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaanagaatcctggccaggctcccaggctcctcatttatgatgcatccaacgacgggccacgtggccgtcccagccaggttcaggtgcagtggtctgggacagacttcactctcaccatcagcagcctagcgcctagaagtntttgctattttattacgtgtacagtacaggtcgtgacctaaggtggtcctttcgacttacgtttcgggacgggtaacggggacccgtaaagggtcggaacgaccgagacggtaacgttgggtcggtccttacggtacctagttactggttaccttaccgtactttccgttacccttaagg

SEQ ID NO: 217524 - DNA, 527 bp, Homo sapiens
  misc_feature: GYAE6OF02F0L8C.9.3.A03.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (371)..(371): a, c, t, g, unknown or other
  misc_feature (371)..(371): n is a, c, g, or t
  modified_base (504)..(504): a, c, t, g, unknown or other
  misc_feature (504)..(504): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagngccaccctctcctgcagggccagtcagagtgttggcacctacgtagcctggtaccaacagaatcctggccaggcctccaggctcctcatttangatgcatccaacgagggcccagtcggccgtcccagccaggttcagtggcaggtggtctggggacagacttcactctcaccntcagcagcctagacgcctagaagtattttgacttattttatactgtacagcagtcgtgaccaagtcgtcttcgtctacgtttcgggcggaggaccgtagggtcgacgacgagacgacgtgtcgctcgcaccgngttctcgtctctacttcctcccg

SEQ ID NO: 217525 - DNA, 549 bp, Homo sapiens
  misc_feature: GYAE6OF02GBPME.9.3.A03.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (381)..(381): a, c, t, g, unknown or other
  misc_feature (381)..(381): n is a, c, g, or t
  modified_base (512)..(512): a, c, t, g, unknown or other
  misc_feature (512)..(512): n is a, c, g, or t
  modified_base (526)..(526): a, c, t, g, unknown or other
  misc_feature (526)..(526): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaanagaatcctggccaggcctcccgaggcctcctctatttatgatcgcatccaacgacgggccacgtcggccgtcccagcccgtaggttcaggtggctaggtcgggtctggggacaggactttcactcncacctatcagcagcctagacgcctagaagtatttgcttaattttactactgtacagctagcgtcgacctaaggtcgtcttctctacgtttcgggacggtacggaccgaggtgacgaccgagacgacgtggnggtcctgccacgtntctgtacttctacttccctaccg

SEQ ID NO: 217526 - DNA, 655 bp, Homo sapiens
  misc_feature: GYAE6OF02IYDY1.9.3.A03.1.454.CMB.1.raw
  modified_base (299)..(299): a, c, t, g, unknown or other
  misc_feature (299)..(299): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaagcgccaccctctcctgcagggccagtcagagtgttggcacctacgtagcctggtaaccaacagaactccgtggccaggcctcccgaggccttcctctatttangatcgactataccaaacgacgggccacgtcggccgtcccaagcccgtaaggttccaggtcggctaggtcgggtctaggggaacacggtacttcgactctaccaacctacgtcgacgccacgtccgtagacgtccgtagtaagtagttttcgacttagttttattacttgtacaacgtcgtacgtacggtcgtacgtaaggttcggtactttaccgtacttaccggtttccgggacgggtaacgggtaaccgtaagggtgggaacgtaccgacgggaacgtaacggtgggtacggtccgtacgtaccgtaaccgacgtttccgtacgtttccgtttacgtaccgttcccgttacccg

SEQ ID NO: 217527 - DNA, 655 bp, Homo sapiens
  misc_feature: GYAE6OF02HSGCJ.9.3.A03.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggctcccaggctcctcatttatgatgcatccaacgngggccacgtggccgtcccagccaggttccagtggcaggttggtctaggggacaggtacttcgactcctacaccatcagtcagcctaggacgccctaggtaagtattttgacttaattttattacgttgtctagtacctagtccgtcgaccctaaggttcggtcctttacctaccgttacggttttaccggggccgggtaacggggtaacccggtaaagggttcggggaaccgtaacccggtaacgggtaacccggaaaccggtttgggtaccggtccgtaccggtaccgtaacccgtacgtttccgttacgtttacccttttaccgtaccgtttccccgtttaccccccgg

SEQ ID NO: 217528 - DNA, 504 bp, Homo sapiens
  misc_feature: GYAE6OF02FF9ZO.9.3.A03.1.454.CMB.1.raw
  modified_base (196)..(196): a, c, t, g, unknown or other
  misc_feature (196)..(196): n is a, c, g, or t
  modified_base (289)..(289): a, c, t, g, unknown or other
  misc_feature (289)..(289): n is a, c, g, or t
  modified_base (475)..(475): a, c, t, g, unknown or other
  misc_feature (475)..(475): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctagtagcctggtacccaacagaatcctggccaggctcccaggctcctcatttangatgcatccaacagggccacgtggcgtcccagccaggttcagtgcagtggtctgggacagacttcactctcaccatcagcagcctagagcctgaagtatttgctatttatactgtcagcagcgtgccagtgtcttctctacgtttcggcggtacgggaccaagggtgacgaccgagacgacgtggngctgcacatctgttctcacttcctacccg

SEQ ID NO: 217529 - DNA, 544 bp, Homo sapiens
  misc_feature: GYAE6OF02IHM77.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggctcccaggcctcctcatttatgatgcatccaacgagggccacgtggcgtccagccaggttcagtgcaggtggtctgggacagcttcactctcaccatcagcagctagcgacctgaagtattttgactatttacttactgttacagcagtcgtacgcgtaagtggtacttctcgtacgtttcgggacggtagggaccgaaggtcggaacgaccgagacgacgtggtaggtctgaccgtaccgtagttcgtacgttcttactacttcccgttcccg

SEQ ID NO: 217530 - DNA, 554 bp, Homo sapiens
  misc_feature: GYAE6OF02FS4NF.9.3.A03.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagngccaccctctcctgcagggccagtcagagtgttggccacctacggtagcctggtacccaacagaatccctggcccaggcctcccgaggcctcctcatttangatgcatccaacagggccacgtggccgtcccagcctaggttcaggtggcaggtcgggtctggggacaggtacttcacttctcaccatcagcagcctagagcctagaagtattttgcttattttatactgtcagcagtcgtcgacctaagtgtcttctactacgtttcggacggtagggacctaagggtcgacgaccgagacgacgttggtacggctacgacctaccagttccgtgttccttactacttccgtcccg

SEQ ID NO: 217531 - DNA, 786 bp, Homo sapiens
  misc_feature: GYAE6OF02IJDRG.9.3.A03.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagagtgttggcacgtacgagcctggtaccaactgaatccgtggaccaggcctcccgaggcctcctactattttacngattcgacctataccgaaacgacgggcccaacgttccggccgtaccccgaggtccgtaagggtttccaagggttcgggacctagggttcggggtcctagggggacaacggttaccgttttaccaaccgtcttacccgaacccgtacttaccggaacggtacgacccggttaaccgaacgggtaccgtacccggttaaaggtaacgtttaacgtttttaccgaacgttttaacttttacgttacgtcgtacgtacgtcgtaaccgtcgtacgtaccgtaaggttcggttacccttacgttaccgttaccggtttacggggaaccgggtaaccgggtaaacccggtaggggttaaccgggaacggtaaacccggtacggtaaacccgggtacggttaacgggttacgaccgggttaaccgaccggtaaaccgtttcgttaccggtttaaccggtttaccgttaccgtttaccgttccccggttaaccccg

SEQ ID NO: 217532 - DNA, 668 bp, Homo sapiens
  misc_feature: GYAE6OF02ILM8N.9.3.A03.1.454.CMB.1.raw
  modified_base (197)..(197): a, c, t, g, unknown or other
  misc_feature (197)..(197): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggcctcccaggctcctcatttatgatgcatccgaacgacgggcccacgtcggccgttccccaaggcccgtaagggttcaaggtgggccaggttcgggtcgtgggggtaacacggtacctttccaacgttccgtacctaaccctattccaacggtccaacgacccgtaagacgtaccctaggaaagtatttttgactttaatttttaacttaaccttgttacgtagtacgagtcgtcgacctaaggtcggtctttcgttccgtacgtttccgggacgggtacggggtaaccgaagggtacgggaacgaccgacggaacggtaaccgtgggttacgggtcgttcggaccgtaacccgtacgttccgttacgttccttaccgtaccgttcccgttaccccgg

SEQ ID NO: 217533 - DNA, 567 bp, Homo sapiens
  misc_feature: GYAE6OF02IA3DH.9.3.A03.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (408)..(408): a, c, t, g, unknown or other
  misc_feature (408)..(408): n is a, c, g, or t
  modified_base (537)..(537): a, c, t, g, unknown or other
  misc_feature (537)..(537): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaacagaactcctggccaggcctcccgaggctcctcatttangatgcataccaacgacgggccagtcggccgtcccagcccgagggttcaggtggcaggtggtctggggacaggaccttcactctacaccatcagcacgcctagacgtcctgaagtntttgcttattttatactgtacagctagcgtgaccgtaaggttggtctttcgctacggtttcgggacgggtacggaccgaagggtcggagacccgtaggaaccgtaacgtggtacggctacgaccacctnttcgttgttccttcgtacctccgttccccg

SEQ ID NO: 217534 - DNA, 613 bp, Homo sapiens
  misc_feature: GYAE6OF02JAFOU.9.3.A03.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (294)..(294): a, c, t, g, unknown or other
  misc_feature (294)..(294): n is a, c, g, or t
  modified_base (361)..(361): a, c, t, g, unknown or other
  misc_feature (361)..(361): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctccagtgaccaccggagaaattgtgttgacacagtctccagccaccctgtccttgtctccaggggaaangccaccctctccngcagggccagtcagagtgttggcacctacgtagcctggtaaccaacagaatccgtggccaggcctcccgaggcctcctcatttangatgcactccaacgagggccacgtcggccgtccagccgtaggttcaggtggcaggtggtctgggacngacttcgactctcacatcagcacgtcctagacgcctagaagtagtttcgacttattttatacgtagtacgagtcacgtcgtacgtaccgtaaggttcggtaccttccttaccgtacggtttaccggggacgggtaacgggtaaccgaaagggtcggaacgtaccgacggtaaccggaacggttcggtacggtctacggacctaaccgtacgttcgttcgttacccgtttacctaccggttcccttaccccgg

SEQ ID NO: 217535 - DNA, 595 bp, Homo sapiens
  misc_feature: GYAE6OF02ISQLS.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctccagtgaccaccggagaaattgtgttgacacagtctccagccaccctgtccttgtctccgaggggaaagagccaccctctcctgcagggccagtcagagtgttggcacctacgtagcctggtaccaacagaactcctggccaggctcccgaggcctcctctatttatgatgcatccaacgacgggccacgtcggccgtcccagcccgaggttcaggtggccgaggttcgggtcgtgggacacggtacttcgacttctacaaccatcgaagccagtccgtagacgacctagaaagttattttgttaattttattactgtacagtctacgtcgtgacccgtaaggtcgtacttcctacttcgtttccgggacgggtaacgggaaccgtaagggtacggaacgaaccgagacgtaacgtggtacgtcgcgaccgactagtcttcggttcctactacttcccgttcccgtac

SEQ ID NO: 217536 - DNA, 511 bp, Homo sapiens
  misc_feature: GYAE6OF02FMNBW.9.3.A03.1.454.CMB.1.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggctcccaggctcctcatttangatgcatccaacagggccactggcgtcccagccaggttcagtggcagtggtctgggacagacttcactctcaccatcagcagcctagacgcctgaagtattttgctatttattactgtcagcagcgtcgcctaagtggtcttctctacgtttcgggcggtacgggaccaaggtcggagaccgagacgaacgtgtggcgtgcacatctgtctcatcttcccg

SEQ ID NO: 217537 - DNA, 690 bp, Homo sapiens
  misc_feature: GYAE6OF02I5UQT.9.3.A03.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagagtgttggcacctacgtagcctggtaccaacgagaatcctggaccaggcctcccgaggcctcctcatttangactgaccatccaaacgcgggaccacgtcggcctcccgagcccgtaaggttcaaggtcggcgtaggttcgggtctacggggacaggtactttcaacttctccaacctagtccaagccaacggtccctaaggacgccgtagaaacgttattttcgacttaagttttacttacgttcgttacaacggtctacgtccgttacggaccgtaaggttcggttacctttaccgttaccgtaccggttttaccgggacggggttaacgggtaacccgttaagggtgggaaccgtaccggtaacggtaaacggtaaccggttcggtacgggtacccgttacggaaccgtaacccgtacgttccgttaccggttacttcccgtaccgtttacccttacccccgg

SEQ ID NO: 217538 - DNA, 570 bp, Homo sapiens
  misc_feature: GYAE6OF02GKNCZ.9.3.A03.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (298)..(298): a, c, t, g, unknown or other
  misc_feature (298)..(298): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagngtgttggcacctacgtagccctggtaacccaacagaactcccgtggccaggcctcccgaggcctcctcatttangatgcactccaacgcgggccacgtggcctcccagcccaggttcaggtgcaggtgggtctggggacagtaccttcacttcncacntcagccaagcctagacgcctagaagtgtttagcttaatttattactgtcgtagtcagtcgtcgcctaaggtcggtcttcgtacgtacgtttcgggcggtacgggaccgaggtacggacgaccgagacgaacgtcggtacggtcgtcgaccgtacctagttcctcggttacctcgtactccttaccccg

SEQ ID NO: 217539 - DNA, 756 bp, Homo sapiens
  misc_feature: GYAE6OF02J2MN6.9.3.A03.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
  modified_base (688)..(688): a, c, t, g, unknown or other
  misc_feature (688)..(688): n is a, c, g, or t
tcagtgatacgtctcacgaccggtgctcgatttagagagcgtcacagggggaggaacgtgctcagttaggacccagagggaaccatggaagccccagctcagcttctcttcctcctgctactctggctcccagtgaccaccggagaaattgtgttgacacagtctccagcccaccctgtcccttgtcctccgaggggaaangccacccttctcctgcagggccagtcagngtgttggcacctgtagcctggtaccaacagactcctggcccaggcctcccgaggcctccgtctatttacnggatcggactntacccaacgtacggccncggtaggcccctcccgagtcccgaaggtttccaagggttggacccgtagggtcgggtaccgttaggggaccaacggttacctttcccaaccgttccttacccgaacccgttagtacccgaagacccgtaacggtccccgttaagggacccgtcccgttaaagggaaaccgttagtttttacggaccctttaagtttttaactaccgttacgtacgtaacgtcgtacggtccgttacggaccgttaaggttcggtaccttttcccgtacgttttacccggtttacggggtacccgggtaaaccggggtaccgtaacggggttacggaaccggttacccggaacggacggtttaaacccggngggttaccgtacgtcgaaccgtaccgtacgtttacgccgtttcttaccgttacgttcccttaccccgg

SEQ ID NO: 217540 - DNA, 606 bp, Homo sapiens
  misc_feature: GYAE6OF02FNO6R.9.3.A03.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (292)..(292): a, c, t, g, unknown or other
  misc_feature (292)..(292): n is a, c, g, or t
  modified_base (450)..(450): a, c, t, g, unknown or other
  misc_feature (450)..(450): n is a, c, g, or t
tcagtgatacgtctcacgaccggtgctcgattttagagagcgtcacaggggggaggaactgctcagttaggacccagagggaacccatggaagccccagtctcagcttctcttcctcctgctactctggctcccagtgaccaccggagaaattgtgttgactacagtctccagtccaccctgtccttgtctccaggggaaangccaccctntcctgcagggccagtcagagtgtggcacctcgagcctgtaccaacagatcctggccaggcctccaggcctcctcattttangatgcatcccaacgacgggcccaacgtcgggccgtcccaggcctaggttccaggtcgctaaggtgggtctaggggacagtacttcacgtctacacatcgagccagtcctagacgcctagaagtatttagacttatttattactgtactagctagcgtnaccgtagtgtcttcttcgtacgtttcgggacggtacgggaaccgtagggtacggacgtaaccgtacggaaccgaacggttacggtacgggtaccgtacggtaccgtaaccgttacgtcgtttaccgttccgtttacttacgttaccctttccccgg

SEQ ID NO: 217541 - DNA, 601 bp, Homo sapiens
  misc_feature: GYAE6OF02FZT31.9.3.A03.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (415)..(415): a, c, t, g, unknown or other
  misc_feature (415)..(415): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagngtgttggcacctacgtagcctggtaccaanagaactcctggccaggcctccaggcctcctctatttatgatgcatccaacgacgggccacgtgggccgtcccagccgtaggttcaggttggctaggtcgggtcgtggggactagtacttcactctacaccatcagcacgtcctagacgcctagaaacgtnttttacgacttattttaacttacgttgttcagtctacggtcgtacgactaaggttcggtcctttctcgtacgtttcgggacggtacgggtaccgtaaagggtcggaacgaccgaggacgtaacgttggtacggtacgtcgactaaccgtacttccgtaggttccttacgtacgttcccttaccccg

SEQ ID NO: 217542 - DNA, 535 bp, Homo sapiens
  misc_feature: GYAE6OF02G57DP.9.3.A03.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagngccaccctctcctgcagggccagtcagagtgttggcacctacgtagcctggtaccaacagaatcctggccaggcctcccgaggcctcctcatttangatgcatccaacagggccacgtcggccgtcccagcccaggttcagtggcaggtggtctggggacagacttcactctcaccatcagccagcctagacgcctagaagtattttgctaatttttatactgtctagctagcgtgccaagtcggcttctctacgtttcgggcggtacgggaaccgaaggtcggagaccgagacgaacgtggtaggctgcaccgtatcgtgtcttctacttcctcccg

SEQ ID NO: 217543 - DNA, 579 bp, Homo sapiens
  misc_feature: GYAE6OF02H434S.9.3.A03.1.454.CMB.1.raw
  modified_base (197)..(197): a, c, t, g, unknown or other
  misc_feature (197)..(197): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagccaccctctcctgcagggccagtcagagtgttggcacctacgtagcctggtaccaacagaactcctggccaggcctccccgaggcctcctctatttatgatgctatccaacgcggccacgtggccgtcccagccaggttcaggtcggcaggtcggtctggggacaggactttcactctacaccatcagcacgcctagacgtcctagaagtatttagacttattttattacttgtacagtcgagtcgtacgaccaaggtcgtcttcgtcgtaccgtttcgggacgggtacggaaccgtaggtacggacgaccgaggaccgaacgttggtacggctacgaccaccgtacgttccgtacgttccttactacttcccgtacccg

SEQ ID NO: 217544 - DNA, 839 bp, Homo sapiens
  misc_feature: GYAE6OF02H2JWP.9.3.A03.1.454.CMB.1.raw
  modified_base (230)..(230): a, c, t, g, unknown or other
  misc_feature (230)..(230): n is a, c, g, or t
  modified_base (262)..(262): a, c, t, g, unknown or other
  misc_feature (262)..(262): n is a, c, g, or t
tcagtgatacgtctcacgaccggtgctcgatttagagagcgtcacagggggaggaactgctcagttaggacccagagggaaccatggaagccccagctcagcttctcttcctctgctactctggctcccagtgaccaccggagaaattgtgttgacacagtctccagccacccttgtccttgtctaccgaggggaaacacgccacccttctcctagcagggccagtcagngtgttggcacctacgtagcctggtaccaacgngaactcctggccaggcctcccgaggctcctcatttatgattgcctatccgaaacgacgggccctacgtcgggcccgtacccaaggtcccgaggtttaccgaggttcgggacctagggtcgggtactacgggggaactacggtaccgttttacaccgttccttaccgaaacccttacgttaccggacgaccgtaagggtccccttaagggtacgtacccgttacggtaaacggttacgtttttacggtaaccgttttaaacgttttttaaccgttaaccggttttacggttaccgtaaacgggttacccgtaacgggttacccgggttacgggtaacccgtaaacgggtttccggggtaccctttttacccggttaccgtttaacccgggttttttaccgggggacccggggttaaaccgggggtaacccggttaaaaacgggggtttccgggaaaccggtaacccggtaagggtaaacccggttaacggtttcgggtaccgggtaccgtacggtacccgaaccgttaacggtttccgttaccgtttacgtttaccgtacgttaccccgtttaccccg

SEQ ID NO: 217545 - DNA, 530 bp, Homo sapiens
  misc_feature: GYAE6OF02GH48G.9.3.A03.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (510)..(510): a, c, t, g, unknown or other
  misc_feature (510)..(510): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatccctggccaggcctcccgaggcctcctctattttangatgcataccaangggtcactggcctcccagccaggttcagtggcaggtgggtcnggggacagacttcactctcactntcagccagcctagacgcctagaagtattttgacttattttacttacgtgtactagtcagcgtgcctagtcgtcttctctcgtttcgggcggtaggaaccgaggtggacgaccgagaccgtagtgtaggctgacacntctcgtcttcactcctcccg

SEQ ID NO: 217546 - DNA, 745 bp, Homo sapiens
  misc_feature: GYAE6OF02I7EDI.9.3.A03.1.454.CMB.1.raw
  modified_base (294)..(294): a, c, t, g, unknown or other
  misc_feature (294)..(294): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctccctgcagggccagtcagagtgttggcacctacgtagcctggtaccaacagaactcctggccaggcctcccaggctcctctatttangatgcactccaacgcggggccacgtcgggccgtaccccgagtcccgtaggtttccgaggttcggccgtagggttcggggttcgtacgggggaaccacggtaccgtttctaaccgttccttaacccaccctacgttccgaagtacccgaacgtcccgtaagtaaccggacccgttaaggaaacggtttacgttttacggtactttaacgtttttaaactttaccgttacggttacctaaggttccgaacggtccggttacgacccgtaaggttcggtcctttaccgttaccgttaccggtttccgggaccggggtaacgggtaaaccggtaagggtacggaacggaacccgaggtaccggtaaacggttcggtacgggtaaccgttcgacccgtaaccggtacgtttaccggttacgtttacccgtttacctacctttccccgttaccccgg

SEQ ID NO: 217547 - DNA, 725 bp, Homo sapiens
  misc_feature: GYAE6OF02HNVGB.9.3.A03.1.454.CMB.1.raw
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (406)..(406): a, c, t, g, unknown or other
  misc_feature (406)..(406): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtcctccgaaggggaaagacgtcccaccctctcctgcagggccagtcagagtgttggcacctacgtagcctggtaccaanagaatccgnggccaggcctccaggcctcctacatttangatgacactaccaacgacgggccacgtcggccgtcccacgccgtagggtttcaggtcggcgtaggttcgggtcgtggggacacgtactttcacctcgtaccaaccgtntaccgacggactacggtaccgtaaggacgtacccgtaaggtaaacgttagttttacgactttaattttacttaacgtcgttacacggtactacggttaccgtacggtacccgtaaagggttcgggtaccttttaccgtaccgtttaccggttttccggggaccggggttaacggggtaacccgtaaaggggtaccggtaacgggtaacccgtacgggtaaccggtaaccggttcgggaccgggttacctaccgggtaacccgaaccgttacggtaccgtttccggttacctttacccgtacgtttaccccttaccccgg

SEQ ID NO: 217548 - DNA, 646 bp, Homo sapiens
  misc_feature: GYAE6OF02JFFVX.9.3.A03.1.454.CMB.1.raw
  modified_base (223)..(223): a, c, t, g, unknown or other
  misc_feature (223)..(223): n is a, c, g, or t
  modified_base (253)..(253): a, c, t, g, unknown or other
  misc_feature (253)..(253): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (391)..(391): a, c, t, g, unknown or other
  misc_feature (391)..(391): n is a, c, g, or t
tcagtgatacgtctcacgaccggtgctcgatttagagagcgtcacagggggaggaacgtgctcagttaggacccagagggaaccatggaagcccagctcagcttctcttcctcctgctactctggctcccagtgaccaccggagaaattgtgttgacacagtctccagccaccctgtccttgtctccagggaaagagccacctctcctgcagggccagtcagngtgttcggcacctagtagcctggtaccaangaactcctggccaggcctcccgaggctcctnactttangatgcactccaacgacgggccaactcggccgtcccagtcccaggttccaggtgcgaggtcggtctaggggtacaggtacctttcgacttctacaaccgtntcgagcacgtcctacggacgcctaggtaagtacgtttttcgacttatttttacgtacgttgttacaacggtcctaaggtccgtacgtacccgtaaaggttcggtacttttaccctaccgtttcggttccgggaacggggttaccgggaaaccgtaggtaacggggaactaccggacgtaaccgtacggttggtacgtacggttcgaacctacgtacgttaccgttgttcctacggttaccttccggtacccccgg

SEQ ID NO: 217549 - DNA, 639 bp, Homo sapiens
  misc_feature: GYAE6OF02F2D02.9.3.A03.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaagngccaccctctcctgcagggccagtcagagtgttggcacctacgtagcctggtaacccaanagaatcctggccaggcctcccaggcctcctctatttatgatgcatcccaaacgcgggcccacgtggccgtcccagcccgaggttccaggtggctaggtcgggtctggggactaggtacttcgacttctacaaccatcagccacgcctagacgcctagaagtattttcgcttattttattactgtacagctacggcgttacgacctaaggtcggtcctttctcgttaccgtttcgggccgggtaacgggtaaccgaaggggtcgggaacgacccgaaggtaacccggtaacgttcggggtacggtaccgtaccggaacctaacccggttagttcccggttcggttaccctttacgtaaccgtttccccgtttaaccccccgg

SEQ ID NO: 217550 - DNA, 524 bp, Homo sapiens
  misc_feature: GYAE6OF02F1I1L.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtattgacacagtctccagccaccctgtccttgtctccaggggaaangccaccctctcctgcagggccagtcagagtgttggcacctacgtagcctggtaaccaacagaactcctggccaggcctcccaggcctcctctatttatgatgcatccaacgagggcccacgtggccgtcccagcccaggttcaggtgcaggtggtctgggacagaccttcactctcacatcagcagctagcgcctgaagtatttgctatttatactgtcagcagcgtcgctaagtgccttctctacgtttcggcggacggacgaggtgacgaccgaggacgacgtggtcggctcgcaccgtattcgtcgtcttctacgtccttacccg

SEQ ID NO: 217551 - DNA, 837 bp, Homo sapiens
  misc_feature: GYAE6OF02JG325.9.3.A03.1.454.CMB.1.raw
  modified_base (204)..(204): a, c, t, g, unknown or other
  misc_feature (204)..(204): n is a, c, g, or t
  modified_base (407)..(407): a, c, t, g, unknown or other
  misc_feature (407)..(407): n is a, c, g, or t
tcagtgatacgtctcacgaccggtgctcgatttagagagcgtcacagggggaggaacgtgctcagttaggacccagagggaaccatggaagccccagctcagcttctcttcctcctgctactctggcctcccagtcgaccaccggagaaattgtgttgacacagtctccagcccaccctgtccttgtcctccgaaggggaaacngccaccctctcctgcagggccagtcagtagtgttggctaccgtacgtagcctgggtaacccaacgagaaacttccctgggcccaggcctacccgaggcctcctctatttactgatcgcactccaacgcggccacgtggccgtcccagccctaggttcaggtcgctaggtggtcgtaggggacctaggtacctttcaacgttcncctaaccagtccaacggccaacgtcccgtaaggacctcccgtaaggtaaacgtttacgttttagaaccgttttaacttttttaaacgtttaccgtttaccggttaccgtaaacgggtacccgttaaacgggtcccggtttaaccgggtaaccccggttaaaacgggttttcggggttaacccctttttttcccggttaaccccggtttaaacccggggttttttaccccggggggtaaccggggggtaaacccggggttaacccgggtaaaaaggggtttccgggaaaaccgggttaacccggacggggttaaaccgttaaccgggttacgggtacgggtacccgttaccgggacccgttaaccggtaccgttaccggttttaccggttaccctttacggttacccgtttacccccggttttaaccccgg

SEQ ID NO: 217552 - DNA, 652 bp, Homo sapiens
  misc_feature: GYAE6OF02JCJF5.9.3.A03.1.454.CMB.1.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
tcagtgatacgtctcacgaccggtgctcgatttagagagcgtcacagggggaggaacgtgctcagttaggacccagagggaaccatggaagccccagctcagcttctcttcctcctgctactctggctcccagtgaccaccggagaaattgtgttgacacagtctccagccaccctgtccttgtctccaggggaaangccacctctcctgcagggccagtcagagtgttggcacctacgtagccctggtaccaacagaatcctggccaggcctcccgaggctcctcatttangatgcatccaaacgngggccacgtggccgtcccagccaggttcagtcggctaggtggtctggggacaggactttcacgtctacaccatcaagcaggcctaagacgcctaggaacgtagtttttgacttaatttttaactacgttcgttacaggtccaaggtccgttagcccgtaaggttcggtactttccgtacgtaccgttttcgggacgggtaacgggtaccgtaaaggggttcggaacgtacccgtacggtaaaccggtaaccgttgggttaccgggtaccgttaccgggacccgttaacccgtacgtttacgttaccggttacccttttaccgtaactttccccggttacccccgg

SEQ ID NO: 217553 - DNA, 603 bp, Homo sapiens
  misc_feature: GYAE6OF02GHK8N.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaagagccaccctctcctgcagggccagtcagagtgttggcacctacgtagcctggtaccaacagaactcctggccaggcctcccgaggcctcctcatttatgatgcactccaacgacgggccacgtggcctcccagcctaggttcaggtggctaggtgggtctggggacaggtactttcactctcgaccatcagccagcctagacgccgtagaagtatttgacttaattttattacgttgttactagtcgacgtcgtacgaccgtaaggttcggtccttccgttcgtaccgtttcgggacgggtacgggtaaccgtagggtacggaacgaccgacggaacggtaacggtgggtacggtccgtcgacctaccgtactccgttacgttcttaccgtacttcccgttccccg

SEQ ID NO: 217554 - DNA, 559 bp, Homo sapiens
  misc_feature: GYAE6OF02FNJ3I.9.3.A03.1.454.CMB.1.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
  modified_base (456)..(456): a, c, t, g, unknown or other
  misc_feature (456)..(456): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctagtagcctggtaccaacagaatcctggccaggcctcccaggcctcctctatttangatgcatccaacgagggcccactggcgtcccagcctaggttcaggttggcaggtgggtcnggggacagactttcacttctacaccctatccagccagcctagacgcctagaagtattttgacttattttattactgtactagcagtcgtgctaagtggtccttntcgtacgttttcgggcgggtaacgggacgtaaggtaggacgaccgaggacgtaacgtggtcggacgtcgacaccgtgtcgttcgttcttctacttccttcccg

SEQ ID NO: 217555 - DNA, 755 bp, Homo sapiens
  misc_feature: GYAE6OF02JSLMG.9.3.A03.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
tcagtgatacgtctcacgaccggtgctcgatttagagagcgtcacagggggaggaactgctcagttagaccagagggaaccatggaagccccagctcagcttctcttcctcctgctactctggctcccagtgaccaccggagaaattgtgttgacacagtctccagccaccctgtccttgtctccgaggggaaagngccacctctcctgcagggccagtcagagtgtgcacctacgtagcctggtaaccacagaactccgtggccaggcctcccgaggcctcctctaatttagngactcgctactaccaacggacgggtcccaacgtcggtacctcccgagcccgtagggttccaggtcggcctaggggttcggtcaggggacctacgtacgtttccaacgttccgtaccaaccacttccgaaacgtccgacgtaaccgttacggaccgtaccgttaaggtaaccgttacgttttacggaccgtttaacgttttaacgttacgtttacggttacgtaacgttaccgaacgggttccggttaaccgtaccgtaacgggttccgtacgtttaccgttaccgtttaacgggtttcccggggacggggtaaaccgggtaacggtaaacggggttaccggaacgtaacccggtaaggtaaccggtacggttacggggttaggaacccgttacgggtaccctaaccggttcttaccggttaccggtttaccgtacccgttaaccgtttccccgtaccccgg

SEQ ID NO: 217556 - DNA, 661 bp, Homo sapiens
  misc_feature: GYAE6OF02JBI5X.9.3.A03.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccgggagaaattgtgttgacacagtctccagccaccctgtccttgtctccaggggaangccaccctctcctgcagggccagtcagagtgttggctaccgtacgtagccctggtacccaacagaactccgtggccaggcctcccgaggcctccgtctattttagngatgcactaccaacgacgggccacgtggtccgtccccagcccgtaggttcaggtggcaggttgggcgtgggacaggtacttcgactcgtaccactatcagctacgcctagacgtacctagaacgttatttagtacgttaatttttaacgttacttcgttacgtagtccgtaaggtccgtagtacccggtaaggttcggtctttaccgttcgtaccgttttaccggggacgggtaacgggtaaccgaacgggttagggaaccggtaaccgtaacggaacggtaaccgtcgggtacggtaccgtcggtaaccgtaccgtaacgttcgtaccgtttctaccgttactttcccgttaccccgg

SEQ ID NO: 217557 - DNA, 535 bp, Homo sapiens
  misc_feature: GYAE6OF02FRT2H.9.3.A03.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (510)..(510): a, c, t, g, unknown or other
  misc_feature (510)..(510): n is a, c, g, or t
  modified_base (523)..(523): a, c, t, g, unknown or other
  misc_feature (523)..(523): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagngccaccctctcctgcagggccagtcagagtgttggcacctacgtagcctggtaaccaacagaactcctggccaggcctcccgaggcctcctcatttangatgcatccaacgcgggccacgtggctcccagccaggttcagtggcaggtgggtctggggacagtactttcgactctcaaccntcagcaagcctagacnctagagtatttgcttatttatactgtcagcagtcgtcgctagtgtcttacgttacgtttcgggcggtagggaccgtaaggtcggaacgacgagacgacgtggtggctgacaccgtnttctcgttcttcncttccttcccgc

SEQ ID NO: 217558 - DNA, 565 bp, Homo sapiens
  misc_feature: GYAE6OF02ITLJ7.9.3.A03.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaanagaatcctggccaggcctccccaggcctcctcatttangntgcatccaagngggccactggcctcccagcccaggttcaggtggcaggttgggtctggggacngacttcactcncaaccntccagcagcctagacgacctagaagtgtttgacttatttatacttgtcagacagcgtagacctaaggtcgtcttctaccgtacgtttccggggacgtaacgggaccgaaaggttggacgtaccgagtaccgtaacgtggtacggacgtcgacctacctagttccgttgtcctttacgtcttccttacccgg

SEQ ID NO: 217559 - DNA, 554 bp, Homo sapiens
  misc_feature: GYAE6OF02IKNFZ.9.3.A03.1.454.CMB.1.raw
  modified_base (197)..(197): a, c, t, g, unknown or other
  misc_feature (197)..(197): n is a, c, g, or t
  modified_base (304)..(304): a, c, t, g, unknown or other
  misc_feature (304)..(304): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagccctggtaccaacagaaatcctggccaggctcccaggctcctcatttatgatgcatccaanagggccaacgtggcgtcccagcccaggttcagtcggcagtggtctggggacagacttcactctcaccatcagcagcctagacgcctgaagtattttgactatttattactgtcagtcagcgtgccaagtcgcttctcctacgtttcgggacggaggtaaccgaaggtcggacgtaccgaggacgaacgtggtacggcgttacggacctaaccgtattccgttaggttaccttactacgttccttaccccg

SEQ ID NO: 217560 - DNA, 609 bp, Homo sapiens
  misc_feature: GYAE6OF02F66D3.9.3.A03.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (306)..(306): a, c, t, g, unknown or other
  misc_feature (306)..(306): n is a, c, g, or t
  modified_base (322)..(322): a, c, t, g, unknown or other
  misc_feature (322)..(322): n is a, c, g, or t
tcagtgatacgtctcacgaccggtgctcgatttagagagcgtcacagggggaggaactgctcagttaggacccagagggaaccatggaagccccagctcagcttctcttcctcctgctactctggcctcccagtgaccaccggagaaatttgtgttgacacagtctccagcccaccctgtccttgtctccgaggggaaangccaccctctcctgcagggccagtcagagtgttggccacctacgtagccttggtacccaanagaacttcccgtggccaggtcctcccgaggctcctctattttagngatgctaatccaacgngggccacgtggccgtcccagcctaggttcaggtggcaggtggtctggggacagtacttcactctacacctatcagcacgctagacgctagaagtatttgcttatttatactgtacagctagtcgtgacgtaaggttcgtcctttccgttcgtaccgtttccgggacgggtacgggaacccgtaaagggttcgggacgaccgacggtaaccgtaacgttcggtacggtccgtacgtcccgaccgtacgttccgttaccgttcctttaccgtactttcccgttaccccg

SEQ ID NO: 217561 - DNA, 742 bp, Homo sapiens
  misc_feature: GYAE6OF02GY0RN.9.3.A03.1.454.CMB.1.raw
  modified_base (331)..(331): a, c, t, g, unknown or other
  misc_feature (331)..(331): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccacgccaccctgtccttgtcctccgaaggggaaagacgcccaccctctccgtgcgacgggccagtcagagtggttggccaccgtacgtacgcctgggtaaccaacacggaacttcccgtcgggaccctaagggccttaccccgaggtccctccttactattttacngtattcgacctactacccgaaacggacgggcctacgtcggccgtaccctactacccgtagggttccaggtcggacgtagggtcgggtacgtacggggacaggtacctttcgacttcgtaccactataccgagccacggtaccgtacgacgtaccgtacgtaagttacgttttacgtactttaagttttacttacgttagtacgtacgtacgtacggtccgtacgaccgtaacgggttcggtacccgttaccgttaccgtaccggtttccgggaccgggtacggggtaacccggtaacgggtacgggtaaccgtaccggtaacggtaaccggtacggttacgggtacggtaccgtacggaccgtaccgtacgttcgttaccgttccgttacctaccgttacccgttaccccg

SEQ ID NO: 217562 - DNA, 530 bp, Homo sapiens
  misc_feature: GYAE6OF02FU346.9.3.A03.1.454.CMB.1.raw
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttangatgcatccaacgngggcccacgtcggccgtccccagcctaggttcaggtcggctaggtgggtctggggacngtacttcactctcaccatcagcagcctagacgtcctgaagtnttttgacttattttatactgtacagcagcgtcgctaagtgtcttctcgtacgtttcggcggtacgggacgaaggtggacgaccgagacgacgtggcgctgacacgatctgtcctctactctacccg

SEQ ID NO: 217563 - DNA, 647 bp, Homo sapiens
  misc_feature: GYAE6OF02G5MSD.9.3.A03.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (255)..(255): a, c, t, g, unknown or other
  misc_feature (255)..(255): n is a, c, g, or t
  modified_base (292)..(292): a, c, t, g, unknown or other
  misc_feature (292)..(292): n is a, c, g, or t
  modified_base (449)..(449): a, c, t, g, unknown or other
  misc_feature (449)..(449): n is a, c, g, or t
  modified_base (479)..(479): a, c, t, g, unknown or other
  misc_feature (479)..(479): n is a, c, g, or t
  modified_base (486)..(486): a, c, t, g, unknown or other
  misc_feature (486)..(486): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccgaggggaaagngccaccctctcctgcagggccagtcagngtgttggcacctagtgcctggtaccaangaactcctggccaggcctcccaggcctcctcatttangatgcactaccaacggacgggcccacgtcggcccgtcccagcccgtagggttcaggtcggccggtaggttcgggtcgtagggggactacggtacctttacgaccttctaccacccatccaacggccacgtaccgtaggacgtactacggtaaagttnttttcgactttacttttattaccgttgtanacgtacncggtcgtcgacctaggttcgtcgtttctcgttaccggttcggacgggacgggtaccgtagggtcgaacggaccggacgtaacggtaacggttggaccggtcgttaccgccctaccgtacgttccgttccgttaccttcccgtactttacccgttcccccgg

SEQ ID NO: 217564 - DNA, 665 bp, Homo sapiens
  misc_feature: GYAE6OF02GU7L3.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtcctccgaggggaaagagccaccctctcctgcaggccagtcagagtgttggcacctacgtagcctggaccaacagaactcctaggccaggcctacccgaggccttcctctatttatgtactgctactacccaacgacgggtccacgtcggacctcccagcccgtagggttaccaggtcggctacggggtgggttccggtaggggaactacggtcctttaccacgtccgttaccacccgtatccacgtccgaacgtccgtaacgtacgtcctaggtaaacgtttattttcggactttaattttattaccgtagttacgaacgtcgtacggccggttagtaaccggtaaggttcggtcctttccttaccggttacgttcgggacgggtacgggaacgtaggtacggacgacgacgaacgtacggtcggtaggtaccgacgtcctaccgtacgtcgttaccgttactccgttacttcccgtacccg

SEQ ID NO: 217565 - DNA, 556 bp, Homo sapiens
  misc_feature: GYAE6OF02FW71M.9.3.A03.1.454.CMB.1.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagagtgttggcacctagtagcctggtaccaacagaatcctggccaggcctcccgaggcctcctcatttangatgcatccaacgagggcccacgtggccgtcccaggccaggttcaggtggacaggtcggtctggggactagtaccttcacttctcacatcagcagcctagacgcctagaagtattttgacttatttatactgtcagcagtcgtgacctaggtggtcttctctacgtttcgggacggtacgggaccgtaaggtcggacgaccgagacgtaacgtggtacggctcgacctacctagttcctacgttccttactacttcccttcccg

SEQ ID NO: 217566 - DNA, 630 bp, Homo sapiens
  misc_feature: GYAE6OF02FHCHX.9.3.A03.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaacngccacccgtctcctgcagggccagtcagagtgttcggcacctacgtagcctggtacccaacagaactcctggccaggcctcccgaggcctcctntattttancgatcgcatacccaangggcctacgnggccgtccccagcctaggttcaggttgcgtaggtcgggtctgggacaggtccttcgacttctccgaacctatccagccacgtccctagacgcctagaacgttacttttgacttagttttaactacgtcgttacgacgtccagtccgtcgaccgtaaggttcgtccttactcgtaacgttttaccggggacggtaacgggtaccgaagggtcggtacgacccgtaggaaccgaccgttgggtcggtaccgtacgaccgtaccgtacgttcgttaccggttccttacgtactttcccgttaccccg

SEQ ID NO: 217567 - DNA, 570 bp, Homo sapiens
  misc_feature: GYAE6OF02IA0CV.9.3.A03.1.454.CMB.1.raw
  modified_base (196)..(196): a, c, t, g, unknown or other
  misc_feature (196)..(196): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (544)..(544): a, c, t, g, unknown or other
  misc_feature (544)..(544): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaacagaactcctaggccaggcctcccgaggctcctnaatttntgatgcactaccaagcgggccacgtcggccgtcccaggtcccaggttcaggtcggcaggtgggtcgtgggacaggtactttcgactctaccaccatcagcacgtcctagacgcctagtaagtattttcgacttattttatacgttgtctagctagcgtgcaaggtgtcttctgtcgttcgggcggtacgggtaccgagggtacgacgaccaggaaccgtacgtggtggactcgaccaaccgttgtaccgtnttccttacgtaccttccttaccccgg

SEQ ID NO: 217568 - DNA, 775 bp, Homo sapiens
  misc_feature: GYAE6OF02GKAE8.9.3.A03.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtctccgaggggaaangccaccctctcctgcagggccagtcagngtgttgcacctagtagcctggaccaanagaactcctggccaggcctccgaggcctcctcatttatgatcgacactacccgaacgacgggccctacgtcgggccgtccccgaagtcccgtaagggtttccaagggttcgggaccgtagggtttcggggtacctagggggaaccacggtaccttttcgaaccgttcctacccaacccgtactccgaacggtccgtaacgaccccgtaaggaacgtcccttaaggtaaacgttagtttttacggacctttaacgtttttacttaaccgtttcgttaccgtaacgtacgtaacggtccggttaccgaacccggtaagggttacgggttccgtttaccgttacccgtttaacggtttttcccggggaccggggtaacggggtaaacccggttaaacggggttacgggaaccggaacccggtacggtaaccggtaaaccggttgggtaccggtaccggttaccgacccgtaaccgttacgttaccgttacggttcctttaccgttaccgttcccgttacccccgg

SEQ ID NO: 217569 - DNA, 553 bp, Homo sapiens
  misc_feature: GYAE6OF02GGZSF.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctacgtagcctggtaccaacagaactcctggccaggcctcccaggcctcctcatttatgatgcatccaaacacgggccacgtggccgtcccagccctagggttcaggtcggctaggtcgggtctggggacaggactttcactctcaccatccagcacgcctagacgcctagaagtatttgacttattttatactgtactagcagtcgtcgacctaagtcggtctttcgtcgtacgtttcgggacggtacgggacaagggtcgagaccagacgtacgtggtagcgtcgaccactagttctgttcttctactccgttcccg

SEQ ID NO: 217570 - DNA, 597 bp, Homo sapiens
  misc_feature: GYAE6OF02GF6NM.9.3.A03.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (297)..(297): a, c, t, g, unknown or other
  misc_feature (297)..(297): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagngtgttggcacctagtagcctggtacccaanagaactccgtggccaggcctcccgaggcctcctacattttacngatgaccatcccaaagcgggcccagtcggcctcccagccaggttcagtggcagtggtctgggacagtacttcactctacactatcagcagcctagacgcctagtaagtattttacgcttattttacttacttgtactagcgtagtcgtcgacgtaaggtcgtcttcgtcttaccgtttcgggacggtacgggtaaccgtaagggtacggaacgaccaggtaccgtaacgtcgggtacggccgtacggaccgtacgtacgttccgttacggttacctttaccgtacttcccgttacccccg

SEQ ID NO: 217571 - DNA, 751 bp, Homo sapiens
  misc_feature: GYAE6OF02HDE7E.9.3.A03.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccacctgtccttgtctccaggggaaancgccaccctctcctgcgaggccagtcagagtgttggcacctagagcctggtaccaacagaatccgtggccaggcctccgaggcctcctnatttacngatgcactccaacgcgggtccacgtcggcctcccgagcctaggttcaggtcgggctaggggtcggtcgtaggggaactaggtacctttacgacctctaccgaaccctagtaccacggtaccgtacgtacccgtaagacggtacccttaagggaacgttactttttacggaccttttaaagttttaactttacgttcgttaaccgtagtaccgtacgtaccgttacggtaacctaacgggttcggttccgtttacccgttccgtttaacccgggtttacggggtaacccggggtaaccggggtaaacccggtaaaggggttaccggaaacgggttaacccgacgggtaaaccggttaaccggttaacgggttaccggaccgtaccggtaacccgtaaccgttaaccgttacccggttcggttaaccctttaccgttaccggttacccctttacccccggg

SEQ ID NO: 217572 - DNA, 554 bp, Homo sapiens
  misc_feature: GYAE6OF02FT0ZP.9.3.A03.1.454.CMB.1.raw
  modified_base (135)..(135): a, c, t, g, unknown or other
  misc_feature (135)..(135): n is a, c, g, or t
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtnaccaccggagaaattgtgttgacacagtctccagccaccctgtccttgtctccaggggaaangccaccctctcctgcagggccagtcagagtgttggcacctagtagcctggtaccaacagaatcctggccaggcctcccgaggctcctcattttangatgacatccaacacgggccacgtggcctcccagccaggttcaggtcggcaggtcggtctggggacngacttcacgtcncacatcagtcagcctagacgctagaagtatttgactagttttatactgtcagctagcgtacgaccgtaagtcggtccttacgtcttaccgtttcgggacggtacgggacaagggtggactaccgagacggaactggtcggactaggaccacgtattcgttacgtactctacgtccttaccccg

SEQ ID NO: 217573 - DNA, 697 bp, Homo sapiens
  misc_feature: GYAE6OF02ITRF8.9.3.A03.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagagtgttggcacctacgtagcctggtaccaacagaatcctggccaggcctcccaggcctcctctattttancgattgacactaccaacgacgggaccctacctgggccctacccgaagccgtaggtttccaggttggcctaggtcgggtcgttagggggaaccaggtactttccgaacttccgtaccacctacttccagccaacggaccttaaggacgcccgttagaaagttacttttaggactttaattttaacttacttgtactagctaggtcgttagccgtaacgttggacctttccgtaccgttacgtttccggggacgggaacgggttaaacccggtaaggggtcgggaacgtaacccggaggtaaaccggtaacgttcgggttacgggtacgtaaccggtaccgaacccggtacgtttacccgttcggttaccctttacccgttaccgtttccccgtttaacccccgg

SEQ ID NO: 217574 - DNA, 635 bp, Homo sapiens
  misc_feature: GYAE6OF02GGDDD.9.3.A03.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
  modified_base (427)..(427): a, c, t, g, unknown or other
  misc_feature (427)..(427): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagagtgttggcaccgtacgtagcctaggtaccaanagaactcctggccaggcctcccgaggcctcctcatttangatgctatccaacgngggccacgtcggcctacccagccgtaggttcaggtggcaggttcggtactggggaacagtacctttcacgttcctacgacctatcagcctagcccgtagacgtccgtagtaagttnttttgactttaattttataccgttgtacagtctacggcgttacgaccgtaaggttcgtacctttcgtaccgttacggtttcgggaccggggtaacggtaacccgtaagggtcggaacgtacccgaaggtacggtaacgtgggtacggtaccgttacggacctaccgtacttccgtcggtttacctcgttaccgttcccttacccccgg

SEQ ID NO: 217575 - DNA, 610 bp, Homo sapiens
  misc_feature: GYAE6OF02ITJJJ.9.3.A03.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (290)..(290): a, c, t, g, unknown or other
  misc_feature (290)..(290): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaanagccaccctctcctgcagggccagtcagngtgtggcacctacgtagcctggtaccaacagaactcctggccaggcctcccaggctcctcatttangatgcatccaacgcgggccacgtggcctcccaggcctaggttcagtggctaggtcgggtctggggacagtacttcactcacacatcgagccagccgtagacgtccgtagaagttatttcgattaattttacttactgttacagcaggtcgtacgaccgtaagtcggtcctttcgtacgtacgtttcgggaccgggtagggtaaccgtacgggtacgggacgtaaccggacggaacggtaaccggtggtacgggtaccgttacggaccgtaaccgtactttccggttacgttacctttaccgttacgttccccttacccgg

SEQ ID NO: 217576 - DNA, 844 bp, Homo sapiens
  misc_feature: GYAE6OF02HWQH4.9.3.A03.1.454.CMB.1.raw
  modified_base (199)..(199): a, c, t, g, unknown or other
  misc_feature (199)..(199): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtcctccgaggggaaanacgccaccctctcctgcacgggccagtcagagtgttgcactacgtagcctaggtaccaacagaatcccgtaggccaggcctacccgaggtccctccttactaacttttatagtattcgacctaactaccccgaaaacggacgggtaccctacgttccgggccgttaccccgaggtacccgtaagggtttccgaaggttcgggaccgtagggtcgggttcgtagggggaactaggttacctttcaccgttcacctaacccgtatccgacgactacggtaccgtaaggacgtacccgttaggtaaacggtttacgtttttacggtaacttttaacgtttttaaacgtttaccgttacggttacgtacggttacccgaaggttcccgggttacgtaacccggtaaacgggtttccggggttaccttttacccgttacccggtttaaccgggtttttcccggggggaacgggggttaaaccggggttaaccggggtaaacggggtttacgggaaccgggtaacccggtaacgggtaaccgggtttaacggtcgggttacggtccggttaccggtaacccgttacccgttacgttaccggtttaccgttttaccgtttacccgttacccgtttaccccggttacccccgg

SEQ ID NO: 217577 - DNA, 868 bp, Homo sapiens
  misc_feature: GYAE6OF02IV72Y.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgttccttgtcctccgaggggaaagacgcccaccctctccctgccgacgggcctaggtcagagttgttcggccaccgttacgacgccctaggtaccaacgagaactccgtggccaggcctaccccgaggtcctccgtcttatttatacgattcgactacttacccgaaaggaccgggcctaacgtcggtaccccgtcccgaacggtcccgtaagggtttaccgagggttcgggaccgtaaggggttcgggttaccgtagggggaccaggttacctttcgaccttccgactaccagttccagtcctacggacccgtaagacggtacccgttaaggtaacgttttaacgttttcggtacttttaactttttaaccgtttacgttacgtaccgtaagggtacctaacgggttacccgttacggaccggttaaacggttccgggttacccggttttaaccttcccgggtttaaacccgggtttaccggggggtaacccggggtaaccggggtttaaaccgggaaacggggttacccggggtaaaccgaaacccgggttaacgtaacccgggtttaaccggggttcgggttacccgggtaaacgggttccccggaaccgttaacccgttaccggtttaaccgttttccgggtttaaaccctttcccgttaacccggtttccccccggtttaacccccgg

SEQ ID NO: 217578 - DNA, 772 bp, Homo sapiens
  misc_feature: GYAE6OF02IQOBO.9.3.A03.1.454.CMB.1.raw
  modified_base (176)..(176): a, c, t, g, unknown or other
  misc_feature (176)..(176): n is a, c, g, or t
tcagtgatacgtctcacgaccggtgctcgatttagagagcgtcacaggggggtaggggaactggctccagttacggtacccgagtacgggaaccattggaagtccccagctcacgcgttctcttacctcctgctactctcgctcccagttgaccaccgagaaattgtgtttcgacncagtctcctaagccacctgtccttgtctcgagggaagcgccaccgtcggtcctgcgacggcgacgtcagtacgttcgttggacctacctacgtacggtccttcggtaacccaacaacgtaacgtcccgtcgggacctacggtccgtacccgacgggtcctcctacgtactttacgtaggacgtcgcgtacgtaccgtaacgtacgggtaaccctaacggtacggtaccggtaccggtacggaccgtaggttaccggaacggttcggacgtacggttaccgggtcgtacggggactacgtaccgtttacacgtcctacgtacctacgtacagcctcgtaccgtaagacgtaccgtagtaacgtttagtttctacttaagtttacctaacgttcgtaaccgtaacgtcgttaacggaccgttacgtaccgtaagggttcgtaccttacgttacgttaccggtttacgggacgggtaaccgggtaccgtaaacgggtccgggtaacgtacccggaagtaaccgtacgtaggttccggacttaacggtacccgtacgttacgttccggtacttccggtttaccaccgtttccctacccgg

SEQ ID NO: 217579 - DNA, 798 bp, Homo sapiens
  misc_feature: GYAE6OF02INRIW.9.3.A03.1.454.CMB.1.raw
  modified_base (198)..(198): a, c, t, g, unknown or other
  misc_feature (198)..(198): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtcctccgagggaaagngccaccctctcctgcgagggcagtcagagtgttaggctacgtacgtacgcctaggtacaaccgagaactcccgtaggccaaggccttacccgaaggtcctccctatacttttagacgtaattcgactactaccgaaacgtaccgggaccctaacgttcgggacccgttaccccgacggacccgtaacgggtttccaacgggttcggggaaccgttaagggttaccggggtccgttacgggggaaacctacggtaaccgttttaccgaacccgttccgtaccctaaccgtaacgttccgtaaacggaccgtaacgtcccgttaaacggaccgtaccccgttaaggtaaacgtttagtttaccgtaacgtttaacgttttaacgtttaccggtagttaacccgtaggtaccgttaacggtcgttaaaccgggtacctaaacgggttccgttaacgtttccgtaaccgtttaaccggtttcgggtaaccgggaacggttaacccgaagggtaacggtaacgtacccgaaggttacgtaccgtaggcgtacgtacggacctacgtaacgttcgtaacgttccctagttccgtacccttacccgg

SEQ ID NO: 217580 - DNA, 559 bp, Homo sapiens
  misc_feature: GYAE6OF02FXS13.9.3.A03.1.454.CMB.1.raw
  modified_base (294)..(294): a, c, t, g, unknown or other
  misc_feature (294)..(294): n is a, c, g, or t
  modified_base (418)..(418): a, c, t, g, unknown or other
  misc_feature (418)..(418): n is a, c, g, or t
  modified_base (536)..(536): a, c, t, g, unknown or other
  misc_feature (536)..(536): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaagagccaccctctcctgcagggccagtcagagtgttggcacctacgtagcctggtaccaacagaactcctggccaggcctcccaggctcctctatttangatgcagtcccaacgacgggcccacgtggccgtaccccagcccgtaggttcaggtggcgtaaggtcgggtcgtggggacaggtaccttcgacttcacaccatcagcagcctagacgctgaagtntttgcttatttatactgtacagcagtcgtacgtcctaaggtcggtcttcgttcttacgtttccgggcggtacgggaccagggttggacgaccgagaacgtagtggtgcgtcgcacctntcgtgtctcgtactccgtacccg

SEQ ID NO: 217581 - DNA, 861 bp, Homo sapiens
  misc_feature: GYAE6OF02JUVNZ.9.3.A03.1.454.CMB.1.raw
  modified_base (200)..(200): a, c, t, g, unknown or other
  misc_feature (200)..(200): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtcctccgaaggggaaancgccctaccctctcctgcgacgggccagtcaggtagttgttggacctaccgttacggtacgcccttagggtaaaccaacgaggtaactccgtagggacccaggcctacccgaggtcccttccgtcgtaagttttacgagtacttcggacctaacgtcccgaaacggcgggtaccctaacgtcggtacccgtacccacggtacccgtaacgggttccacgggtcggcgtacggggttcgggtaccgtaggggaacctacggttacctttaccgtaaccttcccgtaaccgtaaccctaacgttaccggacgtacccgtacggtacccgtacggaccggtacccggttaacgtaaacggtttaacgttttacggtaaccttttaacgtttttaaaccgttacgtttacggttaccgaaccggtttaccgtaaccggttccgttaccggtaaccgtaacggtttcgggtacccttttaccgttacccggtttacgggtttccgggaaccggggtacgggttaacccggtaaaggggttaaccggaaccggtaacccgtacggaaccggttaacggttccgggtaaccgggttcgtaaccggtacccgtaccgttacgttaccgttccggttacctttacccgtaccgttaccccgtttacccgg

SEQ ID NO: 217582 - DNA, 840 bp, Homo sapiens
  misc_feature: GYAE6OF02FHNE4.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtcccttgtctccgaggggaaagacgccaccctctcctgcacgggccagtcgagagtgttcggcaccgtacgtacgccgttggtaacccaacaggtaacttccctgggcccaagggcctccccgagggccttccccgtactaatttttagtcggtaattcggactaacgttcccaaaacgtacggggccctaaccgtgggtcccgtcccccgaggccctaagggtttccaagggtcgggacctagggtcgggggttaccttagggggaactacggtaaccgtttcctaaccgtttcctacccgaaccctacgttaccgaacgtccctaacggacccttaacgggaccgtcccgttaggtaaacggtttacgtttttacggtaccttttaaattttttaacgttaaccgtttcgtttaaccgttacggtacgttaacggtccggttccgtaacccgttaaagggttcgggttaccgtttaccgttaccgtttacccggttttccgggggtaaccggggttaaccggggtaaacccggtaaagggggttacggaacggtaacccgtacgggtaaccggtaacgttcggggtaccggtaccggttacggacccgtaccgtacgttccgttacggttaccctttacctaccgtttccccgttaccccgg

SEQ ID NO: 217583 - DNA, 748 bp, Homo sapiens
  misc_feature: GYAE6OF02JN64O.9.3.A03.1.454.CMB.1.raw
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
  modified_base (421)..(421): a, c, t, g, unknown or other
  misc_feature (421)..(421): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtcaccaccggagaaattgtgttgaacacagtctccacgcccaccctgtccttgtctccgaaggggaanacgccaccctctcctgcgagggccaggtcagtacgtggtcgcacctacgtacgcctcggtaaccaacgagtaactccgtcggccacggcctccgacggtcctacctctatttangagttcgactactaccgaaacggaccggacctaccggtcggaccgtcccgacgtacccgtaaggttctacgggtcgaccggtaggttcgggtcgtacggggaacgnggtacttcgtactcgacctactacacgtacgtacgaccgtacgtacgaacgtaccgtaacgtaaacgtttacgttttacgttaacgtttaactttttacgttacttttacgtacgtacggaccgttaacggaccgttccgtaacgttaacgggttcgttacgtttaccttacggtttaccggttaccgggtaaccgggggttaacgggtacccggtaaagggttaaccgggaacgtaaccggacggtaaccgaacgggttcggtaccgtacggtcgaaccttacctacggttcttaccggttctacccgttaccttcccggttaccg

SEQ ID NO: 217584 - DNA, 888 bp, Homo sapiens
  misc_feature: GYAE6OF02GW7VD.9.3.A03.1.454.CMB.1.raw
  modified_base (196)..(196): a, c, t, g, unknown or other
  misc_feature (196)..(196): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangcccaccctctcctgcagggccagtcaggagtggttggcaccgtacgtagcctggtaaccaacgagaactccgtggcccaggcctcccgaggcctcctctatttatggtatgacactacccgaacgacgggacccacgtcgggcccgtacccgaagcccgtaagggtttcgacggttcgggacgtaggggttcgggttccgtacgggggtaactaacggttacctttacccggtaaccctttcccgttaacccgaaccctaacgttaccgaacggtacccgtaacggtacccgtaagggaaccgttacccgtaagggttaaacggtttacgtttttacggaacctttttaacgtttttaaacgttttaaccgttacgggtttacccgtaacggtaccggttaacgggttccgggttaccggtaacccgttaaaggggtttccgggttacccttttacccgttaccggttttaaccggttttacccggggggtaaccggggtaaaccgggggtaaacccgggttaaacgggggttaaccgggaaccggtaaacccggtaacgggaacccggttaaacggtttcggggttaaccgggtacccgggttaccggtaaccgttaaccccggtacggttttcccgtttaccggtttacctttacccggttaacccgtttccccggtttaaccccccgg

SEQ ID NO: 217585 - DNA, 675 bp, Homo sapiens
  misc_feature: GYAE6OF02G2GLZ.9.3.A03.1.454.CMB.1.raw
  modified_base (302)..(302): a, c, t, g, unknown or other
  misc_feature (302)..(302): n is a, c, g, or t
  modified_base (408)..(408): a, c, t, g, unknown or other
  misc_feature (408)..(408): n is a, c, g, or t
  modified_base (480)..(480): a, c, t, g, unknown or other
  misc_feature (480)..(480): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccacccttgtccttgtcctccgaaggggaaagagcccaccctctcctgcgagggccagtcagagtgtgcactacgtacgcctaggtaccaagagaactccgtggccaggcctcccgaggcctcctctatttangactgactactacccaacggtcgggccctacgtcgggccctacccgaggtcccgtaaggttcgaggttcggcgtaggtcgggtcgtggggaactacgtcgtttacnccgttaccgtaccaacctactaccgacgtaccaacggtacccgtaaggaccgtaccgtaagtaaacggtttnttttaccgacttttaattttaacttacgttcggtactacggtactaggtccgtacgtaccgtaggttcgtccttacgccgttacgttcgggacggtacgggacgtaggtacggacgaacgtaggtaccgtacggtaggtccggtcgacgtacccgtaagtctcggttaccgttctaccgtcgttacccctacccg

SEQ ID NO: 217586 - DNA, 759 bp, Homo sapiens
  misc_feature: GYAE6OF02F8CU5.9.3.A03.1.454.CMB.1.raw
  modified_base (259)..(259): a, c, t, g, unknown or other
  misc_feature (259)..(259): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaagagcccaccctctcctgcgagggccagtcagagtgttggcacctacgtagcctggtaaccaanagaatccgtggaccaggcctcccaggcctcctcatttatgatgcatccaacgacgggccacgtcggccgtcccgagcccgtaggtttccgaggtcggaccgagggttcgggtacgtagggggaactacggtaccgtttcaaccgttccgtaccaaccttactccgaagtcccaacgtaccgtaacggtaccgtcccgtaaggtaaacgtttacgtttttacggtacctttaagtttttaaccgttacgttacggttacctaacggtaccgtaacggttcggttaccgtacccggttaaagggttccggttacctttaccgttaccgttaccggttttaccggggaccggggttaaaccggggtaacccggtaaacggggttacgggaaccggtaacccgacgggtaacccgtaacggttcggtaacgggtccgtacggtacccgtaacctacgttccgtttaccggttaccttaccgttaccgttacccgtttacccccg

SEQ ID NO: 217587 - DNA, 644 bp, Homo sapiens
  misc_feature: GYAE6OF02JGOM1.9.3.A03.1.454.CMB.1.raw
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (365)..(365): a, c, t, g, unknown or other
  misc_feature (365)..(365): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaagagccaccctctcctgcagggccagtcagagtgttggcacctacgtagcctggtaccaacagaatccnggccaggcctcccgaggcctcctcatttacngatcgcactccaaacgcgggccacgtcggcctcccgagccaggttcaggtcggcaggtggtctgggaacnggtacttcactctacacctatcagcacgccgtagacgccgtagaagtattttcgacttagttttacttacttagtacagtacaggtacgtcgacctaaggtcggtaccttcctacgtaccgtttcgggaccgggtaacgggtaccggtaaagggttaccgggacggtaaccgtacgggaaccggtaacggttcgggttacgggtaccgtacggtacccgtaacccgtacgttaccggttacgtttaccgtttacccgttactttccccgttacccccgg

SEQ ID NO: 217588 - DNA, 624 bp, Homo sapiens
  misc_feature: GYAE6OF02INUEC.9.3.A03.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (405)..(405): a, c, t, g, unknown or other
  misc_feature (405)..(405): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtcgaccaccggagaaattgtgttgacacagtctccagccaccctgtccttgtctccaggggaanagccaccctctcctgcgaggccagtcagagtgttggcacctacgtagcctggtaccaacagaactccgtggccagctaccccgaggctcctcatttacngatgactacnccaacgagggcccagtcgggacctccccgacgtaccgagggtttccaaggtcgggtacaggttcgggtcgtaggggtaaccacgtaccttacaccgttntaccacactgacgcctacgcccgtaggacgtacctagtaacggtacgttttacgacgtttaattttaacgttacttagttaccgtaagccgtaggtacgtcgtacctaagtcggtacttcgtctacgtttcggacggtacgggactaggtgaccgacgacgactacgtggtcgcgtcgccgtaatacgtcgtccgttataccgtacgtcccgttacccg

SEQ ID NO: 217589 - DNA, 658 bp, Homo sapiens
  misc_feature: GYAE6OF02JYQGN.9.3.A03.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangcccacctctcctgcaggccagtcagtcgtgttgcacctacgtacgcctaggtaccaacagaactccgtaggccaggcctcccgagcctcctcatttangatcgcatccaacgcggcctacgtcggaccgtccctaaggccgtaaggttccgacggtacggcgtaggtcgggttcgaggggtacagtcttcgactctacaccatcgaagcaacgtccaagcgtaccgtaggtaacttagtttcgacttagtttttataccgttaggttccaacgtaccgtaggtccgtacggttaaccgtacgggttcggtccttacgttcgttacggtttacggggaccgggtaaccggggtaacccgtagggtaccggtaacgaaccggtagtaaccggtacggtggtaccggtacgtccgggaacctcgtaacgttccgtcgtttaccctacgttaccgtccctcccg

SEQ ID NO: 217590 - DNA, 720 bp, Homo sapiens
  misc_feature: GYAE6OF02GLSYH.9.3.A03.1.454.CMB.1.raw
  modified_base (197)..(197): a, c, t, g, unknown or other
  misc_feature (197)..(197): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaancgccaccctctcctgcagggccagtcagagtgttggcacctagtagcctggtaaccaacagaactccgtggccaggcctccgaggtcctcctctatttatgatgacataccaacgcgggccctacgtcggccgtcccaggccgtaggttcaggttcggcgtagggttcggggtacgtagggggaactacggtacctttccgaaccttcctaccaaccctaagttaccgacggcccgaacggtcccgttaacggaccgtcccgttaaggtaaacgtttacgtttttacggacttttaacgtttttacgtttaacgttcgttaccgtaacggtaccgtacggtccggttacgaccgttaagggttccggttccttacgttcccgttacggttttcggggaccgggtaacgggtaccgtaaggggtacgggaacgaacccgtagggtaccgtaacgtcgggtacggtaccgtacggtaccaccgtacgttcgttacgttacctacgttaccgttcccgttaccccg

SEQ ID NO: 217591 - DNA, 866 bp, Homo sapiens
  misc_feature: GYAE6OF02F87BI.9.3.A03.1.454.CMB.1.raw
  modified_base (203)..(203): a, c, t, g, unknown or other
  misc_feature (203)..(203): n is a, c, g, or t
tcagtgatacgtctcacgaccggtgctcgatttagagagcgtcacagggggaggaacgtgctcagttaggacccagagggaaccatggaagccccagctcagcttctcttcctcctgctactctggctcccagtcaccaccggagaaattgtgttgacacagtcctccagcccaccctgtccttgtcctaccgaggggaaacngcccaccctctccgtgccagggccagtcaagcgtgttcggcctacgtacgtagcccgtggtaacccaagacgtaactcccgtaggcccagggtccctacccgaggtcccttccccgtataacttttagcggtaacgtcgactacgtcccaaacggtaccgggtcctacggtcggtacccgtccccaaggtccgtagggttccaaggggtccgcgtaacgggttcgggttctacgggggaacaacgtacctttccgaacgtttccaacccacgttagtacccgtacggtaccaaacggttccctaagggccgtaacccggttaggtaaacgtttacgtttttccggaccttttaaacgtttttaactaccggtaccgttacggacgttaccggtaggtacccggttacgtacccggtttaagggttacccgggttccttttaacgttaccccgtttacgggttttaccgggggacgggtaaacccggggttaaaccctaagggggttaccggtaaccgaaaccccgggttaagggtaaccccggttaaccgggtttcggggtaccggttaacccggttacccggtaccgttaaccccgttaggttttaccccgttaggtttaccccgttttaaccgtaccccggtttccccgtttaacccccgg

SEQ ID NO: 217592 - DNA, 707 bp, Homo sapiens
  misc_feature: GYAE6OF02JULHJ.9.3.A03.1.454.CMB.1.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (322)..(322): a, c, t, g, unknown or other
  misc_feature (322)..(322): n is a, c, g, or t
  modified_base (374)..(374): a, c, t, g, unknown or other
  misc_feature (374)..(374): n is a, c, g, or t
tcagtgatacgtctcacgaccggtgctcgatttagagagcgtcacagggggaggaactgctcagttaggacccagagggaaccatggaagccccagctcagcttctcttcctcctgctactctggcctcccagtcgaccgaccggagaaattgtgttgacacacgtcctccacgcccacccttgttcccttgtcctccgaaggggaaacgacgccctaccccttcttccnggcgacgggtccagtactaggngttcggttcggacctaccgtacgtacgtccgtacggaaccaacgagtaacctccgtcggaccgacgtccnccgtacgtccttacctacttattacgtgtatcgctaccacgacgtacgtcgnggggtacccacggccacggtcgacgtggtcgagtcgggtaccgtgggtaccgtaggacgtacgtactacctactacctactaccgcgtaccacgacgacgtacgtacgtacgtaacgtactttttagacttatttacttacttagttactagtacctacggtcgtacgtccgtaacgtcgtacgttcgtcgttacctttacgggtcggttaacgggaccgtaacgggtacgaacggtaggacgtaaccgcgttaaccgtaccgtggtccccgaagttaccctaccgtacttcgttaccttccgttaacccgttccgtacgttacccttaccgg

SEQ ID NO: 217593 - DNA, 227 bp, Homo sapiens
  misc_feature: GYAE6OF02JDIZ2.9.3.A03.1.454.CMB.1.raw
  modified_base (219)..(227): a, c, t, g, unknown or other
  misc_feature (219)..(227): n is a, c, g, or t
tcagtgatacgtctcacgaccggtgctcgatttagagagcgtcacagggggaggaactgctcagttaggaccagagggaaccatggaagccccagctcagcttctcttcctcctgctactctggctcccagtgaccaccggagaaattgtgttgacacagtctccagccaccctgtccttgtctccgaggggaaagcgccaccctctcctgcgaggccnnnnnnnnn

SEQ ID NO: 217594 - DNA, 656 bp, Homo sapiens
  misc_feature: GYAE6OF02I4K4Q.9.3.A03.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
tcagtgatacgtctcacgaccggtgctcgattttagagagcgtcacagggggagggaactgctcagttaggacccagagggaaccatggaagcccccagctcagcttctcttcctcctgctactctgctcccagtgaccaccggagaaattgtgttgacacagtctccagccaccctgtccttgtctccgagggaaangccacctcnctgcaggcagtcagagtgttggcactacgtagcctggtaaccaacgagaacttccgtaggaccgaggccttacccgaggccttcctctaattttacnggaattcggacctactccgaacgagggcccacgttgggccctacccngacccgtaagggttcaaggggttgactgggttcggtccgtaggggaacacgtactttcgacttcctacgactacttcaacgcgtacgtacgtacgtacgtacccgttagaacgttacgttttacgatttacgttttaacttcgtcggttcaagttcagttcgtacgtacgtacgtggtccttactccgttcgttacgggacggaacggaaccgtacggtagaaccgacgagtaccggaagttcgggtacgccgtacgaccaacgttcgttaggtacttttccggtaacttcccgttccttacccg

SEQ ID NO: 217595 - DNA, 729 bp, Homo sapiens
  misc_feature: GYAE6OF02FXWAU.9.3.A03.1.454.CMB.1.raw
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtcccttgtcctccgaaggggaaagcgcccaccctctcctgcacgggccagtcagngtgttggcacctacgtagcctggtaacccaanagaactcccgtggccaggcctcccgaggtcctccctntattttagngatgactactaccgaacgcgggccacgtcggccgtcccgagcctaggttcaggtcggctaggtcggtcgtgggaacaggtaccttcgacttcctaccaaccgctacgacgcctacgtccgtacgacgtaccgtagtaacgttagtttcgtactttattttactttacgttcgttaccgtacgtacgtacggtccggtacgtaccgtaacggttcgttccgttaccgttaccgttaccggtttaccgggacgggtaaccggggtaaccggtaacggggttaacggaaccgggtaaccgtacgggtaaccggtaaccggttcgggtaccgggttaccggttaccggaccgttaacccgttaccggttaccgtttaccggtttacccgtttaccgtttacccgttaccccggtttacccccgg

SEQ ID NO: 217596 - DNA, 818 bp, Homo sapiens
  misc_feature: GYAE6OF02HCWYB.9.3.A03.1.454.CMB.1.raw
  modified_base (196)..(196): a, c, t, g, unknown or other
  misc_feature (196)..(196): n is a, c, g, or t
  modified_base (241)..(241): a, c, t, g, unknown or other
  misc_feature (241)..(241): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaancgccaccctctcctgcagggccagtcagagtgttggcacctacgngcctaggaccaacgagaactccgtaggccaggcctacccaggtcctcctctattttagtgacttgacctataccccgtaacgacggggccctaaccggtcggtccccgtaccccgaacggtccccggtaaggtttccaaggggttcggacgtacgggtgggttcctaggggaactaccggtactttacccgaccgttactaccccgacctaactaccgacggaccgtacgtacccgtaaggaaccggtccccgttaaggtaaacgttagtttttacggtaaccttttaagtttttaacgtttaaccgttacgttaaccgtaacggttacggtaacggtaccgggttaccgtaacccgttaaacgggttcgttaccgttttaccgtacccgtttaccggttttacccggggaccgggtaaccggggtaaaccggttaacggggtacgggtaaccgtaacccggtacggtaaacccggtaacggttacgggtaccggtacccgttacggaacccgtaccttaaccgtttccgttaccggtttaccgtttacccgttaccgttaccccgttaccccccgg

SEQ ID NO: 217597 - DNA, 804 bp, Homo sapiens
  misc_feature: GYAE6OF02IRZLM.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtcctccagcccaccctgttccttgtcctaccgaggggaaagcgcccaccctctcctgcgacgggccagtcagagtggttcggctaccgtacgtacgccgtggtaaccaacgacgtaacttcccgtgggacccaacgggtccctaccccggacgggtcctacccgttcgtaacttttacgtggtacttacggcctaaacgttacccgaaaccgggtacggggacccctacggtaccgggtaccccgtaccccgtaacggtaccccgtaacggggttttccgaacggggttacgggacccggttaaggggttcggggttacccggtacgggggtaaacctacggttacccttttaccgaacccgtttccgtaacccgtacgtaactaccgacgtaccgacgtaccgtacgacgtaccgtaggtaacgttacgttttacgtactttaacgttttacgttacgttacgttacgtaacgtcgtacggtccgtacgtaccgtaacggttcgtaccttcgttacgttacggtttccgggacgggtacggtaaccggtaggtacgggaacgtaccggacgtaacggtacgtggtcggtacgtacgaccgtacgtacgttacggtccgttctaccgtacttccccgttaccg

SEQ ID NO: 217598 - DNA, 715 bp, Homo sapiens
  misc_feature: GYAE6OF02GTNEA.9.3.A03.1.454.CMB.1.raw
  modified_base (128)..(128): a, c, t, g, unknown or other
  misc_feature (128)..(128): n is a, c, g, or t
tcagtgatacgtctcacgaccggtgctcgatttagagagcgtcacaggggggaggaactgctcagttaggacccagagggaaccatggaagccccagctcagcttctcttcctcctgcctactccggngtcccacgtgtaccaccggacgaaattagttgttgtacacacgtctccacgccgaccctcgtccttcgttcgtccacggggaaagggaagccaccctacctcctgcgagggccgagtacacgaggtgtttggcacctacgtagtctcggtacgaacaagaactacctcggcacggcgtccccacggacgtcctacatttatcgagtgcactaccaaccgacgggccgtactacgggccgtacccacgcgtaggttcgagtggcaggtcggggtcgtcggacgtacgaccttctacgtccttacaacccgtataccgacgacgaaccgtcttaacggacgtaccgtagtaaagagtttttagtcttaatttttaactttacgttacgttgacgtacgacgtacgtaggtccctaacggttaggtccgtttcctaccggtttaccgtttccgggacggggtaacgggaaccgggttaacggagggtacgaaccgacgaaccggtaacgtacggtggggtacctacggtccaaacccggttatacgtttccggttaacgtttctaacccgttacccgttcccgtaacccg

SEQ ID NO: 217599 - DNA, 794 bp, Homo sapiens
  misc_feature: GYAE6OF02G9GJ6.9.3.A03.1.454.CMB.1.raw
  modified_base (198)..(198): a, c, t, g, unknown or other
  misc_feature (198)..(198): n is a, c, g, or t
tcagtgatacgtctcacgaccggtgctcgatttagagagcgtcacagggggaggaactgctcagttaggacccagagggaaccatggaagcccagctcagcttctcttcctcctgctactctgctcccagtcgaccaccggagaaacttgtgttgacacagtcctcagcccacctgtccttgtcctcgaaggggaaancgcctaccctctcctgcgacggccaggtcaggtagtcggttcggacctaaccgttacggtacgtcccgtacgggtaaacccaacgtagaaactcccgtggccaacgggcctaccccgaggccttccctagtaacttttagcggtaattcgaacctacgtaaccccaaacggtaacccgggcctaaccggtcgggtacccctaccccggaacgtacccggtaacgttttaacggcggttcgggacggttacggggttcgggttaaccggtaggggaacctaggttacctttacccacttaccgttccaaaccttacgtcgaacgtaccgacgtaccggtaacgtcggtacctaaaggttaacggttaacttttacggtaactttaagtttttaaccgtacgttacgtacgtacgtacgacggtcgtaacgggtctaacggtcgtccgtttacttccggttacgttaccggggacgggttaaccgggtacggtaaacgggtaccggtaacgaccggtaagaacgtaccggtcggttcggtaacgccgtaccaaccgttagttaccctagttcccgtacttaccggtacccttccccgg

SEQ ID NO: 217600 - DNA, 850 bp, Homo sapiens
  misc_feature: GYAE6OF02F9Z83.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtcctccagcccaccctgttccttgtcctccgaaggggaaagacgcccaccctctcctgccgacgggccagtcgagtagttggttcggcctacctacggtacgccgttacggtaacccaacgaacgtaacttcccgtcggacccgtacgggtcccttaccccgacgggtcccttccccgttaccttaagttttacgtacggtacttcggaccctaacttaccccggaaaaccggtaccggggaccctaaccggttccgggaccccggttacccccaacgggtccccgttaagggtttcccgaggggtacggaccggttacggggttcgggtaccggtacggggaaccgtacggttaacccttacgtacccgttaccgtaacccgtaacccgttacgacccgtaacggtccgtaacgtacccgttaacggaaccggtacccgtaaggttaaacgtttacgttttacgtacgtttttaacgttttaacgttaccgttacggttaccgaacgtccggtacggtccggtacgtaccgtacggttcgttaccttcgtaccgttacggttaccgggaccgggtaacgggtaaccgtacgggtaacgacggtaccgacggtaacgacggttaggtacggtccgtacggacctaccgtacgttcgttaccttacctccgttacgttccccgttacccg

SEQ ID NO: 217601 - DNA, 815 bp, Homo sapiens
  misc_feature: GYAE6OF02IJHHQ.9.3.A03.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (346)..(346): a, c, t, g, unknown or other
  misc_feature (346)..(346): n is a, c, g, or t
tcagtgatacgtctcacgaccggtgctcgattttagagagcgtcacagggggaggaactgctcaggttaggacccagagggaaccatggaagccccagctcagcttctcttcctctgctactctggctccagtgaccaccggagaaattgtgttgacacagtctccagcccacctgtccttgtcctccgagggaanagccaccctctctgcaggccagtnagagttgttcgctacctagtacgccttaggaccaacgaacgaatccgacggacacggcctaccgacggtccttcctacgtattttatggtacttcgactaactacccgaaacggtaccgggacccncgttacggccgttacccgacgtaccgttaggttccaagggttggaccgtaggttcgggtacgtcggggaaactcggtaccgtttctaaccgtcttaacccgaacttactacgacgtaccgtaacgacccgttaagacgtacctaggttaaactttcggttttacgtacctttaagtttttaacgttaaccgtttagttaccgttaaagggtaccgtacggttaccggtaccgtaaccgttaacgggttcgttacccgttttcgtaacccggtttaccgggtttaccgggggtaaccgggttaaaccggggttaacccggggtaaaggttaccgggtaaaacccgggtaccgttaaccgggaaccgggttaacgttaccgggtaccgggttaccggttaaccgacccggttaaccgttcgtttaccggttccgtttaccctttacggttccctttaccccgttaaccccg

SEQ ID NO: 217602 - DNA, 667 bp, Homo sapiens
  misc_feature: GYAE6OF02FIKY3.9.3.A03.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (274)..(274): a, c, t, g, unknown or other
  misc_feature (274)..(274): n is a, c, g, or t
  modified_base (425)..(425): a, c, t, g, unknown or other
  misc_feature (425)..(425): n is a, c, g, or t
tcagtgatacgtctcacgaccggtgctcgatttagagagcgtcacagggggaggaactgctcagttaggacccagagggaaccatggaagccccagctcagcttctcttcctcctgctactctgacctcccagtcgaccaccggagaaatttgtgttgacacagtctccagcccaccctgtccttgtcctccgaaggggaaacncgcccaccctctcctgcagggccagtcagngtgttcggcacctcgtagcctggtaccaacagaactccgnggccaggcctcccgaggtcctcctctactttagcgatcggcactcccaaacgtcgggcccacgtcgggtcctaccccaggcccgtaggttccaggtcggcgtagggttcgggtcctaggggacctggtaccttccaactccgaccaaccgntccgaggccacgcccgtaagtcgaccttgaaacttacgttttcgactttaatttttaactaccgttagtacctaggtcctacggccgttacgaccgtaaggttcgtccttaccgtccgttaccggttaccgggacgggtaacgggacctaagggtcgaaccggtaaccacggaacctacggtcggtcggacctacgaccaccgtacgttccgtacgttcctactaccgttcccgttaccccg

SEQ ID NO: 217603 - DNA, 737 bp, Homo sapiens
  misc_feature: GYAE6OF02FVAL4.9.3.A03.1.454.CMB.1.raw
  modified_base (206)..(206): a, c, t, g, unknown or other
  misc_feature (206)..(206): n is a, c, g, or t
  modified_base (327)..(327): a, c, t, g, unknown or other
  misc_feature (327)..(327): n is a, c, g, or t
tcagtgatacgtctcacgaccggtgctcgattttagagagcgtcacagggggtagggaactgctcagttaggacccagagggaaccatggaagccccagctcagccttctcttcctcctgctacgtctggcctcccagtgaccaccggagaaattgtgttgacgacagtctccagccaccctgtccttgtcctccgaggggaaacncgcccacccctctccgtcgcgacgggcccagttcgacgtagtgttggacctaccttacggtacgcctggtaaccaacagaatcctggaccaggcctcccgaggccttccgtactatttacngatcgcactccaacgacgggccacggtcggaccttacccgtaagcccgttaacgggttccgtaaggtccgggtacgtacggttcgggtacgtagggggtacctaagggttacctttacccggaacctttccgtaacccgtaacctattcccgaaaggtccaacgtacccgtacgaacgtacccttagaaacgtttagtttcggtacgtttagtttttaacgtaccgttagttactaaggtcgtaacggttacgttcgaaccgtaggttacgttcctttacgttaccgttacggtttccgggacggtacgggtaaccgtaacgggttcgaaccgacgtacggtaacgacggttggaccggtacgtcgacctacgacgttacgttaccgtcttaccgtaccgtccttacccg

SEQ ID NO: 217604 - DNA, 626 bp, Homo sapiens
  misc_feature: GYAE6OF02F1W6T.9.3.A03.1.454.CMB.1.raw
  modified_base (259)..(259): a, c, t, g, unknown or other
  misc_feature (259)..(259): n is a, c, g, or t
  modified_base (303)..(303): a, c, t, g, unknown or other
  misc_feature (303)..(303): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccgaggggaaagcgccaccctctcctgcgaggccagtcagagtggttggccacctacgtagcctaggtaaccaanagaactccgtggccaggcctacccgagtccttcctatatttagngtatcgactactaccgaacggacgggacctacggtcgggtcctacccgaggtcctagggttcaggtcggcgtaggtcggtcgtagggacaggtacttacacgttcacgacctatcgaagccgaacgtcctaggacgtccgtagtaacgttcgttttgactttaacgttttacttacgtcgttagaacgtcgtacggtcgtcgacgtaggtcgtcctttacgtcgttaccgttcgggacgggtacggaccgtagggtacgaacgcgacgtacgacgttggcgtactcgactacgtgttcgtacgttcgtactactcccgttccg

SEQ ID NO: 217605 - DNA, 905 bp, Homo sapiens
  misc_feature: GYAE6OF02HQ9CE.9.3.A03.1.454.CMB.1.raw
tcagtgatacgtctcacgaccggtgctcgattttagagagcgtcacagggggtagggaactcgctcaggttaggacccagagggaacctatggaagccccagctcagcttctcttcctcctgctactctggctccagtgtaccgaccggagaaattgttgtttgactacagttacttaccgacgcccaccttgtccttgtctccaggggaagcgccgacccgtcgtcctgcgtacgggccaggttcgagaggttggtttcggccaccgttacggtacgccgttacgggtaacccaacgaaggtaaacttcccgtacgggccctaacggtcccgttaccccgtaacgggtcccttacccttacttaactttttacgttcgggtactaccggtacctaaccgttacccggaaaaccgggacggggtacccctaacggtttcgggccccggttacccgaacggtccgttaacgggtttaccgagggttcgggacgttacggggttacgggttcgtacggggaacctaacgggtaccttttaacccgacgttacccgtaactaccggtaacgttccgtaaccggtccgtaacccggttaccgttaacggtaacccggtaccttaacgggtaaacgttttacgttttaaacggtaccgttttaaacgttttttacgtttaaaccgttcggttaacctacggtaccgttacggtaaccggtaacgtccggtttaaacggttcggttacccgttttacgttacccggttaccggtttccggggaacgggtaaccgggttaaccggtaaggtaaccggttaacgaaccgtaggtaacggtaacgtggtacgtaccgtacgtaccgacgtacgttcgttaccgtttaccgtaccttaccgttcccttaccccgg

SEQ ID NO: 217606 - DNA, 673 bp, Homo sapiens
  misc_feature: GYAE6OF02G7BFW.9.3.A03.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagngtgtgcacctacgtagcctgtaaccaanagaactccgtggccaggcctcccgaggtcctcctctaatttagnaatcgactactaccaaacgcgggacccacgtcggacccgtacccgaggtcccgtaagggttcaaggtcgggactagggttcgggtcgtaggggacaaggtactttcacgttcaccactatcgagcagtaccgtagcgacgtagtaacgttatttgactttaacttttacttacgtgttacgaacgtcgtaacggtcgtacgacctaagggttccgtacgtttccgtaccgttaccggtttacgggacggtaaccgggtaaccgtagggttaacggaacgtaaccggtaggtaaccggtaaggttcgggtaacgtcgtaccggacctacgttacgttccgttacgttacccgtttacgtacctttcccggtaccccg

SEQ ID NO: 217607 - DNA, 701 bp, Homo sapiens
  misc_feature: GYAE6OF02IKKA9.9.3.A03.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
tcagtgatacgtctcacgaccggtgctcgatttagagagcgtcacagggggaggaactgctcagttaggacccagagggaaccatggaagccccagctcagcttctcttcctcctgctactctgctccagtgaccacggagaaatttgtgttgacacagtctcagcccacccttgtcccttgtctccgaggggaaacgngcccacccttntccctgcgacgggccagtcaaggagtcgttggactacctacgtagcctggtaccaaacgagaacttccgtggaccaggacctccccgaaggtccttccctatattttaagcggattcggactacgtaccgaaacgaccggggtccaacggtcggtccgtacccagcccgtaggttcagttcggcgtaggtggtatcggggaactacgcttttacgacttctacgacctaagtccagtaccagtaccgtacgactacgagtaacgtagttttcgacttaactttactacgttgtacgacgtacgacgtcgtcgtaccggtagtcgttcgttaccttaccgtacgtttaccggggtccgggaacggtaaccggtaacgggtacggacggaaccgtagggtaaccggttaacgtcgggttaacggccgttacgacccgtaacctaggttcccgttaacggttccctttaccggttacttcccgttaacccccgg

SEQ ID NO: 217608 - DNA, 628 bp, Homo sapiens
  misc_feature: GYAE6OF02JKO25.9.3.A03.1.454.CMB.1.raw
  modified_base (306)..(306): a, c, t, g, unknown or other
  misc_feature (306)..(306): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtcctccgaggggaaagagcccaccctctcctgcgaggccagtcagagtgtcgcacctagtacgcctaggtaacaacagaactccgtaggaccgacggcctacccgaggcctcctctaagtttanagtatcgctactaccaacgacggccacgtcgaccgtccagccgaggttcgaggtggacgtagggtcggtacgtagggactacgtacgttcgactccgtacacctactcgacgaccgaacgtccgtacgaccgtaccgtagtaacgtttactttacggtactttaacgtttattacgtacgttacgtacgcgtacggtcgtacgtaccgtaggtcgtacgttaccgtacgtacggttccggacggacggtacgaggtcgacgtacgagacgtaggtcgaggtcacgtacgtacgagttcgtacgtactcgtactccgtacccg

SEQ ID NO: 217609 - DNA, 715 bp, Homo sapiens
  misc_feature: GYAE6OF02JHSSL.9.3.A03.1.454.CMB.1.raw
  modified_base (229)..(229): a, c, t, g, unknown or other
  misc_feature (229)..(229): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtcctccgaggggaaagacgcccaccctctcctgcagggccagtcagngtgtgcacgtacgtagctggaccaacagaactcctgcagctaccagtctcctntattangtatacgcgactccaacgtacggccacgtcggaccgtcccgacgaccgtacggttcaggttcggcgtaggtcggtacgtaggggtacacggtaccttctaacgtccgtaccaaccgtactacgagtaccgtaccgaccgtacgacgtacgtaacggtacgttaacgttttcgtacgttttaagtttacgtttaacgtacgttaccgtaggtaccgtacggtacgttacgtaccgtaaacgggtcggttacctttacccgttcgttacccggtttacgggaccgggttaacgggttaacccggtaaagggttacgggaacggtaaccgttaacggaaccgggtaacggttacgggtaccgggtacgtaaccgtaccgaacccgttagttaccgtcgtttacccgtacttaccgtttccccgttacccg

SEQ ID NO: 217610 - DNA, 755 bp, Homo sapiens
  misc_feature: GYAE6OF02H9BG9.9.3.A03.1.454.CMB.1.raw
tcagtgatacgtctcacgaccggtgctcgatttagagagcgtcacgaggggggaggaactgctcagttaggacccagagggaaccatggaagccccagctcagcttctcttcctcctgctactctggcctcccagtgaccaccggagaattggtgttgacacagtctccagcccaccctgtccttgtcctccgaaggggaagacgcctaccctctcctgcgacgggccagtcgaggtagttggttcggacctaaccgttacggtacgtccgtacggtaaccaaacgaggtaacttccgtcgggaccgagggtccccttcccgacggtccttcccttaccgttatttagtcggtacgtgaccctaactacccgaaacggcgggaccctacgtccggccgtcccgacggtaccgtagggttcaggtcggacgtaggggtcggtcgtagggaccgagttacgttcctaccgtctaccacgtactccgacgacctcgtctaggaccgtaccgttgtaaagttcgttttacgtcgtttaactttaagttaccgttgtaccgtcgacgtagtccgtcgaacggtcgggtacggttctttaccgttcgtaccggggtttccggacggggtaacccggggtaacggtacgggtacgggtaaccggcgtaaccgggtacggtaacggtgggtaccggtacggtaccgttactaaccggtctttaaccgtccggtttaacctcttacccgttcccttacccccgg

SEQ ID NO: 217611 - DNA, 797 bp, Homo sapiens
  misc_feature: GYAE6OF02G89OO.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgttcccttgtcctaccgaagggggaaaagcgacccacccctctccgtgcgacgggaccagtcaggagttggttggccaccgtacgtagccctggtaacccaacagaactccgtcggccgacggcctacccgacggcctcctctatttatgatagacactaccgaacgacggaccacgtacggccgtacccgacgaccgtacggttactaggtacggacgacggtacgggtcgtacgggcgtaaaaaaaaaaaaaacggtccttacctacgtaccttacctaaccctaacttaccgaacgtaccgaacgtacccgtaacgtacggtaccgtacggtaaaggttacgttttacgttacgttaacttttaacgtttaacgttacgttacgtacggtacgtacgtaccggttacgtaaccgtaacggttacggtacctttacccgttaccgttaccggttttaccgggtaccggggtaaaccggggtaaccggtaaacgggtaacgggtaacggaacccggaacggaaccggtaaccggtacggttaccgggtacggtacgtacccgtaaccgtaccgttaccgttaccgttaccgtttaccgttaccgttacccgttacccccg

SEQ ID NO: 217612 - DNA, 693 bp, Homo sapiens
  misc_feature: GYAE6OF02FOV2A.9.3.A03.1.454.CMB.1.raw
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
  modified_base (437)..(437): a, c, t, g, unknown or other
  misc_feature (437)..(437): n is a, c, g, or t
tcagtgatacgtctcacgaccggtgctcgatttagagagcgtcacgagggggaggaactgctcagttaggacccagagggaaccatggaagccccagctcagcttctcttcctcctgctactctggcctcccagtgaccaccggagaaattgtgttgacacagtctccagccaccctgtccttgtctccgaggggaaagagcccaccctctcctgcacgggccagtcagngtgttggcaccgtagtagcctggtaaccaanagaatccctggcctaggcctcccgaggtcctcctctatttactgtactgcactacccgaacgtacgggccctacgtcgggccgtacccgaggccctacggttccgaggttcgggacgtaggttcggggtacgtgggggaacctagtacctttccgaacgttcctacctaacccgtntaccggagtccacgtacctacggacgtaccgtaggtaacttagttttcgtactttaattttacgtactacggttactaacgcgtacgtcggtacgtaccgaaggttccgttactttccgtcgttaccggtttacccgggacggggtaacgggtaacccggtaagggtaccggaacgtacccgaggtaaccgtacggttcggtaggcgtacgacctaccgtattccgttacggtccttacctacgttccccgttacc

SEQ ID NO: 217613 - DNA, 769 bp, Homo sapiens
  misc_feature: GYAE6OF02H35A5.9.3.A03.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattggtgttgacacagtctccagccaccctgtccttgtctccgaggggaanacgccaccctctcctgcgagggccagtcgagngttgttggcacctacgacgcctggtaaccaagcgaatccctggccaggtcctcccgaggtcctaccgtctaattttgtcgatcgacctagtaccccgaaagacgggcccacgtcgggacccgttcccgacgtcccgtaggttccgaggtcgggtacagggtttcgggtcgtacgggggtactaacggtaccttcctaccgtctaccgtaacctaagtccacggacctaacgtcccgttaagaccggtacggtacgggttaaattacgtttttaggtaccttttaaatttttacgttaccgtagttaacccggagtaccggtacgtccgggttacgaccggtaaggttcggtacctttcgtacccgtttccgggtttacggggaccggggtaaccgggtaaccggtaaggggtaaccgggtaacgtaaacccgtacgggaacctacgggttcgggtaccgtaccgtaccggaaccgtaacccttaggttacccggttttaccgtcccgttttaccggttacccttcccccgggtttaaccc

SEQ ID NO: 217614 - DNA, 683 bp, Homo sapiens
  misc_feature: GYAE6OF02G35HQ.9.3.A03.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (458)..(458): a, c, t, g, unknown or other
  misc_feature (458)..(458): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccacctgtccttgtctccgaggggaaanagcccaccctcncctgcagggccagtcagagtgttggcacctacgtagcctggaccaacagaactccngccaggcctcccaggtcctcctctatttacgntatgaccatacccgaacgaacgggccctacgtacggccgtcccgacgtaccgacgttccaggtcggtcagggttcgggtccgtaggggactcggtaacctttcaccgttctcgaacccattacgacgcctacgtcccgtaagacgtacccttaggaacgttnttttacggtaactttattttatttaccgtgttacacggtactaggtacgttcgaccgtaaggttcggtacttacccgttacgtaaccgtttcgggacgggtacggtaaccggttaacgggtacgggaaccggtaccgaacggtaaccggtaacggttccgggtcggtcgttacgaccgtactacgttaccgttcgttaccctttacgtccgttacccgttacccg

SEQ ID NO: 217615 - DNA, 780 bp, Homo sapiens
  misc_feature: GYAE6OF02HW5NW.9.3.A03.1.454.CMB.1.raw
  modified_base (200)..(200): a, c, t, g, unknown or other
  misc_feature (200)..(200): n is a, c, g, or t
tcagtgatacgtctcacgaccggtgctcgatttagagagcgtcacagggggaggaactgctcagttaggacccagagggaaccatggaagccccagctcagcttctcttcctctgctactctgctcccagtgaccaccggagtaaattgtgttagacacgagtctccacgcccacctcgtccttgtcctcgaaggggaanacgcctaccctctccgtgcgacggccagtcaggtgttggtcggcctaccgtaccggtacgccttaggaaccaacgacggtaactccggtcggaccgtacggtcctacccgacggtcctcccttactacgttttaagacgtacttacgacctaacgtacccgaacggtaccggacctaccggtcggtacccgtacccgtaacggccggttaacggtttcgacggtaggtccgtaggttcggtcggtacgggaactacgtacctttcgaccgttctacgtaacctaccgtacgacgtaacgtaccgtacgtacggtacccgttcggtaacgttaagtttcgtttacgtacttttacgtttacttcgtacgttacgacgttcgtacggtcgttcgacggttacggttccgttacggtttaccttccggttaaacccgggttcgggtaaccgggtaaaccggttacgggtaacggttaacggaccgttaaccggaccgttacgggttaccgtcgggtaaccgtacggtaccgtaaccgtcggtactaccggttcgttaaccgtttctaccttaccccgtaccgg

SEQ ID NO: 217616 - DNA, 761 bp, Homo sapiens
  misc_feature: GYAE6OF02GXMCU.9.3.A03.1.454.CMB.1.raw
  modified_base (199)..(199): a, c, t, g, unknown or other
  misc_feature (199)..(199): n is a, c, g, or t
tcagtgatacgtctcacgaccggtgctcgatttagagagcgtcacgagggggaggaactgctcagttaggacccagagggaaccatggaagccccagctcagcttcctcttcctcctgctacgtctggctccagtgaccacggagaaattgtgttgacacagtcctcagccaccgtgtccttgctccgaaggggaaacngccacctctcctgccgagggccagtcaggtacgtgttggacctaccgtacgtacgccgtagggtaacccaaacctaggaaacttccccgttagggaccctaagggtccttacccgacgggtaccttcccgttactaacgtttttagcgtaaactcggtccctaacgtacccgaaaacggccgggtaaccaacggttcggaccgttacccgaacgtacccggtaggtttaccgaaccgggttcggacctacgggttcggggtacctacgggggactaacggtaccgtttccaccggttactacaacccgtatcctaacggcctaaggtccctaacgacgtcccgtaaagtaacgttagtttctacgttaacttttacgtaccgttagttaccgtagtacgtaacggtcgtacgtaccgtaaggttccgttacgttaccttcgttaacgtttccgggacgggttaacggggaacctagggttacgaccgaacgtaccgacgtaaccgtgggtccgtacggtactaccgacgttacgtccgttccgtcttactccgtcttacccg

SEQ ID NO: 217617 - DNA, 779 bp, Homo sapiens
  misc_feature: GYAE6OF02IJJ7C.9.3.A03.1.454.CMB.1.raw
  modified_base (233)..(233): a, c, t, g, unknown or other
  misc_feature (233)..(233): n is a, c, g, or t
tcagtgatacgtctcacgaccggtgctcgatttagagagcgtcacagggggaggaactgctcagttaggacccagagggaaccatggaagcccagctcagcttctcttcctctgctactctggctcccagtcgaccaccggagaaattgtgttgacacagtctaccagcccacctgtccttcgtcctacgaagggaaagcgccacccgtctacctgcgtacggccagctaggngttgttggacctacgtacgtacgccgttacggaaccaacgacgtaactccgtacggaccgacggtccgtacccgacggccttaccgtctaactttcgtgtactcgactacttacccaacggacggcctacgtcggcccgtacccagaccgttacgggttccagggtcgtacgtcgggtacggtaccgtcggactaggtaccttcgactcgtaccgactacgtcgaacgcgccgtaacgacgacgccgtaagtacgttacgttcgttaactttacgtttaagttccgttaaggtctacgtaacgtcggttaccgtaacgtaccgggaacgtttcggaactttccgttaaaccgtttcccggttccgggaaccgggttaacgggtaacccgggtaacggtaacggggttaaccgaaccggtacggttaaaccgggtccggttacgggtttaacccggccggtttaaaccggacccgttaacggtttcccgttacccggtttaaccggtttacccgggtttaaccttccgttaccccgtttaccccggg

SEQ ID NO: 217618 - DNA, 719 bp, Homo sapiens
  misc_feature: GYAE6OF02J1X0A.9.3.A03.1.454.CMB.1.raw
  modified_base (307)..(307): a, c, t, g, unknown or other
  misc_feature (307)..(307): n is a, c, g, or t
  modified_base (424)..(424): a, c, t, g, unknown or other
  misc_feature (424)..(424): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtagttgacacagtctccagccacctgtccttgtctccaggggaaagagccaccctctcctgcacgggccagtccagagtgttggctacctacgtacgcctggtaccaacacgaactccgtggccgaggcctacccgaggcctacctctagtttaacngtatcgcacgtccaacgacggtccgactcggccggtaccccagtcccgtaaggtcctaggttcggactaggtgggtaccgtcggggtacagtaccgtacgaccttcgtactaacccngttaaccccgaggacgacgtaccccgtaacgtacggtaccctagggtaaacgttaaagttttccgtaacgtttaattttttaaacggtactttacggtacctaacggtacgtacggttaccggtacgtaccggtaacgtcgggttactttacccgtcgtttacccgttcgggacggtaaccgggtacgtaacgggtaggacgaaccggtacgacgtaaccggttggacgtaccgtagtacccgtaacgttccgttaccgttaggtttccttaccgtaccgtttcccttaccccgg

SEQ ID NO: 217619 - DNA, 620 bp, Homo sapiens
  misc_feature: GYAE6OF02JMKCU.9.3.A03.1.454.CMB.1.raw
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (325)..(325): a, c, t, g, unknown or other
  misc_feature (325)..(325): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (431)..(431): a, c, t, g, unknown or other
  misc_feature (431)..(431): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtcctccagccaccctgtcccttgtcctccgaggggaaataggcccaccctntcctgcgagggccagtcagacgtgttgcacctgagcctgtaccanagaatcctggcagcctccgaggcctccnctattngatgctatccaagcggccgtactcggtacctccncgccgtaggtcaggtcgagtcggtggccgtgggtaacncgtacctttnacctacgtcactatccgagtcgacgcgttacgaccgtctagggaattcgtttacggtnttaacgttttatactggtaccaggtccagtccgataccggtagtcgtcttacgtacgtcttccgggagggtaacgaccggtaaagggtcgaacggtaccgaaggtacccggaggttcggtcggtaacgtcccgaggtaaccccttacgtttccggctttacccgtacttccgggttaacccctccccgg

SEQ ID NO: 217620 - DNA, 797 bp, Homo sapiens
  misc_feature: GYAE6OF02F5PMI.9.3.A03.1.454.CMB.1.raw
  modified_base (260)..(260): a, c, t, g, unknown or other
  misc_feature (260)..(260): n is a, c, g, or t
  modified_base (307)..(307): a, c, t, g, unknown or other
  misc_feature (307)..(307): n is a, c, g, or t
tcagtgatacgtctcacgaccggtgctcgatttagagagcgtcacagggggagggaactgctcagttaggacccagagggaaccatggaagccccagctcagcttctcttcctcctgctactctggctcccagtgaccaccggagaaattgtgttgacacagtcctccagccaccctgtccttgtctccgaggggaaagcgcccaccctctcctgcacggccagtcagagtgttggcacctacgtcgccgtggtaccaanagaacttccgtggccacggcctacccgacggtcctcctactatttancgtatcgactactaccgaacgacgggcccacggtcggccgtacccgacgccgtacggttcgaggtcggcgtagggttcggtcgtacggggactacgtacctttcacgttcctaccacctactccgacgtaccaacggtccgtaaggaaccgtccgttaaggtaacgtttacgtttttacggacttttaacgtttttaacttacgttacggttacgtaacgtacgttacggtccggttacgtacccggttaggttcggttcctttaccgttaccggtttaccgggttttaccgggggaccggggttaaccgggggtaaacccggttaagggggttaccgggaaccgggtaacccgggtaacgggtaaacccggttaacgggttccgggttaaccgggtacccgttaacccgggtacccgtaacccgttacggtttcccgtttaccggtttaccctttacccggttacccgtttacccccgtttacccccgg

SEQ ID NO: 217621 - DNA, 819 bp, Homo sapiens
  misc_feature: GYAE6OF02ID0AJ.9.3.A03.1.454.CMB.1.raw
tcagtgatacgtctcacgaccggtgctcgatttagagagcgtcacagggggaggaactgctcagttaggacccagagggaaccatggaagccccagctcagcttctcttcctcctgcttactctggctccagtgaccaccggagaattgtgttgacacagtcctccacgccctaccctgttccttgtcctaccgaaggggggaaacgacgccctaccccgttcttcccgtggaccgacgggggtcccaggtacaggaacgttcggtttacgggacctaacccttaaccggttaacgtcccgttcgggttaaacccaaaccgaacggtaattcccgtaggggacccaacgggtcccttaccccgagggtccttaccccttacttaacttttaacgcgtaacttcggactaacgtaccccgtaaacgacgggtcccaacgttcggggaccctacccgtacggacccgtagggttccaagggttcggacgtaggtcggggttaccgtaggggaacctacgtactttacccggtacttacccgtaccgtaaccctatacccgaacggttcgaacccgttcccgtaacggaacggtacccttaagggtaaacgttacgttttacgtaacgtttacgttttaatttaccgttacgtacgtacgtcgtaccggtacgtcggtacctaacggttacgtccgttcgttacgtaccggtttccgggacgggtacgggtaccgtagggtacggacggacacggaacggtacgtcggtacggtacgtcgaccgtaacgtctacgtcgtacctacgttaccgtccttacccg

SEQ ID NO: 217622 - DNA, 708 bp, Homo sapiens
  misc_feature: GYAE6OF02F26TC.9.3.A03.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtcctccgaaggggaaancgccaccctctcctgcaggccagtcagngtgttggctacctagtancctaggtaccaanagatcctaggccagcctccgaggtctaccgtntatttagngatcgactatccaaagcgggtacccaagtcggacctacccagtcccgtaggttccaggtgacgtaggtcgggtctggggtaacagtaactttcgaacgttctaccgaacctatccaggtacaacgtcccgtaggaacgtcctaggaaacgttacttttacgaccgtttaattttaacgttacgttacgtacgtacggtacaacggttccggtacgtacccgtaaaggtcggtacctttaccgttcgtaccggttttacgggaccgggtaacgggtaacccgtaagggtaccgggaacgtaaccgtaacgggtaaccgtaacggtcggtaccgggtaccgttaccggtaccctaaccgttagttccggtttaaccggttcctttacccggtaacttccccgtttaaccccg

SEQ ID NO: 217623 - DNA, 783 bp, Homo sapiens
  misc_feature: GYAE6OF02F7LJ6.9.3.A03.1.454.CMB.1.raw
  modified_base (154)..(154): a, c, t, g, unknown or other
  misc_feature (154)..(154): n is a, c, g, or t
  modified_base (207)..(207): a, c, t, g, unknown or other
  misc_feature (207)..(207): n is a, c, g, or t
  modified_base (325)..(325): a, c, t, g, unknown or other
  misc_feature (325)..(325): n is a, c, g, or t
tcagtgatacgtctcacgaccggtgctcgatttagagagcgtcacagggggagggaactgctcgagttaaggacccagagggaaccatggaacgccccagctccagcttcctcttcctccctcgcctactctggcctcccagtgaccaccgganaaattgtagttgacacagtctcagccaccctgtccttgtctccgaggggaaanacgcccaccctctcctggcgacgggccagtcagagtggttggccacctacgtagccctggtaccaacagaactccgtacggccgaggccctcccgacggtccttccttcctaattttntcgaatcgtacactacccgaaacggtccggccctaacgtcgggcccgtacccgagtacccggtaggttccaggttcgggccgttagggttcggggtacggttacgggggaactaccggttaaccctttcccgtaaccttcccgttaacccgaaccttacgtacccgaacggtacctacccgggttaaccgttaacggaacccgtcccggttaaggtaaacgttttaacgtttttccgttaacttttaaagtttttaccgtttacgttacgttcgtaacgtaccgacggttccggtacgtaccgtaagggttcgttaccttcgttaccgttaccggttcgggtacgggtaaccggggaacgtaacgggtcggaacggtaccggacgttaacggaacggttcggtaacggtccgtacggtaccacggtcttcgtaccgttccttacgtccttcctccccg

SEQ ID NO: 217624 - DNA, 789 bp, Homo sapiens
  misc_feature: GYAE6OF02HOU9X.9.3.A03.1.454.CMB.1.raw
  modified_base (200)..(200): a, c, t, g, unknown or other
  misc_feature (200)..(200): n is a, c, g, or t
  modified_base (315)..(315): a, c, t, g, unknown or other
  misc_feature (315)..(315): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtcctccagcccaccctgtccttgtcctccgaggggaaancgcccaccctctcctgcacgggccagtcagagttgttcggcacctacgtcgcctaggtaccaacgagaactcccgtaggcccaggcctcccgaggtccttcccgtactatttagnggtatcggacactacccgaaaccggacggggccctacggtcgggcccgtacccgaacggtcccgtaggttaccaggggttcgggacgtaggggttcgggtcccggtaggggaacctagtacctttccgaaccgttcctacaacccgatccgagccgtaacgccgtagacgtccgtaaggtaagttacgttttcgacgttttaattttacgttaacgttcgtacgtacgtaccgtacggttaccggtacgtaaccgtacggttccggttccctttacccgttacccgtttaccggggtttccggggaccgggggttaaaccggggtaacccgggttaaacggggttacgggaaacccggaacccgtaacgggtacggttaaccggttacgggtccgggacgttaccggaacctaccggttacgtttacccgttcggtttaccctttacccgttaccgttccccgttaacccccgg

SEQ ID NO: 217625 - DNA, 733 bp, Homo sapiens
  misc_feature: GYAE6OF02GYKG7.9.3.A03.1.454.CMB.1.raw
  modified_base (197)..(197): a, c, t, g, unknown or other
  misc_feature (197)..(197): n is a, c, g, or t
  modified_base (326)..(326): a, c, t, g, unknown or other
  misc_feature (326)..(326): n is a, c, g, or t
tcagtgatacgtctcacgaccggtgctcgatttagagagcgtcacagggggaggaactgctcagttaggacccagagggaaccatggaagccccagctcagcttctcttcctcctgctactctggactcccagtgaccaccggagaaattgtgttgacacagtctccagccaccctgtccttgtctccaggggaaangccaccctctcctgcgagggccagtcagacgtgttggccaccgtacgtacgccctaggtaacccaacaggaacttcccgtagggacccagggtccctccccggaagggtcccttccgtcctattttacnggtactcggtaccaactcccgaaacgcggggaccctacggtacgggtcccgttccccaacggtccccgtagggtttaccaaggggttcggacgtagggttcgggtacttgggggacctaggtacctttaccgaccttcgtacccaaccgtactaccgaagccgacgtacccgttaaggacgtacccgtagtaaggttacttttcggactttaatttttattaccgttggttaccaggtacgtacggtcgtacgaccgtaagggttcgtccttaccgtacgtaccggtttcgggacgggtaccgggtaacgtagggtacggacgaccgtaggaaccgtacggtggtaccggacgtccgacctaaccgtcgttacgttccgttaccttaccgtacgttcccgttacccg

SEQ ID NO: 217626 - DNA, 802 bp, Homo sapiens
  misc_feature: GYAE6OF02FS84B.9.3.A03.1.454.CMB.1.raw
  modified_base (266)..(266): a, c, t, g, unknown or other
  misc_feature (266)..(266): n is a, c, g, or t
  modified_base (318)..(318): a, c, t, g, unknown or other
  misc_feature (318)..(318): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagcccaccctgtccttgtcctccgaaggggaaagacgcccaccctctcctgcgagggccagtccagagtcgtcggcacctagtagccgtaggtacccaanacgtaactccgtacggccacggcctccgacggtccttcctactattttacgngtagttcgactactacccgaaaccgtacggggaccctacggtcgggtcccgccccgtaggtacccggtaacgggtttccgacggggtttacggacggtaacgggggttcggggtttaccgtacgggggtaaccaacgggttttactttaccccggaacctttcccgtaaccctaacccgtagttaacccgacgtcccgtaacggtaccgtaacggtaaccggtaccgtaacggtaaacgttacgtttttacggttacttttaacgtttttaacttaaccggttgttaccgttaacgccgtacggtccgttacggtaccggtaacgggttcgttaccgttcgttaccgtttccggtttacgggaccgggtaacggaacgtaacgggtagggacgtaaccgggacgtaaccggtacggttacgggtcggaccggtaccgtaccgtacgtcgttcgttaccgttaccttccttacctccgtaccccg

SEQ ID NO: 217627 - DNA, 893 bp, Homo sapiens
  misc_feature: GYAE6OF02JDLP6.9.3.A03.1.454.CMB.1.raw
  modified_base (198)..(198): a, c, t, g, unknown or other
  misc_feature (198)..(198): n is a, c, g, or t
tcagtgatacgtctcacgaccggtgctcgatttagagagcgtcacagggggaggaactgctcagttaggacccagagggaaccatggaagccccagctcagcttctcttcctcctgctactctggcctcccagtgaccaccggagaaattgtgttgacacagtctccagccaccctgtccttgtctccgaggggaaancgccaccctctcctagccagggccagtcacgtagtggttggccaccgtacgtagccctaggtaaccaaacagaaccttccgtacggacccaagggccctaccccgaagggtccttaccccgtcctaagttttacgtacggaacttcggacctaaacgtccccgaaaccgggtaacgggtccccgtaaaccggtcgggacccccggtttaacccccaagggtaccccggttaaacgggtttcccgaagggtttaccgggacggttaacggggttcggggttacccgtacggggggaaacctaggtaacccgttttacccaaccggtttcccgttaacccgaaaccgtacttaaccggaacggtacccgtaacggtacccgtaacggtaaccgtacccgtttaagggtaaacgtttaacgtttttaccggtacttaaagtttttttaaccgtacttacggtacgtaacgtactacggtacggtaccgtaccgtaaaggttccggtaccttttaccgttacgttacccggtttacgggacgggttaacggggtaacccgtaaagggtccgggtaaacaacccggtagtaaaacccggaacgtttcgggtaacggtaccgttacggtaacccgtaacccggttaagttcccggtttaccgttaacccgtttaccgtacccgtttacccgttacccccgg

SEQ ID NO: 217628 - DNA, 729 bp, Homo sapiens
  misc_feature: GYAE6OF02FKX4V.9.3.A03.1.454.CMB.1.raw
  modified_base (195)..(195): a, c, t, g, unknown or other
  misc_feature (195)..(195): n is a, c, g, or t
  modified_base (322)..(322): a, c, t, g, unknown or other
  misc_feature (322)..(322): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccacggagaaattgtgttgacacagtctcagccacctgtccttgtcctccgaggggaaanacgccaccctctcctgcgagggccagtcagtagttggttcggccaaccgtacgtacgtcccgtcggtaacctaaccgacgtaactcccgtcggccgacggtcctccggacgtcctcctctattttangtatcgacactaccaacgacggcctacgtcggccgtacccgacgtaccgtaggttacacggttcggacgtagggtcgggtcgtacggggactacgtaccttaccgacttccgtacacctactacggagaccgtacgtaccgtacggacgtaccgttagtaagttacgtttataccgtttaattttacctacgttagtacgacgtaccgtaacgtccgttacgtaccgtaggttacggttcttaccgttaccgttaccggttacgggggaccgggtaacgggtaaccgggtaaaggtacggggaaccgacggtaacggaacgttaccggtacgggtacggtcgtacggtaaccgtaccgttaacgtccgtttacggttacctttaccgtacctttacccggtaccccg

SEQ ID NO: 217629 - DNA, 968 bp, Homo sapiens
  misc_feature: GYAE6OF02IW4I7.9.3.A03.1.454.CMB.1.raw
tcagtgatacgtctcacgaccggtgctcgatttagagagcgtcacagggggaggaactgctcagttaggacccagagggaaccatggaagcccagctcagcttctcttcctcctgctactctggctcccagtgaccaccggagaaattgtgttgacacagtcctccagcccaccctgtccttgtctccgagggaaacgcgcccgaccctctcctgcgacgggccagtcagagtgttggcaccgtacgtacgcctcggtaaccaacagaacttccgtcgggtacccagggtccctccccggtaacgggtcccttccccgtacttaagttttactacggtactggaccctacgttaccccgaaacggaccggggacccgacggttcggtaccccggtccccgaacggtcccgtaaacgggtttccgaagggttcgggaccgtaacgggtttcggggtcggttacgggaacggtacggttaccttaccgtaccttccgtacctaaacccgtagttacccgaacggtcccgtaaacccggttaacccgttaacgggaacccggttaacccggtttaaaacgggttaaacggttttaaaccgtttttttcgggtaaacctttttaaacgttttttaaacgttttaacccggtttacgtacccggttaacgtaacccggttaaccggtccggttaaacccgtacccgggttaaacgtttccgggttaacgttttaccccggttaccggtttttaacccgggtttaccggggtaaccgggggttaaccgggggtaaacccggttaaaacccggggtacggggttaacccggaaccggttaacgggtaaaacccggtttacgggtttaccgggttacgggtttacccggtaccgggttacccgaacccgtttaacggtttccccggtttacggttacccttttacggttaccccgtttaccccgttttacccccgg

SEQ ID NO: 217630 - DNA, 705 bp, Homo sapiens
  misc_feature: GYAE6OF02ISW7W.9.3.A03.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (262)..(262): a, c, t, g, unknown or other
  misc_feature (262)..(262): n is a, c, g, or t
  modified_base (486)..(486): a, c, t, g, unknown or other
  misc_feature (486)..(486): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgactacagtctccagccacctgtccttgtctccgaggggaanacgccaccctntcctgcgacggccagtcagtagttgttgactaccgtacgtacgctaggacccaanacgaactccgtaggaccgaggccttcccgaacggtccttacccgtactaatttagagtatcgactactaccaacggaccgggtccacggtcggcccgaccacgacccgtaggttacacggtcggtacgacggttcgggtacgtacggggtacaggtacctttaccgactccgtacaacgtctaccgacgccgaagtaccgtaggaccgtactaggtaacgtttnttttacggtaactttatttaaccgttcgtacgttacagtactaccgggttatacggtacctaaggttcggtacctttcttaaccgtacgggtttccgggtaccgggtaacgggtaaccaagggttacgacgtaaaccgtacggtaacggtaaccgtggtaccgtacggacgtacccgtactagttcgttacgttccgttccttaccgtccgttacccgg

SEQ ID NO: 217631 - DNA, 808 bp, Homo sapiens
  misc_feature: GYAE6OF02FRE2M.9.3.A03.1.454.CMB.1.raw
  modified_base (240)..(240): a, c, t, g, unknown or other
  misc_feature (240)..(240): n is a, c, g, or t
tcagtgatacgtctcacgaccggtgctcgatttagagagcgtcacagggggaggaactgctcagttaggacccagagggaaccatggaagcccccagctcagcttctcttcctcctgctactctggctcccagtcgaccaccggagaaattgtgttgacacagtctccagcccacccttgtccttgtcctccgaaggggaaagacgccctacccctcctcctcgcgacgggccagtcagngttgttcggcctacctacgtacgcccgtaggtaacccaacgagaacgttcccgtcggcccgaacggtcccttacccggaacgggtcccttccctccgtttaactttttagtacggtacttcggacctaaccttaaccccgaaacgggaccgggtacccgtaaccggtcggggtaccccgtaccccgaccggtacccgtaacgggtttaccgaagggttcggaccggtaggggttcgggtacggtagggtaacgtacgttacctaccgtacgtaccctaccaaccgactacgacgaccgtaccgtacgtaacggacgtcccgtaaggtaacgttttagtttacgttacgtttaattttaaccttaccggtacgttaccgtacgtacgtacgttaccggtgtacccggtaacggttcgttaccgttccgtttacccgttacggtttccggggtaacccgggaacgtacgggtaacggtaaggacccgtaacgaccggtaacgtacggtcggtccgtacggtaccaccgtactcgtttccgtaccgttcgtaccttcgttcccgtaccccg

SEQ ID NO: 217632 - DNA, 642 bp, Homo sapiens
  misc_feature: GYAE6OF02GTF3P.9.3.A03.1.454.CMB.1.raw
  modified_base (420)..(420): a, c, t, g, unknown or other
  misc_feature (420)..(420): n is a, c, g, or t
tcagtgatacgtctcacgaccggtgctcgatttagagagcgtcacagggggaggaactgctcagttaggacccagagggaaccatgggaagccccagctcagcttctcttcctcctgctactctggctcccagtgatcaccggagaaattgtgttgacacagtctccagcccaccctgtccttgtcctccgaggggaaagacgccctaccctctcctgcgagggccagtcaggtagtgttcggctaccgtacgtacgccgtacggtaaccaacaagaactccgtcggaccaggcctccccgaggtccttcccgtactagtttatgatcgctactaccaacgacgggccacggtcggccgtcccagccgtaggttcaggtggcgtaggtgggtcgagggacaggtactcgactcacacctntacgacgcacgcgtacgcgtacgtagtagttagtttgtacttaagttttacttacgttgtacgacgtcgtacgtcgtacgtaccgtacggtcgtaccgtttccgtacgttccggtttacgggaccggggtacgggaaccgtaggggtacgacggtaccgacggaacgtacggtaggtcggcgtccgactacgtacgtcttccggtacttcgtaccgttcccg

SEQ ID NO: 217633 - DNA, 674 bp, Homo sapiens
  misc_feature: GYAE6OF02IF4A0.9.3.A03.1.454.CMB.1.raw
  modified_base (104)..(104): a, c, t, g, unknown or other
  misc_feature (104)..(104): n is a, c, g, or t
  modified_base (237)..(237): a, c, t, g, unknown or other
  misc_feature (237)..(237): n is a, c, g, or t
  modified_base (281)..(281): a, c, t, g, unknown or other
  misc_feature (281)..(281): n is a, c, g, or t
  modified_base (515)..(515): a, c, t, g, unknown or other
  misc_feature (515)..(515): n is a, c, g, or t
  modified_base (523)..(523): a, c, t, g, unknown or other
  misc_feature (523)..(523): n is a, c, g, or t
  modified_base (577)..(577): a, c, t, g, unknown or other
  misc_feature (577)..(577): n is a, c, g, or t
  modified_base (632)..(632): a, c, t, g, unknown or other
  misc_feature (632)..(632): n is a, c, g, or t
  modified_base (644)..(644): a, c, t, g, unknown or other
  misc_feature (644)..(644): n is a, c, g, or t
  modified_base (659)..(659): a, c, t, g, unknown or other
  misc_feature (659)..(659): n is a, c, g, or t
tcagtgatacgtctcacgaccggtgctcgatttagagagcgtcacagggggaggaactgctcagtttaggacccagagggaaccatggaagcccccagctcagnttcctcttcctcctgctactctggctcccagtcgaccgaccgagaaattgtgttgacacagtctccacgcccacccttgtccttcgtctccaagggaaagacgcccacccgtctcctcgcacggccagtcagngtgttgcaccgtacgtacgccgtacgtaaccaacgagactccgngcctagcctacccgacggcctccctatatttacgtagagtgccacgtacccgaacgcggcccaccgtaggacccgttcccacgcccgtacggttccacggttcgggcgtacggttcggtacgttacggaaccgtataccgtttcgaacccgttccgtactaaccggtacaccgtagaccgtccgacgtacgaccgacgtcgtaaagttgttcgtactttaagttttcttacgtntacccgtntacccgtagtaccgcgttaccgaggttcgccgtttctccggtcgtttaccgggnggtaaaccggtacggaacgtaccggacgacctaggtaacgtacggtgttcggacncgaccgtacgtnttcgtcgttacccgntaccgtccttacccg

SEQ ID NO: 217634 - DNA, 747 bp, Homo sapiens
  misc_feature: GYAE6OF02IW78W.9.3.A03.1.454.CMB.1.raw
  modified_base (165)..(165): a, c, t, g, unknown or other
  misc_feature (165)..(165): n is a, c, g, or t
  modified_base (209)..(209): a, c, t, g, unknown or other
  misc_feature (209)..(209): n is a, c, g, or t
  modified_base (476)..(476): a, c, t, g, unknown or other
  misc_feature (476)..(476): n is a, c, g, or t
  modified_base (528)..(528): a, c, t, g, unknown or other
  misc_feature (528)..(528): n is a, c, g, or t
  modified_base (665)..(665): a, c, t, g, unknown or other
  misc_feature (665)..(665): n is a, c, g, or t
  modified_base (694)..(694): a, c, t, g, unknown or other
  misc_feature (694)..(694): n is a, c, g, or t
  modified_base (740)..(740): a, c, t, g, unknown or other
  misc_feature (740)..(740): n is a, c, g, or t
tcagtgatacgtctcacgaccggtgctcgatttagagagcgtcacagggggaggaactgctcagttaggacccagagggaaccatggaagccccagctcagcttctcttcctcctgcctactctggcctcccagtcgaccaccggagaaattggtgttgacaacngttcctcagcccaccctgttcccttggtcctccgaaggggaaancgtacccacccgtctccctggaccgacgggacccagtcaggtaggtggttacgacctaccggtacgtcgacccgttaggtaaccaaacgacgtaaccgtttccgcggaacccacggcccttaaccccggaacggtccttacctcttaattttagccggtaatacgaccgtaacaccccgtaacggtacggggcccaacggtccggtccccgtaaccaaccggtacccgtaacgggttcaagggtcgaacgtcggggttcggtaccgnggggaaccttcgtaccttacgactccgtaaccacgcttacgaccgaccgttnaccgttacaccggtataacggaacttttagtttacggtattttaactttacttacgtacttcgtacgttggtccgtaacgtacgtacgtcgtactccgttacgttcggttacggacgggtacgtacgttaaacgggngtaaaccggaccgagttacgcgtttacgnggtaccgacgtactaccggtactacgttcgtactacaccgtttccnctaccgg

SEQ ID NO: 217635 - DNA, 779 bp, Homo sapiens
  misc_feature: GYAE6OF02HOP9U.9.3.A03.1.454.CMB.1.raw
  modified_base (159)..(159): a, c, t, g, unknown or other
  misc_feature (159)..(159): n is a, c, g, or t
  modified_base (195)..(195): a, c, t, g, unknown or other
  misc_feature (195)..(195): n is a, c, g, or t
  modified_base (271)..(271): a, c, t, g, unknown or other
  misc_feature (271)..(271): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacanagtctcagccacctgtccttgtctccgaaggggaanacgcctaccctctccgtgcgacgggcctagtcaggtagttgttcggctaacgtacgtagcctacggtaaccaacanaactccgtcggacctaggccctacccgaggtcctccctacgtaattttacgtcgtaacgtgacctaaccttacccgaacggtacgggccctaccgtcggtccccgtacccacggtcccgtacggttacgacgggtcggtacggtagggttcgggtacggtacggggaactaacggtaccctttactaacccgttccgtacgaaacccgtcgttaccacgtacacgttaccgtagaccgtacgtagtaaacgtttagtttacgtacttttaacgttttacttaacgtcgtacgacggtacgtccgtacggcgttaccgaggttacggttcgttacccttacggtaacccggtttcgggaaccggggtacggtaaccgggtaaagggtacggaaccgtacggaacgggtaccggttaaggtacgggttaccggtacgtaaccggaacccgttaacgttacggttaccgttccgttaacctttaacccttaccgtttcccgttaaccccgg

SEQ ID NO: 217636 - DNA, 832 bp, Homo sapiens
  misc_feature: GYAE6OF02HQSW8.9.3.A03.1.454.CMB.1.raw
  modified_base (507)..(507): a, c, t, g, unknown or other
  misc_feature (507)..(507): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagcttttccagccacctgtccttgtctccgaggggaaagacgccaccctctcctgcgacgggccagtcagagtgttggccacctacgtacgccgttacggtaacccaaacgtaagaactcgaacgtcggtacccgacggtccctaccccgacggtccccttcctaacttaacgtttttactaggtaactcggactaaccttacccgaaaccggacgggaccctacggttccggacccggtccccgaacgacccggtacggtttaccgagggtcggtaccggtagggtacggggttcggttacggggacctacggttaccctttcggacccttcctacccgtaaacccncttaccgaacgaccgtacccggtacctaacggtaccgtaccgttaacggtaacgttttactttacgtaacgttttactttttaacgttacgttacggttactacggtactacggttcgtacgtaaccgtaggttcgttacctttcggtacgtttccggggttacgggaaccggggttaacggggaaaccgttaaggggggtaaccgtaaccggtaccggtaaacgggttaaccggtaacggttgggtaccgggtccgtttaccgaccggtacccgttaaggttcccggtttaacgttacctttacccggtacctttacccccggg

SEQ ID NO: 217637 - DNA, 762 bp, Homo sapiens
  misc_feature: GYAE6OF02F99MU.9.3.A03.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (275)..(275): a, c, t, g, unknown or other
  misc_feature (275)..(275): n is a, c, g, or t
tcagtgatacgtctcacgaccggtgctcgatttagagagcgtcacagggggaggaactgctcagttaggacccagagggaaccatggaagccccagctcagcttctcttcctcctgcctactctcggcctcccagtcgaccgaaccggaagaaattgtgttgacacagtcctccacgccctaccctgtccttgtcctccgaaggggaaancgccaccctctccngacgcggcagtcagtgtgtcggactacgtacgtacgcctacggtacccaanacgtaactccgcggaccgacgcctaccggagtccctccgtctactttagcgtatccgactaccgtacccgaacggtaccgggaccctaccgggtcggtcccgtaacccgcggtacccgttaacggtccgtaagggccggtacggtacggttcgggtacgtacgggactacggttaccttaccgaccgtcctaaccctacctacgtaacgacggtccgtaaccgtaccgtagaaccgacgttaacggtaacgtttagtttaacggttaccttttaacgtttcgttaacgttacgtacgtaccgtacggtacggtccgtacgtaccgttaaggttcccgtactttaccgtccgtttaaccgttcgggaacgggtaaccgggtaaccgtacgggacggacgtaaccgacggtaacggtacggtcggtaccgacgtccggtacctaccgtacgttccgttaccgttccgttacgttaccgttcccgtaccc

SEQ ID NO: 217638 - DNA, 819 bp, Homo sapiens
  misc_feature: GYAE6OF02J1J94.9.3.A03.1.454.CMB.1.raw
  modified_base (204)..(204): a, c, t, g, unknown or other
  misc_feature (204)..(204): n is a, c, g, or t
tcagtgatacgtctcacgaccggtgctcgatttagagagcgtcacagggggaggaactgctcagttaggacccagagggaaccatggaagccccagctcagcttctccttcctcctgctactctggctcccagtgaccaccggagaaattgtgttgacacagtcctccgagccctaccctgtccttgtctccggaaggggaaancgcccgaccctctccgtcgaccgacgggcctagtccgaaggtggttcggttacgggacctacccgttaggtaccgtccgttacgggtaacccaaacgtacgtaacgtcccgtgggaccgacgggccctacccggacggtcccttccctacttaatttacgcggtaatacgacgtacgtacccgaaacggtaccggggtcctaaccggtccgggtaccgttaccccgaggaccccgttacgggtttacacggggtcggtcgtaacgggttccgggtcggtaacggggactaccggtaccttacgaccttaccgtacctaactacgtaccgagtaccggtacgaacccgtaacggtaccggtaccgttaacggtaacggttttacgtttaaccggtacgttttaacgttttacgttacgttacgtacgtacgtacgtacggtaccggttgaaacccggttggttccgttacgtttccggaccgttttaaccggggttcggggtaaccgggtacgggtaaccggtacgggaacgtaaccgacgtaccggtacggtaacgtcgggtccgtgtaccgtaccgacgttcttcggtacgttcttacggtccttcccgtcccg

SEQ ID NO: 217639 - DNA, 1016 bp, Homo sapiens
  misc_feature: GYAE6OF02GAVX8.9.3.A03.1.454.CMB.1.raw
tcagtgatacgtctcacgaccggtgctcgatttagagagcgtcacgagggggaggaactgctcagttaggacccagagggaaccatggaagccccagctcagcttctcttcctcctgctactctggctcccagtcgaccaccggagaaattgtgttgacacagtctccacgccaccctgtccttgtctccgaggggaaagcgcccgaccctctcctgccgacgggccagtccgagtagtgttcggaccaccgtacgtacgccgttacggtaacccaacgaacgtaaacttcccgtacggtacccgacggtacccttaccccggaacgggttccttacccccgttacgtaagtttttaacgtacgtaacgtttccggaaccgtaacgtaacccccgtaaacggaaccggggtacccgtaacggttccgggtacccgttaaccccgaccggtaacccggtacgggtttaacccggaacgggtttccgggtacggtaaccgggggttacgggggttcccgggtaacgggggtaacccttaacggttaaccccgtttaccgtaacccggtttacccttaacccggtaaaccctacgttaacccggaaccggtacccgtaaccgggttaccctaaacgggtacccggtaaccggttaaacgggttaaaccgttttacggtttttaccggtaaccttttttaacggtttttaaaccgtaccggtttaccgttaaccgttaacggaccgttaaccgggttaccgtaaccgggttaacccgtttaagggttaccggtttacccgttttaccgttaacccgtttacggggtttcccgggtaaccggggggttaacggtaacccgggtaaagggtttaaccggggaacctaaccgggttaacgggtaaccgggtttaacccggtaacggggttaccgggtaacccgttacgacccgggttaaacctttaccgttaccgggtttacccgttacctttacccggtacccttaccccggttaaccccgg

SEQ ID NO: 217640 - DNA, 762 bp, Homo sapiens
  misc_feature: GYAE6OF02JYT8S.9.3.A03.1.454.CMB.1.raw
  modified_base (270)..(270): a, c, t, g, unknown or other
  misc_feature (270)..(270): n is a, c, g, or t
  modified_base (427)..(427): a, c, t, g, unknown or other
  misc_feature (427)..(427): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtcgaccaccggagtaaattgtgttgacacagtctccagccaccctgtccttgtcctccgaaggggaagacgcctaccctctccgtgcgagggtccagtacaggagtggttcgacacctacgtcgccttcggaaccaanagtactccgtacgcctacggcctccgaggtcctccttagtattttacgacgattcgacctcgtacccaaacggcggaccttacggcggtcccgtacccgactaccggttaacggttccaacggggtgtaccgaggggttcggtcgggtacggtaacncggttaactcgtacctcggttaccacgttacgtaccgacggtacgacgttaacccgtacggtaccgtaacctttaagggaaacgttttacgtttaccggtactttttaaacgttttacgtacgtttaccgtacgttacggaccttacggtacgtacggtaaccgtgtttcggtactttccgttaagtcccggttagggtaaccggaacggtaacggtacggaacggaccggtaaccgacggttaaccgaggttaccggtacggtactacggttaccgaacgtttaccggttaacttccggtttacctacccggttcgttaccccggtttaacccc

SEQ ID NO: 217641 - DNA, 695 bp, Homo sapiens
  misc_feature: GYAE6OF02JTSU6.9.3.A03.1.454.CMB.1.raw
  modified_base (145)..(145): a, c, t, g, unknown or other
  misc_feature (145)..(145): n is a, c, g, or t
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
tcagtgatacgtctcacgaccggtgctcgatttagagagcgtcacagggggaggaactgctcagttaggaccagagggaaccatggaagccccagctcagcttctcttcctcctgctactctggctcccagtcgaccaccggganaaattgtgttgacacagtctcacgccaccctgtccttgtctccaggggaancgccaccctctcctgcgagggccagtcgagngtgttcggcacctacgtagcctaggtaccaanacgactcctggcacggcctccgagctcctcgtatttacngatgacactaccgacgacgggccacgtcggccgtcccgaagccgtaggttccgaaggtcggtccgtaagggtccgggttacgtacgggaacaacggtcctttaccggaacttcgttaccgaactcgtacgacgtcgacgtacgtacgtacgacccttaggaactttacgtttacggctttaatttttaacgtcggttacttcgacgtacgtcggtcgtacgtacggcgtttagccgttcgtaccgttacggtttcgggagggtaaccgggtaccgtaagggtaggaaccgtcgggttaaccgaacggttaccggtacgggttaccggttcggaccgtacccgtaccgttacgttccgttcgggtttaacctccgttaaccgttccccggtttacccg

SEQ ID NO: 217642 - DNA, 711 bp, Homo sapiens
  misc_feature: GYAE6OF02JV640.9.3.A03.1.454.CMB.1.raw
  modified_base (688)..(688): a, c, t, g, unknown or other
  misc_feature (688)..(688): n is a, c, g, or t
tcagtgatacgtctcacgaccggtgctcgatttagagagcgtcacgagggggaggaactgctcagttaggacccagagggaaccatggaacgccccagctcagcttctcttcctcctgctactctgctcccagtcgaccacggagaattgtgttgacacagtctccggccacctgtccttgtcctccgaaggggaagacgccctacctcctcctgcgacggccagtcagagttgtcgcacctacggtcgccgtacgtaccaagacgtaactccgtacggccacggtcctccgacggtcctcctacgtacgtttacgtcggtacgttcgaccgtaacgtacccgaaacggacggtccctaacgggtccgggtaccctacccgacgtccggttacgggttcaaggttcggcgtaacgggttcggggtccgacggggtaacgtacgttacccgtttacgacctttaccgttaccgaaccgtactacgaaccgtacgaccgtaccgtaacgcgtaccgtaagttaaacgtttacgtttcgtaacgtttaactttacgttacgtaccgtacgacggtcgtacggtacgtcgtacggtaacgtgtaccttcgttacgtacggtcggtaaggacgtacgtaggacgtaacgacgtacgtacgtacgtggacgtcgtcggtctacgtcgtacggtntaccgtcgtacctcgtccttacg

SEQ ID NO: 217643 - DNA, 702 bp, Homo sapiens
  misc_feature: GYAE6OF02FHHJK.9.3.A03.1.454.CMB.1.raw
  modified_base (199)..(199): a, c, t, g, unknown or other
  misc_feature (199)..(199): n is a, c, g, or t
  modified_base (348)..(348): a, c, t, g, unknown or other
  misc_feature (348)..(348): n is a, c, g, or t
tcagtgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtcctccgaggggtaaancgcctacccgtctcctgcgacggcctagtccagtagtggttcggactacctacgtacgtccgtacggtaacccaacaggtaacttcccgtagggacccagggtacccttccccggaagggtccccttacccgttacgtaagtttttacncggtaacttcggacctaacttacccgaaaacgtcggggaccctaacggtcggaccccgtacccgaggtccctaagggttccaacggttggaccgtaggtcggtcgtagggacagtaccttcactctaccactatcgacggcacgtactacgcgactaggaatacgtttcgactttatttactacgtcgttacgagtctacggtctacgtacgaacggttcgtccgttacctcgttaccgttacgggacggaaccgtaccgtaagggtcgaacgtcgacgtaacggacgttcggtcgacgttaacgacctacgttaccttcgttaccgttccgtttactacttaccccgtacccg

SEQ ID NO: 217644 - DNA, 830 bp, Homo sapiens
  misc_feature: GYAE6OF02GBRWZ.9.3.A03.1.454.CMB.1.raw
  modified_base (201)..(201): a, c, t, g, unknown or other
  misc_feature (201)..(201): n is a, c, g, or t
tcagtgatacgtctcacgaccggtgctcgatttagagagcgtcacgaggggggaggaactgctcagttaggacccagagggaaccatggaagccccagctcagcttctcttcctcctgctactctggcctccagtcgaccacggagaattgtgttgacacagtctccacgccctacctgtccttcgtctccgaaggggaanacgccctaccctctacctgacgacggtccagtcgaagtcggtcgttcggccaccgttacgtagtccgttacggaaccctaagacgtacgtcccgtggacccgtacggccctacccggacggtccttcccgttactacgtttaagcggtaatccgaccttaaccaccggtaaacgggttacccgggaccctaccggggtaccggtaccccggttaccctacgggtacccgttagggttaccgggaggggttaccggaccgggttacggggtttacggggtaccggtagggtaaaccccggttcgttaaccgggttcctaacccgggttacctacccggtaaaccgtaccggtaaaccgtcgtaacccgggtaaccgtaccgtaacggtacccggtaaccggtttacggttaaacgttttaaccggttttacgttaaccgtttttaaactttcgtttaaaccgttaccgttacgttacgtacggtacgtcccggttaacgtaccgggttacgtccgttacgttaccgttaacggttcggttacgggtacggtacggaacgtaggtacgagtaccgagtacggacggtcgacgctccgtactctacgttctacgtctcgtacctccgtaccg

SEQ ID NO: 217645 - DNA, 931 bp, Homo sapiens
  misc_feature: GYAE6OF02IOHFJ.9.3.A03.1.454.CMB.1.raw
tcagtgatacgtctcacgaccggtgctcgatttagagagcgtcacaggggggaggaactgctcagttaggacccagagggaaccatggaagccccagctcagcttctcttcctcctgctactctcggctccagtgaccaaccggagtaaattgtagttgaacacgagtctccacgtccctacccttcgttccttgtcctaccggaaggggaaacgtacgaccctacccttcctcctcggacggacgggtaccaaggtaccaagggtacggttggttcggaccgtaaccgttacggtacggtccgttacggtaaccaaacgaagtaaccgttccgtcggacccgtaggccgtacccgacgggtccttaccttacgttaagtttacgtacggtactcggtactacctaaccgaaccgaccgggtaccctacggtccgggtaccttacccgacggtaacgttacgggttcgtacggtcggtacggacgggttcggtcggggttaacggcggtacgtccttacgacctcgtaccaactacgtacacggtcgtaaccggtaccggtagtaccgggtaaccgtaagggttagttttaaccggtttcggtttaaacctttttacgtttaaccgttacggttccgtaacggtaccgttacgtaccgggttaaccggttaaccgaacgggtttaccgggtaaccgttcccgtttaaccggttttaaccggtttacccggggtttcggggaaacccgggggtttaccggggttaaaccggggtaagggttaaacgggaacccggttaaaccggaccgggttaaaaccgggttcgggttaaccggtcccgggtccgttaacccgggtaacccgttaaccgtacgggtttaccttaccgggtttacccttttaaccgtaccccgggtttaccctacccccggg

SEQ ID NO: 217646 - DNA, 778 bp, Homo sapiens
  misc_feature: GYAE6OF02GTN81.9.3.A03.1.454.CMB.1.raw
  modified_base (116)..(116): a, c, t, g, unknown or other
  misc_feature (116)..(116): n is a, c, g, or t
  modified_base (292)..(292): a, c, t, g, unknown or other
  misc_feature (292)..(292): n is a, c, g, or t
  modified_base (330)..(330): a, c, t, g, unknown or other
  misc_feature (330)..(330): n is a, c, g, or t
tcagtgatacgtctcacgaccggtgctcgatttagagagcgtcacagggggaggaactgctcagttagacccagagggaaccatggaacgccccagctcagcttctcttcctcctnctactctcggctcccagtcgaccgaccggagaaattgtgttgacagtgtacctccgacgcccacccttgttccttcgttcctccgaagggggaaacacgcccaccctctcctgccgaggaccagtccaggtacgtggttcgaccgaccgttacggtacgccgttacggtaccaaanacgtaacctccggtacggaccgtaaggccctaaccggnggtcccttccccgtattaactttagtacgtagttccgaactaacctaacccggaaaacgtcccggggaacctaccgggtccggtcccgtaccccgtagtacccggtaaggtttcaacgggtcgacgtacggggttcggtcggtaacggggtaacacgttacctctaacgtccgtaccactacgtcgaactacgacggaccttagacgtccgtaaagtactttaacgttgtactttaacgttttaacgtcttacgtacgtcgtacgtcgtacgtaccgtcgtaacggtcgtttacccttcgttacccgtttacgggttaccggggtaaccgggaccgggtaacggttaaaccggacggttaaccgaacggtacgaacggttcggtaagggtctacggttaccgaccttacgcgttacgtccgttccgttaccgtcccttaaccgtcccg

SEQ ID NO: 217647 - DNA, 864 bp, Homo sapiens
  misc_feature: GYAE6OF02FPWLT.9.3.A03.1.454.CMB.1.raw
  modified_base (200)..(200): a, c, t, g, unknown or other
  misc_feature (200)..(200): n is a, c, g, or t
tcagtgatacgtctcacgaccggtgctcgatttagagagcgtcacagggggaggaactgctcagttaggacccagagggaaccatggaagccccagctcagcttctcttcctctgctactctggctccagtcgaccaccggagaattgtgttgacacagtcctccacgcctaccttgtccttgtcctccgaggggaaacncgccaccctctccgtacgcgacgggcctagtcgagacggtcgttcggacctaccgtacgtacgtaccgttacggaacctaacgagtaaccttccgtacggaccgacggtccctacccggacggttcccttacccgttacgttaagtttttacgacggttaacgtccgtacctaaccgttacccgaaaaccggtccgggtaccctaaccggtccgggtaccctacccgacgttaccgttacgggttaccgtacggtcgggtacggtacgggttacggtcggtacggactccgttacctacttaccgtacctaccgacgtactccgacggtaccgtacgtccgtaacgtacggtaccgttaaggttaaccgtttacgttttacgtaacgtttttaacgtttacgttactaccggttgtaaacgtccggttcggtaccgtacgttaccggtggtttaccgttaccctttacgggttacccggtttacggggttaacccgggtacggggtaaaccgggttacggtaaacggggtaacggtacccgggtaaaccggttaccggacggttaacccggttcgggtaccgtacccggttaccgtccgtaaccggtttccttaccggttacccggttacccgtttaacccttaccggttaccccgttaacccg

SEQ ID NO: 217648 - DNA, 781 bp, Homo sapiens
  misc_feature: GYAE6OF02IYQBM.9.3.A03.1.454.CMB.1.raw
  modified_base (239)..(239): a, c, t, g, unknown or other
  misc_feature (239)..(239): n is a, c, g, or t
  modified_base (520)..(520): a, c, t, g, unknown or other
  misc_feature (520)..(520): n is a, c, g, or t
  modified_base (562)..(562): a, c, t, g, unknown or other
  misc_feature (562)..(562): n is a, c, g, or t
tcagtgatacgtctcacgaccggtgctcgatttagagagcgtcacagggggaggaactgctcagttaggacccagagggaaccatggaagccccagctcagcttctcttcctcctgctactctgctccagtcaccaccggagaattggtgttgacacagtctccacgccctacctgttccttgtcctaccgaaggggaaacacgccccacccttctccgtcgccgagggtcccagtcgngtaggttgttacggctaccgttacgtacggcctacggtaacctaacaggtaactccggtagggtaccaccggacctccccggacggtcccttaccgttctttaagtttagtaccggtaagttccgaccctaaagtaccccggaacggtaccgggacccacggttccgggaccctacccgtaggacccgttaggtccgaacggggtcgtcgttaacggggcggttcggtaacggtacaccgttaccgtttacaaccctttcggaccctaacgacttaaccgngtacccgttacggacccgttaaggccgtactagtacggtttnttacggttatttacttacgttactgtacgaactcgtaacgttcgccgtacgtacgttcgttacctttccgtaccggttagttaccgggaccggtaacgggtacggtaaaggtacgaaccggtaagacggtaccgttacggtggtaaccgtcggtaaccgacccgttaggttacttcccggttcgtttaccgttacccgttaccggttccccgtaacccg

SEQ ID NO: 217649 - DNA, 877 bp, Homo sapiens
  misc_feature: GYAE6OF02F593H.9.3.A03.1.454.CMB.1.raw
tcagtgatacgtctcacgaccggtgctcgatttagagagcgtcacagggggaggaactgctcagttacggacccagagggaaccatggaacgccccagctcagcttctcttcctcctgctactcgtcggctaccctagtcgtacccgaaccgggataaaagtttcgtacgttagaacaactacggttccttccgaacgccctacccgttgttacccttgttacctacccgagggggaaaacacgccctacccctctccgtagccgacgggtaccgtacgtcgaaggtattcggttcggacctaccgttaacggtaacgtcccgttacggtaaacccaagaacggtaaaccttccggacggacccgtacggtccccgtaccgtacggtccttaccgttacgttaacgttttacggacgttacctacgaaccgtaccgtaaccggtaacggaccggaccgtaccggtaccggtaccccggtacccgacgttaccggttacggttcgacggtcggtacgttcgggttacgggtacggtacggtaaccgtaccgttaccgttaccgtacctacctaacccaaccgttacgtaaccgaccgtaccgtaacgtaccgtaacgtaccgtaccgttaagttaacggtttactttacgtacttttagtttaacgtacgttacgtaccgtacggtacgtacgtaccgtcggtaaccgttcggttacttaccgtaccgttcgttaccggttacgggaccggttaaccggtaacggtacgggtacgaaccgtaacggacgttaaccggtcggtaacgggttactaccggtaacgtacgtaccgtaacgttccggttaccttacgttaccgtttacccgtacccggtacc

SEQ ID NO: 217650 - DNA, 783 bp, Homo sapiens
  misc_feature: GYAE6OF02FSZCN.9.3.A03.1.454.CMB.1.raw
  modified_base (200)..(200): a, c, t, g, unknown or other
  misc_feature (200)..(200): n is a, c, g, or t
tcagtgatacgtctcacgaccggtgctcgatttagagagcgtcacaggggggaggaactgctcagttaggacccagagggaaccatggaagccccagctcagcttctcttcctcctgctactctggctcccagtcgaccaccggagaaattgtgttgacacagtctccagccaccctgtccttgtctccgaaggggaaancgcccaccctctcctgcagggccagtcagagtgtcgcaccgtagtagcctaggtacccaacagaactccgtaggccaggcctcccgaggtcctcctattatttagcgtagtcgacctaactacccgaaacggacgggcccctaacggtcgggtacccctacccgacggcccgtagggtttaccaagggtcggagtagggttcgggtaccgtggggaactacggtaacctttacaactttccgacctaaccctatacccgacggtcctaaggtccctaaggaccgtacccgttaaggtaaacgtttacgttttacgaacttttaacgttttaacgtttaccgttggttaaccgtaacgtcgtaacgggttaccgtaacggtaccgttaaggtccggtttacctttacccgtccgttttaccggggttaccggggaccgggtaaaccgggggtaaccgtaaacggggttccgaacggtaaccggtaacggtaacggtaacggtttgggtaaccgtccgttacgaacccgtaaccgtaccgttcggttaccgtttacgttaccttacccgttacccgttaccccgg

SEQ ID NO: 217651 - DNA, 673 bp, Homo sapiens
  misc_feature: GYAE6OF02F4P45.9.3.A03.1.454.CMB.1.raw
  modified_base (133)..(133): a, c, t, g, unknown or other
  misc_feature (133)..(133): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
tcagtgatacgtctcacgaccggtgctcgatttagagagcgtcacagggggaggaactgctcagttaggacccagagggaaccatggaagccccagctcagcttctcttcctcctgctactctgcctccagtnaccaccggagaaattgtgttcgactacagtctccagtcccacccttgttccttgtctccggaaggggaaacacgccctaccctctcctgcgacgggtccagtcaggtacgtgttcggcaccgtaacgtgcctacggtaaccaacagaacttccgtaggccaaggtcctaccgacggtcctaccgttntaactttagngtactcgactacaccgacgtaggcctacgtcgtcgaccctagccgttagtctacgtgtacgaggtcgtcggtacggacttacgccttaacgctccgtacaacgtcttcgaacggtcacgtcgtacgacgcgtacgaagttacgtttactacgttaactttacgttaacgttctacggttacgaccgtacgtacgtacgtaccgtaacgggtcgttacgtacgttccgttacggttacggtaccgggacgggttacgagggtacggacgtaacgcgtaacgtaccgggtagtacggtcgtaccgcgtacctagttccgtacgttctcttcccgtaccttcccgg

SEQ ID NO: 217652 - DNA, 907 bp, Homo sapiens
  misc_feature: GYAE6OF02F6W60.9.3.A03.1.454.CMB.1.raw
tcagtgatacgtctcacgaccggtgctcgatttagagagcgtcacagggggaggaactgctcagttaggacccagagggaaccatggaagccccagctcagcttctctcctcctgctactctggcctcccagtgaccaaccggagaaatttgtagttagactacgagtccgtccaacgccctaccctgttccgttcgtcctccgtaagggggaaagacggtcccacccgttaccgttccgtcgacggtacggccgacgttacgaacggtggttcgggttacggacctaaccgtacggttacggtacccgttacgggtaaccctaaaaccgacgttaaaccgttccccgggttacgggaccccggtaacgggtacccgttaccccgacggggttaccttccccgtaccttaaacgttttagtacggacgttaccggacttaaccggtaaccgaacggtaacccggtaccgttaacccgggtcggggtaccccgtttacccggaccgggttaccggttaacgggtttacccgggacggtacgggttccccgtaaggggttaccgggttccggtaacggggtaccgtaccggttaaccgtttcccgtacggttacaccgtaacccgtacgttacgaacggtcctaacgggccgtaacggttaccgtacgtacggttaaacggtttcgttaaagttacccgtttaagtttacgtaccgttaggtacgaacgtcggtacgttaccgtacgtcggttacggtaccgtcggttaccttacggtaccggtttcgggaacgggttaaccgggtaaccgtaacgggtcggaacgtaaccgtacgtacgtaccgggtagttccggacgactacccgtacggtaccgttcggttaacctctcccgtacgtcccttaccg

SEQ ID NO: 217653 - DNA, 684 bp, Homo sapiens
  misc_feature: GYAE6OF02GI0XS.9.3.A03.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (254)..(254): a, c, t, g, unknown or other
  misc_feature (254)..(254): n is a, c, g, or t
tcagtgatacgtctcacgaccggtgctcgatttagagagcgtcacagggggaggaactgctcagttaggacccagagggaaccatggaagccccagctcagcttctctcctcctgctactctggctcccagtcgaccaccggagaaattgtgttgaacacagtctccagcccacctgtccttgtctccagggaaancgccaccctctcctgcagggccagtcagngtgttggcacctagagtcctaggaccaanagtaactccgtggcccgaggtcctcccgaggtcctcctctaatttagcgatcgtacactaccgaacgcggcctacgtcggcctccaggtccctaagggttcaggtcgacgtaggttcggtccgtaggggactacgtcctacgacctttcgacactaacgtccgtacgactaacggtcctagaaccgtcgtaggttaacttagtttacgtactttaactttaagttccgttagtaccgacggtacgacggtacgtcgtacccgtaaggttcggtaccgtttcgttaccggtttaccggttccgggacgggtaaccggtaccgtaaagggttcgaacgtaccggacgtaacggacgttacggcgggaccttaacggtacccaagtaccgtttacgttccgttaccgtttacctacccgttcccgttaccccg

SEQ ID NO: 217654 - DNA, 784 bp, Homo sapiens
  misc_feature: GYAE6OF02JYSJT.9.3.A03.1.454.CMB.1.raw
  modified_base (210)..(210): a, c, t, g, unknown or other
  misc_feature (210)..(210): n is a, c, g, or t
  modified_base (422)..(422): a, c, t, g, unknown or other
  misc_feature (422)..(422): n is a, c, g, or t
  modified_base (486)..(486): a, c, t, g, unknown or other
  misc_feature (486)..(486): n is a, c, g, or t
  modified_base (493)..(493): a, c, t, g, unknown or other
  misc_feature (493)..(493): n is a, c, g, or t
tcagtgatacgtctcacgaccggtgctcgatttagagagcgtcacagggggaggaactgctcagttaggaccagagggaaccatggaagccccagctcagcttctcttcctctgcttactctcggcctcccagtcgaccaccggagtaaattgtgttagacacagtcctccgacgcccaccgtgttccttgtacctaccggaaggggaanacgtcccacccttcgtcctggcgacgggtcctaggtcgaaggttgtcggttacggacctaaccgttacggtacgtcccggttacggtaaccaaacgaagtaaccgtcccgttacggccaggccctaccgacggtccttaccgttacttatttacgtggtaactcgtacgaacgttaccgaacgaccgggtacctacgtccggacccgtaccngtacccgttaggtaccagggtcgacgaggtcggcggtaggactacgttactacgtactcgtacnccgtaanaccggtacgtacgaccgtacacggtacgacgttaggtaacgttagtttacgtacttttatttaaccggttacgtagttaccggacttcgggtacgtacgttaaccgggtaccttacggtctttcgtttaacgtaccgttttacgggtggggtaaccgtaccggggtaaacgtacgggtaacgccgttaacgtacggtccgttaaggttccgggaacgggttccttaacgtacctaaccgggtttcttaacgggttcctttaccggtaacccgttcggttccccttaaccgg

SEQ ID NO: 217655 - DNA, 167 bp, Homo sapiens
  misc_feature: GYAE6OF01BVXUG.34.28.C06.1.454.CMB.1.raw
  modified_base (167)..(167): a, c, t, g, unknown or other
  misc_feature (167)..(167): n is a, c, g, or t
tcagtacacgtgatcacgaccggtgctcgatttagagctcacgtattgggtttgggggtgtggtggtactccactcccgccttgacggggctgctatctgccccctcggtcactctgttcccgccctcctcatcacgtgtactgagcgggctggcaaggcgcatagn

SEQ ID NO: 217656 - DNA, 166 bp, Homo sapiens
  misc_feature: GYAE6OF01CJ6HX.34.28.C06.1.454.CMB.1.raw
  modified_base (166)..(166): a, c, t, g, unknown or other
  misc_feature (166)..(166): n is a, c, g, or t
tcagtacacgtgatcacgaccggtgctcgatttagagctcacgtattgggtttgggggtgtggtggtctccactcccgccttgacggggctgctatctgccccctcggtcactctgttcccgccctcctcatcacgtgtactgagcgggctggcaaggcgcatagn

SEQ ID NO: 217657 - DNA, 516 bp, Homo sapiens
  misc_feature: GYAE6OF01BUJ66.34.28.C06.1.454.CMB.1.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
  modified_base (512)..(516): a, c, t, g, unknown or other
  misc_feature (512)..(516): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgtttgatgattanaagtctgtctctggtaccaacaacacccggcaaagctaccaaactcatgatttangatgtacaataatcggccctnaggttgtttcnctatcgtcttctctcgcctcatgtctggacaacgacggcctccctgacctatctctcggactccgaggctggaggacgagggtcacgcccaaggctcgcccctcggtcactctcgtccccgcctcctcactctacgtgtactggacggcgggtcgtcggcgacggcgactatacgnnnnn

SEQ ID NO: 217658 - DNA, 526 bp, Homo sapiens
  misc_feature: GYAE6OF01CW4IZ.34.28.C06.1.454.CMB.1.raw
  modified_base (231)..(231): a, c, t, g, unknown or other
  misc_feature (231)..(231): n is a, c, g, or t
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
  modified_base (514)..(514): a, c, t, g, unknown or other
  misc_feature (514)..(514): n is a, c, g, or t
  modified_base (522)..(526): a, c, t, g, unknown or other
  misc_feature (522)..(526): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgtttgatgattataagtctgtctcctggtaccaacaacacccggnaaagctaccaaatcatgaatttangatgtacaataatcggcctcaggtgtttcncatcgcttctctgcctcatgtctggcaacgcgcctcctagaccatctcgtggactcaggctaggaggacgagggtcaacggccctaagggccttcgacccccttcggtccaaccttccgtccgttcccccgcccttcctacactaccacgttcgacttaggaggcggctggacaggcnctagacgnnnnn

SEQ ID NO: 217659 - DNA, 523 bp, Homo sapiens
  misc_feature: GYAE6OF01DU42V.34.28.C06.1.454.CMB.1.raw
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggcaaaacgctacccaaactcatgatttatgatgtcaataatcggcctcaggttgtttctcatcgcttctctcgcctcatgtctggcaacaccggcctcctgaccatctctgactccagctgaggacggaggtgtattattacgtgccgcctcatatactattcactcgccactctcgtatgtgtacgtttcggacggacggtaaccaaacctccacccgttccttcgtacacgcccgaggtcccg

SEQ ID NO: 217660 - DNA, 512 bp, Homo sapiens
  misc_feature: GYAE6OF01DQ9J5.34.28.C06.1.454.CMB.1.raw
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggcaaagctcccaaactcatgatttatgatgtcaataatcgcctnagtntttcncatcgcttctctgcctcatgtctggacaacacggcctccctgaccatctctgactccaggctaggaggacgaggtgtattattactgcgcctcatatactattcactcgccactctcgatgtgtagtttcggcggtagggacctaaacgtcacccgttccttcgtcacgcccgaggtcccg

SEQ ID NO: 217661 - DNA, 522 bp, Homo sapiens
  misc_feature: GYAE6OF01B8OBB.34.28.C06.1.454.CMB.1.raw
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggcaaagctcccaaactcatgatttatgatgtacaataatcggccctcaggtgtttcncatcgtcttctctgcctccatgtctggcaacncggcctcctgaccatctctcggactccaggctgacggacgagggttgtattattattgctagctcacatacaacctattaacacttctggtttcggcggtaggacctaagtcgacgtcctacgtcgagcccgaacgctcgcccctcgtcctaccg

SEQ ID NO: 217662 - DNA, 516 bp, Homo sapiens
  misc_feature: GYAE6OF01DHLWJ.34.28.C06.1.454.CMB.1.raw
  modified_base (248)..(248): a, c, t, g, unknown or other
  misc_feature (248)..(248): n is a, c, g, or t
  modified_base (462)..(462): a, c, t, g, unknown or other
  misc_feature (462)..(462): n is a, c, g, or t
  modified_base (493)..(493): a, c, t, g, unknown or other
  misc_feature (493)..(493): n is a, c, g, or t
  modified_base (514)..(516): a, c, t, g, unknown or other
  misc_feature (514)..(516): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattanaagtctgtctcctggtaccaacaacacccggcaaagctcccaaactcatgatttatgatgtacaataatccggccctcgaggttgtttctcatcgcttctctgcctcatgtctggcaacacggcctccctgaccatcctctggacctccgaggctggacggacgagggtccacgcccaaggcctcgcccccgtcggtccactcctcgttccccnccctcctcactcacgtgtacgtgacggcggntcggcaacgggcgacatagcnnn

SEQ ID NO: 217663 - DNA, 536 bp, Homo sapiens
  misc_feature: GYAE6OF01AMJQQ.34.28.C06.1.454.CMB.1.raw
  modified_base (280)..(280): a, c, t, g, unknown or other
  misc_feature (280)..(280): n is a, c, g, or t
  modified_base (351)..(351): a, c, t, g, unknown or other
  misc_feature (351)..(351): n is a, c, g, or t
  modified_base (440)..(440): a, c, t, g, unknown or other
  misc_feature (440)..(440): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggnaaagctcccaaactcatgatttatgatgtacaataactcggccctcgacggggtccctgaccgtattttcngcctcaagtctggcacctcacgtccctccctggactattattcggacctccagcctgacggatgaggctgatttattactgtcagtcanatcgacacaccgtgggcgggttctcgggcggagggaccagcgtgaccgtctcagtcacgcccgaaggtcctcgacccccgtcggtcctcgttcccg

SEQ ID NO: 217664 - DNA, 542 bp, Homo sapiens
  misc_feature: GYAE6OF01B8JJ2.34.28.C06.1.454.CMB.1.raw
  modified_base (249)..(249): a, c, t, g, unknown or other
  misc_feature (249)..(249): n is a, c, g, or t
  modified_base (282)..(282): a, c, t, g, unknown or other
  misc_feature (282)..(282): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgtttgatgattanaagtctgtctcctggtaccaacaacacccgganaaagctacccaaactcatgatttangatgtcaatatcgcctnaggtntttcnatcgtcttctctcgcctcatgtctggaccaacnccggccctccctgaccactctctcggactccagctgaggacgagggtgtattatactgcgtcctcatatactattcactcgacctactctcgtatgtagttacgtttcgggacggtacgggtaacccaaaccgtcctaacccggttccttaccgtaccacgcccgaacggtcccg

SEQ ID NO: 217665 - DNA, 521 bp, Homo sapiens
  misc_feature: GYAE6OF01EA99N.34.28.C06.1.454.CMB.1.raw
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggnaaagctcccaaactcatgatttangatgtcaataatcgcctnaggttgttctcatcgcttctctgcctcatgtctggcacacggcctcctgaccatctctgactcagctgaggacgaggtgtattattactgcgcctcatatactattcactgcctactctcgtatgtgtacgttttcgggacgggtacggtaaccctaaaccgtcacccgttcccttacgtcacgtcccgaacggtcccg

SEQ ID NO: 217666 - DNA, 563 bp, Homo sapiens
  misc_feature: GYAE6OF01CI8M0.34.28.C06.1.454.CMB.1.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (304)..(305): a, c, t, g, unknown or other
  misc_feature (304)..(305): n is a, c, g, or t
  modified_base (553)..(553): a, c, t, g, unknown or other
  misc_feature (553)..(553): n is a, c, g, or t
  modified_base (559)..(563): a, c, t, g, unknown or other
  misc_feature (559)..(563): n is a, c, g, or t
tcagtacacgtgatcacgaccggtgctcgatttagagctcacgtattgggtttggggggggtctcgaggaggcgaggcgctctcgggacgtctcccacatggcctgggctctgctattcctcaccctcctcactcagggcacagggtcctgggcccagtctgccctgactcaggctgcctcgtgtctgggtctcctggacagtcgatcaccatctcctgcactgtaaccggnagtgacgtttgatgattanaagtctgtctctgtaccaacaacacccgcaaagcctccaaatcaatgatttannatgtactaaataactccggacccttcgaggttgtttactctatcgtcttctctcgcccttcattgtctaggaccaaccgaccggtccctcccgtgaccctattcctcgtacggtacctcccgagcgtagacgggtacgacgggtcacgccaaggcctcgcccccgttcggtcctaccttccgtccgttccccgtccctcccgtctacgtcctacgttcgtaccgtgacggtcggctcggacgaggcgnagtagnnnnn

SEQ ID NO: 217667 - DNA, 531 bp, Homo sapiens
  misc_feature: GYAE6OF01DJMTS.34.28.C06.1.454.CMB.1.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggcagtgacgttgatgattanaagtctgtctcctggtaccaacaacacccggcaaagctccaaactcatgatttangatgtcaatatcggcctcaggtgtttctcatcgtcttctctgcctccatgtctggcaacacggcctcctgacctatctctcgacctccacggctagacggacgagggtcgtaattattactgcgcctctatatactatcactcgaccactctacgtatgtgtagtttcggacgggtacggaccaaaccgtccgtacccgttccttacgtacaccgcccgtaggtcccg

SEQ ID NO: 217668 - DNA, 518 bp, Homo sapiens
  misc_feature: GYAE6OF01DFQYU.34.28.C06.1.454.CMB.1.raw
  modified_base (247)..(247): a, c, t, g, unknown or other
  misc_feature (247)..(247): n is a, c, g, or t
  modified_base (279)..(279): a, c, t, g, unknown or other
  misc_feature (279)..(279): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccgcagtgacgttgatgattanaagtctgtctcctggtaccaacaacacccggnaaagctccaaactcatgatttatgatgtcaataatcggccctcaggtgtttctcatcgcttctctgcctcatgtctggcaacacggtccttcctgaccatctctgactccaggctgaggacgagggtgattattacgtgcgcctcaatactactacttcactgcctactctcgatgtgtacgtttcggacggacgggaccaaacgtcgaccgttccttacgtcacgcccgaaggtcccg

SEQ ID NO: 217669 - DNA, 663 bp, Homo sapiens
  misc_feature: GYAE6OF01ADLEP.34.28.C06.1.454.CMB.1.raw
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatcctcctgcactgtaaccggcagtgacgttgatgattataagtctgtctcctggtaccaacaccacccggacaaacgcctacccaaactcatgtatttatgatgtacaaataactccggcccttcgtaggttcgtttctctactccgtctttcctctcgcccttccattcgtctcgggaccaaaccgtaccgggtcccttccccgtacgaacccctacttccttcgtacgggaccctcccgacggtcgtacgggaacgggaccgggtaggggttagtaactttagtttaccgtcggtccgtcccttactaattaactacctactttaccacctcgtaccctactccgttaccgagttcggtagtttacggtttccgggaccgggtaacgggtaaccctaaaccgttcccgtaacccgtttccttccgtacccgacgccccgtaaggtccccgg

SEQ ID NO: 217670 - DNA, 678 bp, Homo sapiens
  misc_feature: GYAE6OF01AVG9W.34.28.C06.1.454.CMB.1.raw
  modified_base (212)..(212): a, c, t, g, unknown or other
  misc_feature (212)..(212): n is a, c, g, or t
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccaggtctgccctgactcaggctgcctccgtgtctgggtctcctggacagtcgatcaccntctcctgcactgtaaccggcagtgacgttgatgattatagtctgtctctgtaccaacacacccganaaagcctaccaactcatgatttangatgtacaataacgtccggtaccctgtagggttctttcctctacttccgctttctctcgccctctatcgtcgtacggacctaaacccgccggtcccctccctacgaccctacgttcctccgtcgggtaccctacccgtacgggtccgttaggggaacgggtacggtacgggttacgtaattttacgttaccgtcggccgtaccctacgtaacttaacctactactttaccgacttccgacccttactcgtacgtacgttgttacggtttacggtttccgggacgggtaaccggtaaacccttaaacccgtcccgttaaaccccggttcccggtttacccgtaccgtaacccggtaccccggtaaccggttcccccg

SEQ ID NO: 217671 - DNA, 532 bp, Homo sapiens
  misc_feature: GYAE6OF01ANO8C.34.28.C06.1.454.CMB.1.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggcaaagctcccaaactcatgatttangatgtcaataatcgccctnaggtgtttctcatcgcttctctgcctcatgtctgacacacggcctcctgaccatctctcgactccgaggtctgaggacggaggtgtattattactgcgtccgtcactatactacttacactcgcctactctcgtatggtgtacgttttcggcggacgggaacctaaaccgtccgtacccgttccttcgtaccacgcccgtaaggtcccg

SEQ ID NO: 217672 - DNA, 703 bp, Homo sapiens
  misc_feature: GYAE6OF01DJ4OV.34.28.C06.1.454.CMB.1.raw
  modified_base (230)..(230): a, c, t, g, unknown or other
  misc_feature (230)..(230): n is a, c, g, or t
  modified_base (694)..(694): a, c, t, g, unknown or other
  misc_feature (694)..(694): n is a, c, g, or t
  modified_base (700)..(700): a, c, t, g, unknown or other
  misc_feature (700)..(700): n is a, c, g, or t
  modified_base (703)..(703): a, c, t, g, unknown or other
  misc_feature (703)..(703): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattataagtctgtctcctggtaaccaacaaccacccggacaaacgcctacccaaaactcatgtatttatgatgtacaaataactccggccctgtacggttgtttcctctacgtcgtctttctctcgccctactattcgtcgtggacctaaccgaccggtcccttccctacgtaaccctacttccgttaccgttacggtaaccttcccgaacggtccgtacgggaacgggaacgggtacggggttaccgaaccggtaccccgaaacgggtcccgttacccggtccccccgttaccgggtaccctaacccgtttcccgtttaccccgtttaccccccgtaacccccgttccccttacccgtaaccgttcccgtaaccggtttccggttaacccgtacgggtaccgggtccggggtcgtacgggtccggaaacgggccgaaccgtagttaacgnacgtcngtn

SEQ ID NO: 217673 - DNA, 576 bp, Homo sapiens
  misc_feature: GYAE6OF01CTOMS.34.28.C06.1.454.CMB.1.raw
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
tcagtacacgtgatcacgaccggtgctcgatttagagctcacgtattgggtttggagggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctaggtaaccaacaaccaccccggacaaacgcctacccaaaactcatgtatttangatgtacaataatccggcctctaggttctttcnctatcgctttctctcgtcctcctatcgtctcgggaccaaaccgccggtccctccctgacctatcctcgtcggacctccgaggtccgtggacgggacggagggtatattattactgccgcctacaatactactacttcacttcgcctactctacgtattcgtagtacggtttcgggacggtacggtaccaaacctccgtacccgttcttaccgacgtccgcccgtaacgg

SEQ ID NO: 217674 - DNA, 533 bp, Homo sapiens
  misc_feature: GYAE6OF01B4FXI.34.28.C06.1.454.CMB.1.raw
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggcaaagctccccaaaactcatgatttatgatgtcaataatcggccctcgaggtgtttctcatcgcttctctgcctccatgtctggacaacacggcctcctgaccatctctgactccagctgaggacgagggtgtagttattactcgcgcctcatatactattcactcgcctactctcgtatgtagtacgttttcggaggtacgggtaacctaaactccgacccgttcccgttcgtaccacgcccgtaaggtcccg

SEQ ID NO: 217675 - DNA, 565 bp, Homo sapiens
  misc_feature: GYAE6OF01B5KQ7.34.28.C06.1.454.CMB.1.raw
  modified_base (249)..(249): a, c, t, g, unknown or other
  misc_feature (249)..(249): n is a, c, g, or t
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (377)..(377): a, c, t, g, unknown or other
  misc_feature (377)..(377): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattanaagtctgtctcctggtaccaacaaccacccggnaaacgcctacccaaactcatgtatttangatgtacaataatccggccctctaggttgtttctcatcgtcttctctcgcctccatgtctggcaacnccgccctccctgacctatcctcgtcggacctccgaggctaggacggacggaggtagtatttattactcgctcctcattatacattaccactcgcctactcgtacgtattcgtgttacggttttcgggacgggacggtaaccctaacctccgtacccgttccttccgtacaccgtacccgaacggtccc

SEQ ID NO: 217676 - DNA, 532 bp, Homo sapiens
  misc_feature: GYAE6OF01CUKOR.34.28.C06.1.454.CMB.1.raw
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctccgtggacagtcgattaccatctcctgcactggaaccagcagtgacgttggcattatgactatgtctcctggtaccaacattaccagacaaacgccccaaactcattatttatgatgtcgctagtcggcctcaggggtttctaatcgcttctctgctcaagtctgcaacacggcctccctgacatctctggctcaggctgaggacgaggctagattattattgctagctcaacactaacaaacctattaacacttcgttggtttcggcggacggtactaagtcgaccgtccgtacgtcacgcccaggcctcgtccccctcggtccactcgtccgttccccg

SEQ ID NO: 217677 - DNA, 613 bp, Homo sapiens
  misc_feature: GYAE6OF01EG5B9.34.28.C06.1.454.CMB.1.raw
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattatagtctgtctctgtaccaacaacacccggnaaagctaccaaactcatgatttangatgacaataatcggccctgaggttntttctcattcgctttctcttcgcctccattgtcctggaccaaccgaccggtccctccccgtagaccctacttcctcgtcggacctcccgaggtcgtaggaacgggacgggtagggtagtaatttaacgttaccgttcgccgtacctacgtaattaactaactattacctacttacgaccctactccgtacgtagttcgtagttacgttttccgggacgggtaacgggtaaccctaaaccgtccaaccccgttccgttaccgtaccacggtacccgaacggtccccg

SEQ ID NO: 217678 - DNA, 555 bp, Homo sapiens
  misc_feature: GYAE6OF01E2HHJ.34.28.C06.1.454.CMB.1.raw
  modified_base (281)..(281): a, c, t, g, unknown or other
  misc_feature (281)..(281): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (444)..(444): a, c, t, g, unknown or other
  misc_feature (444)..(444): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaaccacccggnaaacgcctacccaaactcatgatttatgatgtacaataactcggccctnaggttnttcnctatcgcttctctcgcctcatgtctggcaacgcggccctccctgaccatctctcggtacctccgaggctggacggacggtagggtgtattattactgcgtcctnatatactacttacactcgcctactctcgtattgtcgttagtttccgggacgggaacggtaccctaaacgtccctacccgttccttacgtaccacgtacccgaacggtcccg

SEQ ID NO: 217679 - DNA, 623 bp, Homo sapiens
  misc_feature: GYAE6OF01BWIE8.34.28.C06.1.454.CMB.1.raw
  modified_base (228)..(228): a, c, t, g, unknown or other
  misc_feature (228)..(228): n is a, c, g, or t
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcacatctctgcactacgtaccgnagtgtacgttgatgtattatagtctgtcctcgtacgtaaccaacaaccgacccgganaaacgtcctaaccaaatcatgtaatttagngtatntacaatacgtccggtaccctagtagttcgtttcacgtagtcgtcctttctacgtcgtcctactagttcgtcgtacgaccaaaccgtccgtccctaccgtacgacctacttcctcgtcgtacctaccgacggtcgtaggaacgggacggtaggttactaatttacgtacgtcgtccgtcctataacttaacttactacttccactacgcctactctgtagttggtacgttcgtttcgggacggaacgtaaacctaccgtacctacccgtttccgtacgtaccgaacccgtccggaacgtccccg

SEQ ID NO: 217680 - DNA, 629 bp, Homo sapiens
  misc_feature: GYAE6OF01CIQ2C.34.28.C06.1.454.CMB.1.raw
  modified_base (281)..(281): a, c, t, g, unknown or other
  misc_feature (281)..(281): n is a, c, g, or t
  modified_base (331)..(331): a, c, t, g, unknown or other
  misc_feature (331)..(331): n is a, c, g, or t
  modified_base (621)..(621): a, c, t, g, unknown or other
  misc_feature (621)..(621): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
tcagtacacgtgatcacgaccggtgctcgatttagagctcacgtattgggtttggggggggtctcaggaggcagcgctctcgggacgtctccaccatggcctggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaaccacccgganaaacgcctacccaaactcatgatttatgatgtacaaataactcggccctnaggttgtttctcactcgtcttctctcgccctcatgtctgacaacgaccggcctccctgacctattcctcgtcggacctccagggctaggacggtaccgacgggtacacggtacccgaacgggtccgtacccgtccccccgttacggtccctaaccgttcccgttaccggtttacccccctaacccccgtttccctaccgtaccttcccgtaacggttaccgtaccgttcgggacgggtcccggggtccgtaccggggtaccgaaacgggtcccgaacgtaacgttaaggntcngngtc

SEQ ID NO: 217681 - DNA, 570 bp, Homo sapiens
  misc_feature: GYAE6OF01EJ64D.34.28.C06.1.454.CMB.1.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacngtcgatcaccatctcctgcactgtaaccgcagtgacgttgatgattataagtctgtctcctggtaccaacaaccacccggacaaaagcctaccaaactcatgatttangatgtacaataatcggaccctcaggttcgtttctcatcgtcttctctgcctccatcgtctggactaacgaccggtcctccctagacctacttctctcggaccttccaggctaggacgggacggagggtcacgacccgaacggtcctacgtcccccgtcggtcctaccgttcctccgttccccgtcccttcctcctactcgaccggttcgtacgtcggtacggccgggtctcgggccgaacgggccgacgtatagcngngngn

SEQ ID NO: 217682 - DNA, 606 bp, Homo sapiens
  misc_feature: GYAE6OF01BUZJB.34.28.C06.1.454.CMB.1.raw
  modified_base (309)..(309): a, c, t, g, unknown or other
  misc_feature (309)..(309): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcacgtgtaaccggcagtcgacgttgatgattataagtctgtctcctggtaccaacaacacccggcaaagcctacccaaactcatgatttangatgtacaataactcggccctcgaggttgtttctcatcgtcttctctcgtcctcatgtcgtcgacaactaccggcccttccgtcgacctattcctcgtcggtacctccgaggtcgtggacggacggtagggtctagtttacgttacgtcgcgtcctacgtatactactattccacttcgacctaccttcgtcgtatggttacgttacgtttccgggacgggtaaccgggtaaccctaaaccgtcccgttaaccccgtttccgttaccgtacccaacggtccccgaaacgggtccccg

SEQ ID NO: 217683 - DNA, 671 bp, Homo sapiens
  misc_feature: GYAE6OF01B4HSQ.34.28.C06.1.454.CMB.1.raw
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (348)..(348): a, c, t, g, unknown or other
  misc_feature (348)..(348): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctgccctgactcaggctgcctccgtgtctgggtctcctggacagtcgatcacatctcctgcatgtaaccggcagtgacgttgatgtaattatagtctgttcctcgtaggtaaccaaacaccgacccgganaaacgcctaccaaatcatgtatttangtatgtacaatacncggccctgtagttcgttacnctagtcgtcttctctcgtaccctcattcgtcgtaggacctaaaccggcccggtcccttcccgtacgtaaccgtacttccgtccgtacggtacccttaccggacggtcgtacggacgggtacgggtaagggtgttaactttacgttaccgtcggactacctactaagtaacttacctacttccgtaacctcgtacctaccgttcgtcgtaacgtttcggttagttacccgggtttcgggaacgggtaaccggttaaaccccgaaccgttcccggtaccccgtttaccgtacccgtaccggtaaccgcccggtaaccgtccccgg

SEQ ID NO: 217684 - DNA, 685 bp, Homo sapiens
  misc_feature: GYAE6OF01BJNMM.34.28.C06.1.454.CMB.1.raw
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctctggtaccaacaacacccggnaaagctaccaaactcatgatttangatgtacaataactcggccctnaggttgtttcncatcgtcttctctcgcctccattcgtctggacaacgaccggcccttcccgtgaccctattcctacgtcggtacctcccgagggtcctagggaacgggtaccgggtaggggttataacgttttaacgtttaccgtcggtccgtacccttacgtaacttaacttaaccttacgttttacccgaccgtttaccggacccctactttcccgtacgtaagtttcggttacggtttaccggtttttacccgggggaacggggtaaaccggggtaaacccctaaaaacccggttccccgtaaacccggtttccccttaccggttacccacccgggtaccccgtaacgggtcccccg

SEQ ID NO: 217685 - DNA, 617 bp, Homo sapiens
  misc_feature: GYAE6OF01EV6QZ.34.28.C06.1.454.CMB.1.raw
  modified_base (612)..(612): a, c, t, g, unknown or other
  misc_feature (612)..(612): n is a, c, g, or t
  modified_base (615)..(617): a, c, t, g, unknown or other
  misc_feature (615)..(617): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggcagtgacgttgatgattataagtctgtctcctgtaccaacaaccacccggacaaagcctaccaaactcatgtatttatgatgtactaaattaacgtccgtcctcgtaggttcgtttctctacgttcgtctttctcttcgcctcctagtcgtctcgggacaaccgaccggtccctccctacgacctacttcctcgtcggacctccgacggcgtaggacgggacggtacgggtccgaaccggacccgaacggtcccgtccccgtacccccgttccgtacccttaccgttcccgttcccgggttccccctccccttccgtcctacgtcccgtaacgttcgttaacgtggacgggccgggtacgtcggaccgacggcaccgtgtacgncgnnn

SEQ ID NO: 217686 - DNA, 511 bp, Homo sapiens
  misc_feature: GYAE6OF01BHJZP.34.28.C06.1.454.CMB.1.raw
  modified_base (248)..(248): a, c, t, g, unknown or other
  misc_feature (248)..(248): n is a, c, g, or t
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattanaagtctgtctcctggtaccaacaacacccggnaaagctcccaaactcatgatttangatgtacaataatccggccctcgaggtgtttcncatcgcttctctgcctcatgtctggcaacgcgcctcctgaccatctctcgactcagctagacggacgaggtgtattattacgtgcgcctcatactactattcactcgccactctcgatgtgtagtttcggaggacggaccaactcgaccgttcttcgacacgcccgaggtcccg

SEQ ID NO: 217687 - DNA, 624 bp, Homo sapiens
  misc_feature: GYAE6OF01ALA0U.34.28.C06.1.454.CMB.1.raw
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcacatctcctgcactgtaaccggcagtgacgttgatgtattatagtctgtctcctggtaccaacaaccacccggacaaacgcctacccaaactcatacgtatttangtatgtacaataactccggcccttagacgggttntttctctatccgtcttctctcgcctcatcgtctcgactaaccgaccggtcctccctcgacctatcctcgtcgactcccgagcgtaggacggacgggtaggtgtaatttacgtacgtcgcgtccttacaattactactacgttacctacgttcgacctaccgtctcgtagttcggttaggttacggtttccgggaccggggtaacggtaacccgtaaaccgtccccgttacccgtttccccgttacggtaccctacgggtaccccgtaagggttcccccg

SEQ ID NO: 217688 - DNA, 545 bp, Homo sapiens
  misc_feature: GYAE6OF01ET5FT.34.28.C06.1.454.CMB.1.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
  modified_base (371)..(371): a, c, t, g, unknown or other
  misc_feature (371)..(371): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctctggacagtcgatcaccatctcctgcactgtaaccgnagtgacgttgatgattanagtctgtctcctgtaaccaacaaccacccggnaaagctcccaaactcatgatttangatgtacaatactcgccctnaggttnttctcatcgcttctctgcctcatgtctggccacacgccctccngaccatctctgactcgagctgaggacgaggtagtattattactcgctctcaatactactattactactcgacctactctcgtattcggtagttacgttttcgggacgggtacgggtaacccaaaccgttcccgtacccgttcccgttacgtaccaccggtacccgacggtcccg

SEQ ID NO: 217689 - DNA, 545 bp, Homo sapiens
  misc_feature: GYAE6OF01BF4XB.34.28.C06.1.454.CMB.1.raw
  modified_base (247)..(247): a, c, t, g, unknown or other
  misc_feature (247)..(247): n is a, c, g, or t
  modified_base (300)..(300): a, c, t, g, unknown or other
  misc_feature (300)..(300): n is a, c, g, or t
  modified_base (383)..(383): a, c, t, g, unknown or other
  misc_feature (383)..(383): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggcagtgacgttgatgattanagtctgtctctgtaccaacaacacccggcaaagctacccaaatcatgatttangatgtacaataactcggccctgaggttgtttctcatccgtcttctctcgcctccatgtctggacaacacggtcctcctgaccntctctgactcaggctagacggacggaggtagtattagtacgtcgcgtcctatactaactactattacacttcgccctactccgtgtatgttacgttacgtttcggacgggacgggtacctaaaccgtctaccgtccttcgtaccgacgccgtaacggtcccg

SEQ ID NO: 217690 - DNA, 606 bp, Homo sapiens
  misc_feature: GYAE6OF01C3KDW.34.28.C06.1.454.CMB.1.raw
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (347)..(347): a, c, t, g, unknown or other
  misc_feature (347)..(347): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggcagtgacgttgatgattanaagtctgtctcctggtaacccaacaaccacccgganaaacgcctacccaaactcaatgtatttatgatgtacaataacgtccggccctgaggttctttcnctactcgtcttctcgtcgtccctactatcgtctcggaccaaaccgtccggtccctccctgaccctatcctcgtcggacctcgaggtctacgggacggacggtagggtccacgacccgaagggtccctccggccccccttcgggtaccctccgttaccgttcccgttacccccacccttccctacctactccgtaacgttcgtaccgtggacgggccgggtcgtacgggtaccgaacggccgacgtacgtacgncngngn

SEQ ID NO: 217691 - DNA, 519 bp, Homo sapiens
  misc_feature: GYAE6OF01EKEZ5.34.28.C06.1.454.CMB.1.raw
  modified_base (327)..(327): a, c, t, g, unknown or other
  misc_feature (327)..(327): n is a, c, g, or t
  modified_base (514)..(519): a, c, t, g, unknown or other
  misc_feature (514)..(519): n is a, c, g, or t
tcagtacacgtgatcacgaccggtgctcgatttagagctcacgtattgggtttggggggggtcgtcaggaggcagcgctctcgggacgtctccaccatggcctggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattattaagtctgtctcctggtaccaacaacaccccggcaaagctccccaaactcatgatttatgatgtcaataatcggccctnaggtgtttctcatcgcttctctgcctcatgtctggcaacacggcctccctgacccatctctggactccaggctgaggacgagggtccacgcccgaacggctcgccccgtccggccacgtcctcgttcccgtccctccctcgactcaccgttgtacctgacggcgggtcctggccgaaggcgctacgnnnnnn

SEQ ID NO: 217692 - DNA, 608 bp, Homo sapiens
  misc_feature: GYAE6OF01CDVKC.34.28.C06.1.454.CMB.1.raw
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacgagggtcctgggcccagtctgccctgactcaggctgcctccgtgtctgggtctcctggacagtcgatcaccatctcctgcactggtaaaccggnagtgacgttgatgattataagtctgtctctggtaaccaaacaaccacccgganaaaacgcctacccaaaactcatgattangatgtacaaataatccggcctacgaggttcgtttaccnctactcgtccttctctcgtcctacattcgtcgtcgaccaaacgccggtccctcccgtacgacctactctcgtcggtacctcgacggtcgtaggaggacggagggtacgtaagttattactgcgtcctactataactactactacactcgaccactctagtacgtgttacgttacgtttccgggacgggtaacggtaaccctaaaccgtaccgtacccgttccgttacgtacccgacgtacccgtaacggtccccgg

SEQ ID NO: 217693 - DNA, 782 bp, Homo sapiens
  misc_feature: GYAE6OF01BMR3V.34.28.C06.1.454.CMB.1.raw
  modified_base (220)..(220): a, c, t, g, unknown or other
  misc_feature (220)..(220): n is a, c, g, or t
  modified_base (259)..(259): a, c, t, g, unknown or other
  misc_feature (259)..(259): n is a, c, g, or t
  modified_base (324)..(324): a, c, t, g, unknown or other
  misc_feature (324)..(324): n is a, c, g, or t
  modified_base (361)..(361): a, c, t, g, unknown or other
  misc_feature (361)..(361): n is a, c, g, or t
tcagtacacgtgatcacgaccggtgctcgatttagagctcacgtattgggtttggggggggtctcaggaggcagcgctctcgggacgtcctccaccagtcggccgtggctctgcttacttccctccaccctcctcactcgagggcacgacgggtccgtcgggcccagtctcgccctgacctcgaggctcgtccctcgtgtcgtcgggtcctccgtggacngtcgactccaccatcctcctgcctacgtacggtaaccgngtagtgtacgtgatgtaattaatagtctcgtcctccgtacgaaccaaacgaacccgacccggaanaaaccgccctaacccaaactctagtagttaacttagngtatgtaacaaataccgtccgtaccctagtagtttcttacctactacgtccgttcttctccgtccgtccctactagttccgtacgtacgaaccctaaacccgcccgtccccttacccgacgtaccctacttcccgttaccgtacgtacccgtaccgtaacgggtcgtaacgggaacggtaacgggtacgggttattaacgtttacgtaccgtacgtccgtacctacgtaactaacttaaccgttacttaccgtaaccttcccgtacccttacgttcccgtacgttacgtttaggttacggtttaacgggtttcccgggaaaccgggttaacccggtaaacccttaaacccggttaccccgttaccccgtttacccgttacccggtaaccgaacccggtaccccggtacgggttaccccccg

SEQ ID NO: 217694 - DNA, 677 bp, Homo sapiens
  misc_feature: GYAE6OF01DXSGQ.34.28.C06.1.454.CMB.1.raw
  modified_base (229)..(229): a, c, t, g, unknown or other
  misc_feature (229)..(229): n is a, c, g, or t
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (670)..(670): a, c, t, g, unknown or other
  misc_feature (670)..(670): n is a, c, g, or t
  modified_base (673)..(673): a, c, t, g, unknown or other
  misc_feature (673)..(673): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggnagtgacgttgatgaattataagtctgtctcctaggtaaccaacaaccacccgganaaaacgcctacccaaactcatagatttangatgtanaactaatcggccctgtaggttntttcncatcgtcttctctcgaccctcattcgtactcggaccaacgtacccgggtccctacccgtagaccctactcctacgtcgggaaccttcccgaaggtccgttagggaacgggtacgggtaacgggtaccaacgacccgtaacgggtccttaccccggtccccccgttagggtaccctaccgttacccggtttcccgttacccccgtccccctttccctaccttacgttacccgttaaccggttacggttaaccggtacgggtaaccgggtccgggtaccgtcggggtaaccgaaaaccgggtccggaaccttaagaacggacacncgngtcg

SEQ ID NO: 217695 - DNA, 549 bp, Homo sapiens
  misc_feature: GYAE6OF01EC351.34.28.C06.1.454.CMB.1.raw
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctctggacagtcgatcaccatctcctgcatgtaaccgnagtgacgttgatgattataagtctgtctcctggtaccaacaacacccggnaaacgctacccaaatcatgatttangatgtacaataactcggccctgaggttntttcncatcgctttctctgcctccattgtctggaccaacacggtccctccgngaccatcctctgactccgngcgtgaggacgagggtgtattattacgtcgcgtcctactagtaactactacttactactcgacactctcgagttcgtgtagttttcggacgggaacggtaacccaaaccgtcctacccgttccttaccgtaccacgcccgaggtcccg

SEQ ID NO: 217696 - DNA, 618 bp, Homo sapiens
  misc_feature: GYAE6OF01ELHDF.34.28.C06.1.454.CMB.1.raw
  modified_base (230)..(230): a, c, t, g, unknown or other
  misc_feature (230)..(230): n is a, c, g, or t
  modified_base (281)..(281): a, c, t, g, unknown or other
  misc_feature (281)..(281): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (445)..(445): a, c, t, g, unknown or other
  misc_feature (445)..(445): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattataagtctgtctcctaggtaccaacaacacccggnaaacgctacccaaactcatgtatttatgatgtacaataatcggcccttnaggttntttctcatcgtctttctctcgcctccattgtctgggcctaaacgaccggtccctcccgtgacctattcctcgtcggacctccgacggctagggacggacggtagggttntaatttacgttactcggtccgtccgtactaattaactaactactttaccaaccgttcgaccccgtacttccgtacgtattggttcggttacgttttcggggacgggaacgggtaaccctaaaccgtcccgtaacccggttcctttacgtaccgacggtccccgaaggtccccg

SEQ ID NO: 217697 - DNA, 526 bp, Homo sapiens
  misc_feature: GYAE6OF01DPPIT.34.28.C06.1.454.CMB.1.raw
  modified_base (199)..(199): a, c, t, g, unknown or other
  misc_feature (199)..(199): n is a, c, g, or t
  modified_base (248)..(248): a, c, t, g, unknown or other
  misc_feature (248)..(248): n is a, c, g, or t
  modified_base (325)..(325): a, c, t, g, unknown or other
  misc_feature (325)..(325): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacngtcgatcaccatctcctgcactgtaaccggcagtgacgttgatgattanaagtctgtctcctggtaccaacaacacccggcaaagctcccaaactcatgatttatgatgtacaataatcggccctnaggttgtttctcatcgtcttctctgcctcatcgtctggcaacacggcctccctgaccatcctcgtcgactccgagctgacggacggagggtgtagttacttactcgcgtcctcatactactattcactcgccactctcgatgtgtacgtttcggcggacggaccaaacgtcacccgttccttcgtacacgccgacgtcccg

SEQ ID NO: 217698 - DNA, 622 bp, Homo sapiens
  misc_feature: GYAE6OF01EJR3E.34.28.C06.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacgagggtcctgggcccaatctgccctgactcagcctgcctccgtgtctgggtctcctggacagtcgattaccatctcctgcactggaaccngcagtgacgttggtcattangactatgtctcctggtaccaacattaccaggacaaacgccccaaactcattattatgatgtcgctagtcgcctcgtagggtttctaatcgtcttctctggtctcaagtctggacaacgacgcctccctgaccactctctgggcctccaggccttaggacggacgaggctagatttattagttgaccagtcctacactaactaactaaacctacgttaaacctactttacgtttcgggttttaccggacgggtaacgggtaacccgtaaggtttccgaacccggttcccgtaaccggtacgaaccggtacccgaacgggtccctcccgggtcccccctcgggtaccctaccgttccgttcccggttccccccg

SEQ ID NO: 217699 - DNA, 569 bp, Homo sapiens
  misc_feature: GYAE6OF01ARA56.34.28.C06.1.454.CMB.1.raw
  modified_base (307)..(307): a, c, t, g, unknown or other
  misc_feature (307)..(307): n is a, c, g, or t
  modified_base (480)..(480): a, c, t, g, unknown or other
  misc_feature (480)..(480): n is a, c, g, or t
  modified_base (492)..(492): a, c, t, g, unknown or other
  misc_feature (492)..(492): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatcctcctgcactgtaaccggcagtgacgttgatgattataagtctgtctcctggtaccaacacacccggacaaagcctacccaaactcatgatttangatgtcaataactccggcccttcgaggttgtttcctcactcgtctttctcgtcgccctccatcgtctggaccaacgaccggccctccctgaccctactctcgtcggacctccgaggcgtggacggacgagggtgtattattactcgcgtcctactactatactacttcactcncctactctcgtntcgtgtacgtttcgggacgggacgggacctaaccgtaccgtacccgttcccgttcgtaccgacgcccgtacgtcccg

SEQ ID NO: 217700 - DNA, 589 bp, Homo sapiens
  misc_feature: GYAE6OF01BBKFP.34.28.C06.1.454.CMB.1.raw
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
  modified_base (393)..(393): a, c, t, g, unknown or other
  misc_feature (393)..(393): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatcctcctgcactgtaaccggcagtgacgttgatgattataagtctgtctctgtaccaacaacacccggnaaagctccaaactcatgatttangatgtacaataatccggccctcaggttntttctcatcgtcttctctcgcctccattgtctcggactaacgccggtccctccctgaaccctnttcctctcggactcccgaggctaggacggacgtagggtcacggaccccaaggtcctaccggtccccctcgggtcccaccgttcccgttaccgttccccctaccccttccctacctacgtacccgtacggttcgtaaccgtgggaacgggccgggtacgtcgggaccgaacgggcccgacgtaattacgancgtngc

SEQ ID NO: 217701 - DNA, 706 bp, Homo sapiens
  misc_feature: GYAE6OF01CFQHJ.34.28.C06.1.454.CMB.1.raw
  modified_base (231)..(231): a, c, t, g, unknown or other
  misc_feature (231)..(231): n is a, c, g, or t
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatcctcctgcactgtaaccggnagtgacgttgatgattataagtctgtctcctggtaaccaacaaccacccgganaaacgcctacccaaactcaatgtatttangatgtactaataactccggccctagtaggttcgtttcctctacgttccgtacctttcgtccgtcgtccctcctattcggttccgtacggaccaaaccgtcccggtccccttaccccgtacgtacccgtacttccgtccgttacggtaccttacccgacgggtccgtacgggtaacgggaccgggtaaggggttacgttaagtttaacgtttacgtcggtccgtacccgtacgtaacttaacgttaactacttaccgtaccttcgtaccctaccttacgtacgtagttcggttacgttacggttttaccgggaccgggtaaccgggtaaaccctaaaccgttacccgttacccgttaccgttaccgaccgtaccgtacccgtacggtaccccgg

SEQ ID NO: 217702 - DNA, 631 bp, Homo sapiens
  misc_feature: GYAE6OF01DFI6A.34.28.C06.1.454.CMB.1.raw
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactcgtaaccgcagtgtacgtgatgtattatagtctgtctcgtagtaccaacaccgacccganaacncctaccaactcatacgtatttagagtatgtacaaatacgtccgtacctcgtagttcgtttactctactcgtcttctctcgtcctctagtcgtccgtacgaccaaccggtacccggtccctacccgtacgtaccctatcccgttcgtacggtacctccgaggtacgtagggaacggtacgggtagggttattaagtttacttcgtcgccgtctagtaactactaactactaccactcgtacctacttccgtgtagttcggtacgttacggttaccgggacgggtaacggtaccctaaacgttcccgtacccgttcccgttaccgactacccggcccgtaaggtccccg

SEQ ID NO: 217703 - DNA, 635 bp, Homo sapiens
  misc_feature: GYAE6OF01CDENS.34.28.C06.1.454.CMB.1.raw
  modified_base (280)..(280): a, c, t, g, unknown or other
  misc_feature (280)..(280): n is a, c, g, or t
  modified_base (363)..(363): a, c, t, g, unknown or other
  misc_feature (363)..(363): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggcagtgacgttgatgattataagtctgtctctggtaccaacaaccacccgganaaacgcctacccaaactcatgtatttatgatgtacaaataacgtcgcctgtaggtcgtttctcatcgtcttctctcgcctacntgtctggacaacgcgcctcccgtgacctacttcctcgtacgtaccttccgaggtctacgggaacgggtacgggtaggggttataacgttttacgttaacgtcgtccgtacctactaaacttactaacttacttaccgtacttacggtaccctaccttccgttacgtaagttcgttacggtttacggttttccggggacgggtaaaccgggtaaccctaaaccgttccctaacccggttccttaccgaccgaccgtacccgtaaggtcccccg

SEQ ID NO: 217704 - DNA, 638 bp, Homo sapiens
  misc_feature: GYAE6OF01ESMFA.34.28.C06.1.454.CMB.1.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggnagtgacgttgatgattanagtctgtctcctggtaccaacaaccacccgganaaagctacccaaactcatgatttangatgtacaataatccggacctcgaggttntttctcatcgtcttctctcgcctctattcgtctcggaccaaacgccggtcccttcccgtacgtacctacttcctcgttacggtaccttaccgacggtcgtacgggtacgggacgggtagggtagtacgtttaacttacgtcgtaccgtcctaccgtaacttaacttaaccgtactttacgaccttacgtaccctactaccgtacgtacgttagttacgttacggttttcgggacgggtacgggtaaccctaaacgttcccgtacccgttcccgttcgtaccgaccggtacccgacggtaccccg

SEQ ID NO: 217705 - DNA, 515 bp, Homo sapiens
  misc_feature: GYAE6OF01DNBEU.34.28.C06.1.454.CMB.1.raw
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattanaagtctgtctcctggtaccaacaacacccggcaaacgctcccaaactcatgatttatgatgtcaataatcggccctcaggtgtttctcatcgcttctctgcctcatgtctggcaacacggcctccctgaccatctctggactccaggctgaggacgagggtgtattattacgtgcgctcattatactattcacttcgacctactctcgatgtgtagtttcggcggacggaccaacgtcacgttccttacgtcacgcccgaaggtccg

SEQ ID NO: 217706 - DNA, 664 bp, Homo sapiens
  misc_feature: GYAE6OF01C74XJ.34.28.C06.1.454.CMB.1.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
  modified_base (659)..(659): a, c, t, g, unknown or other
  misc_feature (659)..(659): n is a, c, g, or t
  modified_base (662)..(664): a, c, t, g, unknown or other
  misc_feature (662)..(664): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctcgccctgactcaggctgcctcgtgtctgggtctcctggacagtcgatcaccatctcctgcactgtaaccggnagtgacgttgatgtattanaagtctgtctccgtgtaaccaacaacacccgganaaacgcctacccaaactcaatcgtaatttangtatgtactaaataacgtccggtcccctgtaggttcgtttcnccgtaattcgtcctttctcctcgtaccttacctattcggttactcgggtaccaaacccgtccggtcccttaccccgtagtaaccctacgttccgtaccgttcggtaccgtacccgtacgggcgttaacgggacgggtaacgggacgggttaccgaaccggtacccgaagggtccctacccgtcccccgttacggtacctaccttcccgttcccgttaccccgcccttccgttcctacttccgtacgttacgaccgttaggacgggtccggtacgtcggtaacgaccgggacacgtaacgtggnacnnn

SEQ ID NO: 217707 - DNA, 592 bp, Homo sapiens
  misc_feature: GYAE6OF01CL3P3.34.28.C06.1.454.CMB.1.raw
  modified_base (312)..(312): a, c, t, g, unknown or other
  misc_feature (312)..(312): n is a, c, g, or t
  modified_base (587)..(587): a, c, t, g, unknown or other
  misc_feature (587)..(587): n is a, c, g, or t
  modified_base (590)..(592): a, c, t, g, unknown or other
  misc_feature (590)..(592): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaaccacccggacaaacgcctccccaaactcaatgtatttangatgtacaaataatccggccctcgaggttgtttctcacttcgcttctctcgccctcatcgtctcggaccaaaccgcggtccctccgtagacccattcctacgtcggacctcccgaggcgtaggacgggaccggagggtcacggacccgaaggtcctaccgcccccgtacggtcctaccgttccgtccgttcccccgtcccttcctacctacgtccgtacgttcggtacgtacggacggtccgggtacgtcgggacgaacgggccgacgtatacgncgnnn

SEQ ID NO: 217708 - DNA, 707 bp, Homo sapiens
  misc_feature: GYAE6OF01AMWVV.34.28.C06.1.454.CMB.1.raw
  modified_base (281)..(281): a, c, t, g, unknown or other
  misc_feature (281)..(281): n is a, c, g, or t
  modified_base (341)..(341): a, c, t, g, unknown or other
  misc_feature (341)..(341): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggnaaacgctacccaaactcatgtatttatgatgtacaataacgtccgcctctaggttcttcnctatcgtcttctcgtcgtccctacctagttcgttccgtagggtaccctaaaaccgtcccgggtacccttccccgtacggaccctacgttcctaccggtacggtaccctacccggaacgggtccgtacgggtaacggggtaccgggtaacgggttacgttaactttaacgtttaaccggtcgtaccggtacccttactaaaccgtttacttaaccgttacgttaacccgtaccgttaccgacccttaccgttccgtacgtagtttacggttacggttacggttttaccggggacgggtaaaccgggtaaccctaaaccgtcccgttaccgttcccgttacgacctaccggacccgtacgggtccccg

SEQ ID NO: 217709 - DNA, 706 bp, Homo sapiens
  misc_feature: GYAE6OF01AR8FT.34.28.C06.1.454.CMB.1.raw
  modified_base (286)..(286): a, c, t, g, unknown or other
  misc_feature (286)..(286): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatcctcctgcactcgtaaccggcagtgacgttgatgtattatagtctgtctcctggtaaccaacaaccacccgganaaacgcctaccccaaactcatagtatttatgatgtacaacttaacgtcccggacccttagtaggtttcgtttccactacgttccgtcctttcctaccgttccgtcccttccgtagttcggtcgtacggaccctaaaccgtcccggtcccctacccgtacgaccctacgttcctaccggtaccggtaccttcccggaagggtcgttacgggaacgggtaccgggtagggttacgtaacttttaacgtcgtacgtccctaccttagtaattaaccgtactacttccaacgttccgaccctacgttcgtacgtcgttggttaccggttacggtttaccgggacgggtaaccggtaaccccttaccgttacccggtacccgtttcccgtacggtaacccaccggtcccgtaaccggttcccccg

SEQ ID NO: 217710 - DNA, 754 bp, Homo sapiens
  misc_feature: GYAE6OF01EK8O4.34.28.C06.1.454.CMB.1.raw
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
tcagtacacgtgatcacgaccggtgctcgatttagagctcacgtattgggtttggggggggtctcaggaggcagcgctctcgggactctccaccatggcctgggctctgctattcctcaccctcctcactcagggcacgagggtcctgggcccagtctgccctgactcgaggctcgcctcgtgtctgggtctccgtggacagtcgatcacatctccngcactgtaaccgntagtgacgttnatgatttatagttctgtcctcgtacgtaaccaaacgaacccgaacccggacaaaacgccctaccaaacttcattacgtatttagngaattcgtaactaaacgtacgtccggcccttagtaggtttcttcactagtccgtctttcgtacttcgaccctttntacggttcgtaccgtacggaccctaaaccggtcccgtccctaccgtacgaccctacttccgtcctacggtacctaccgggtacggtacgtacgggaaaccggtacgggtacggtttacgttaacgttttaactccggtacggtaccccttacgtaacttaacttaacgtaaccttacgtttacccaaccgttccgtacccgttacctaccggttagttacggtttcggttaacggttttaaccggttacccggggtacggtaaacccgggtaaaccctttacccgtacccgttaccccggttacccgttaccggttaaccccgaaccgggttacccgacccgggttacccccg

SEQ ID NO: 217711 - DNA, 588 bp, Homo sapiens
  misc_feature: GYAE6OF01EGMJ7.34.28.C06.1.454.CMB.1.raw
  modified_base (229)..(229): a, c, t, g, unknown or other
  misc_feature (229)..(229): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (363)..(363): a, c, t, g, unknown or other
  misc_feature (363)..(363): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccgnagtgacgttgatgattataagtctgtctcctggtaccaacaacacccgganaaagcctacccaaactcatcgatttangatgtacaataatccggcctnaggttntttctcatcgcttctctcgcctcatgtcnggcacgccgcctcctgaccatctctgtacctcgaggctggaggacggagggtatattactacgtcgccgtcctactaattaacgtactattacctacctcgtaccctacgttccttacgtattcggttagttacggttttccgggacgggtaaccgggtaacctaaacccgttcccaacccgtttcccgttaccgtacccgacggtaccccgtaacggtaccccg

SEQ ID NO: 217712 - DNA, 597 bp, Homo sapiens
  misc_feature: GYAE6OF01BFOHM.34.28.C06.1.454.CMB.1.raw
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
  modified_base (593)..(594): a, c, t, g, unknown or other
  misc_feature (593)..(594): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaaccacccgganaaacgcctacccaaactcatgatttangatgtacaataatccggccctgaggttgtttctcatcgtcttctctcgtcctccattcgtctacggacctaaaccgaccggtcccttacccgtagaaccctattcctccgtacggtaccttcccgaggcgtaggaacgggacggtacgggtcacgacccgaaggccctccgccccgtggtccacttccgtccgtccccgtccctcctactactccgtacggttcgtacgtcggacggtccgggtacgtacgggaccgaacgggtccgacgtaacgtaggatcgnngta

SEQ ID NO: 217713 - DNA, 613 bp, Homo sapiens
  misc_feature: GYAE6OF01CDQRI.34.28.C06.1.454.CMB.1.raw
  modified_base (282)..(282): a, c, t, g, unknown or other
  misc_feature (282)..(282): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaaccaacaacacccgganaaacgctacccaaactcatgtatttatgatgtacaataacgtcgccctcgtaggttgtttctctatcgtcttctctcgtcctccatcgtctcggacctaacgacccggtccctacccgtacgaccctattcctcgtacggaccttccgaggcgtaggaacgggtacggacgggtaccaaccggacccgaacggtcctaccccggtccccccgttcggtaccctacccgttccttcccggttacccctaccccttaccttacgtcgtaaccggttcgtacgtacggacggtcgggtcgtcgggacgacgggtccgacgagtacgcancntgn

SEQ ID NO: 217714 - DNA, 694 bp, Homo sapiens
  misc_feature: GYAE6OF01CI6GK.34.28.C06.1.454.CMB.1.raw
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
  modified_base (368)..(368): a, c, t, g, unknown or other
  misc_feature (368)..(368): n is a, c, g, or t
  modified_base (687)..(687): a, c, t, g, unknown or other
  misc_feature (687)..(687): n is a, c, g, or t
  modified_base (691)..(692): a, c, t, g, unknown or other
  misc_feature (691)..(692): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcaggctgcctccgtgtctgggtctccgtggacagtcgatcaccatcctcctgctacgtacgtaaccggctagtgacgttgatgtattatagtctgtctcgtaggtaaccaacaaccgacccgganaaacgcctaccccaaatctatcgtatttangatgtaactaaagtacgtccggtaccctgtaggttctttaccnctacgtccgtctttcctcgtccgtacccttactacgttcgtccgacggaaccctaaaccggtcccggtccctacccgttagaaccctacgttccgttaccgtaccggtacctacccggtaacgggtacgtaacgggaacgggtacgggtaccgggtaccgaaccggacccggtaacggtcccgtaccccggtacccccggttcggtaccctaccgtttccccgttacccgttaccccctacccttcctactacgtacccgtacgttaccgtacgtacgggtccgggccggtcgacgggtaccgacggtcgacgtagagnacgnngc

SEQ ID NO: 217715 - DNA, 634 bp, Homo sapiens
  misc_feature: GYAE6OF01D8V9V.34.28.C06.1.454.CMB.1.raw
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (464)..(464): a, c, t, g, unknown or other
  misc_feature (464)..(464): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcgaggctgcctccgtgtctgggtcctccgtggacagtcgatccaccatctcctgcactagtaaccgcagtgacgttgatgattatagtctgtctcgtgtaccaacaacgaccgacaagcctaccaatcaatgtatttangatgtacaattacgtccgtcctgtaggttnttctctatccgtcttctctcgtcctctagttcgtactacggacctaaccgcccgtcctcccgtacacctactccgtcgtacgtaccgtccgagcgtaggaacggacggtagggtatagtttacgtcncgtacctcctagtaactacgtactacgtacctactctacctacgttccgtagtacgttcggttacggttaccggtttccgggaaccgggtaaaccggtaaccctaaaccgttcccgttaccccgtttccgttaccggaccccgttaaccggacccgtacggttcccccgg

SEQ ID NO: 217716 - DNA, 538 bp, Homo sapiens
  misc_feature: GYAE6OF01ACSTB.34.28.C06.1.454.CMB.1.raw
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggcaaagctcccaaactcatgatttangatgtcaataatccggccctnaggtntttcncatcgcttctctgcctccatgtctcggccaacncggccctccctgacccntctctcggactcccaggctgaggacgtagggtgtattactactgccgcctctatactactattcacttcgacccactcctcgtatgtgtacgtttcgggacggacgggaccaacgtcctacccgttccttcgaccacgccccgtaaggtcccg

SEQ ID NO: 217717 - DNA, 556 bp, Homo sapiens
  misc_feature: GYAE6OF01C78RI.34.28.C06.1.454.CMB.1.raw
  modified_base (380)..(380): a, c, t, g, unknown or other
  misc_feature (380)..(380): n is a, c, g, or t
  modified_base (455)..(455): a, c, t, g, unknown or other
  misc_feature (455)..(455): n is a, c, g, or t
tcagtacacgtgatcacgaccggtgctcgatttagagctcacgtattggttttggggggggtcgtcaggaggcagcgctctcgggacgtctccaccatggcctgggctctgctattcctcaccctcctcactcagggcacagggtcctgggcccagtctgccctgactcaacctgcctccgtctctgggtctcctggacagtcgatcaccatctcctgcactggaaccagcactgacgttggtggttatgggtatgtctctggtaccgacaatacacagacagacgccccccaacttcttaactttttgatgtcactaatccggtccctcgtaggggtttctacatcgcttctctggctcagtctgcagcacggcctccncgacctatctcgtcggctccaggctgaggcgacgtcttatttactactgctgctcatatactatttcgctagcgnttcgtcgtagttcgggcgggtagggaccgtaaggtcgacccgtctacgtcgtaccgacggaccccgtaaggtccctaccggccccccgtggtccctacccg

SEQ ID NO: 217718 - DNA, 607 bp, Homo sapiens
  misc_feature: GYAE6OF01DE48I.34.28.C06.1.454.CMB.1.raw
  modified_base (230)..(230): a, c, t, g, unknown or other
  misc_feature (230)..(230): n is a, c, g, or t
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattataagtctgtctcctggtaaccaacaacacccggcaaagcctacccaaaactcaatgtaatttatgatgtacaataactccggccctgaggttgtttctcgatcgtcttctctcgcctcntgtctcggaccaacnccggtccctaccctgacctactcttccgtacggtaccgtccgaggtactacgggacggacggagggtaccacggacccgaacggtcctacccggcccccgttacgggtccctaaccgttccgttcccgtttccccgtccccttccgtctaccgtccgtaccgttcgtaccgtggtaccgggtcgggtaccgtcgggaccggaaggccgacgtacgtaggctngngn

SEQ ID NO: 217719 - DNA, 693 bp, Homo sapiens
  misc_feature: GYAE6OF01ACWB0.34.28.C06.1.454.CMB.1.raw
  modified_base (312)..(312): a, c, t, g, unknown or other
  misc_feature (312)..(312): n is a, c, g, or t
  modified_base (347)..(347): a, c, t, g, unknown or other
  misc_feature (347)..(347): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacgagggtcctgggcccagtctgccctgactcaggctgcctccgtgtctgggtctcctggacagtcgatcaccatcctcctgcactgtaaccggcagtgacgttgatgattataagtctgtctcctggtaaccaacaaccgacccggcaaagcctacccaactcaatgatttatnatgtacaataactccggccctagtaggttgtttcnctatccgtcctttctctcgtcccttcctagttcgttcgtacggactaacccggacccggtccccttcccgtacgtaccgtactccgttcgtacgggaccttcccgacggtacgtacgggaacgggtacgggtaagggttagtaacgtttacgtttaccggacggtcccgtaccttactaacgttaaacttacctactttacctacgtccgtaccctacgttaccgttacgagtttggttacggttaacgggttttccgggaccggggtaaaccgggtaacccctaaacccgttacccgtaccccgttaccgttacccgtaccgaccggacccgtacggtcccccgg

SEQ ID NO: 217720 - DNA, 680 bp, Homo sapiens
  misc_feature: GYAE6OF01DMSRU.34.28.C06.1.454.CMB.1.raw
  modified_base (328)..(328): a, c, t, g, unknown or other
  misc_feature (328)..(328): n is a, c, g, or t
tcagtacacgtgatcacgaccggtgctcgatttagagctcacgtattggggtttgggggggggtctcaggaggcagcgctctcgggactctccaccatggccctgggctcgtcgctacttccctcacccctcctcgactcagggcacgagggtcctgggcccaggtctcgccctgactcaggctgcctcgtgtctcgggtctcctggacagttccgatccaccatctcctgcagtgtaaccggctagtgacgttgatgattataagtctgtcttccgaggtaaccaactaaccacccggaaaaacgcctacccaactcatcgaatttngatacgtactaatactccggcctgacggtctttctcgacttcgtcttcgtacgtcgtcccgtactactcggtactcgggaacctaacgttaccggttcccttacccgtgtaaccctacgtccttacggtcgggtcctacccggtagtcgtaaggacggacggacggtcttagtattttagttcttcgactagtcctacgtaacctaactaacccgtaaaccttaattaacccgttgttaccggtttaaccgggtttacgggacgggtacgggtaacctaaacggttccggtaaccgttaccgtaacgttccgaacgtccccgaaggtccctacccgtccccgttcggtaccc

SEQ ID NO: 217721 - DNA, 622 bp, Homo sapiens
  misc_feature: GYAE6OF01A8A44.34.28.C06.1.454.CMB.1.raw
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggcagtgacgttgatgattataagtctgtctctggtaccaacaacacccggnaaacgcctaccaaactcatgatttangatgtacaataacgtccggtccctcgtaggttcgtttctcattccgtctttctctcgtccctcctattcgtcgtcggaccaacgaccggtcccctccctacgaccctatcctcgtcggacctccgacggtctagggacggacgggtagggtagtactttacgttacgtcgtcctaccgtcaactacttacgtaacttccactccgtacctacttcgtacgtagttggttagttcggtttacgggacgggtaacgggtaaccctaaactcccgtaacccgttccgttaccgtaccgtaccgacccgtacggtccccg

SEQ ID NO: 217722 - DNA, 627 bp, Homo sapiens
  misc_feature: GYAE6OF01DB81D.34.28.C06.1.454.CMB.1.raw
  modified_base (296)..(296): a, c, t, g, unknown or other
  misc_feature (296)..(296): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctctcactcagggcacagggtcctgggcccagtctgccctgactcaggctgcctccgtgtctgggtctcctggacagtcgatcaccatctcctgcactgtaaccgcagtgacgttgatgattataagtctgtctcctggtaccaacaccacccggcaaacgcctaccaaactnatgtattatgatgtactaatacgtccgccctcgtaggtgtttctctatcgtctttctctcgtcctctagttacgtcgtggaccaaccgtccggtccctcccgtacgaccctactccgttcgtacgtaccgtccgtacggtacgttcggaacggtacgggtagggttacgtaacgtttacgttaccgtcggtaccgtccttacgtaattaacgttaactaccgttactacgttaccgtaccctactcgttacgtagtcgttagtacggtttacggaacggtacggtaaccaaccgtacctaccgttaccttcgtacgacgccgtacgtcccg

SEQ ID NO: 217723 - DNA, 670 bp, Homo sapiens
  misc_feature: GYAE6OF01CHOS7.34.28.C06.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtcctcctggacngtcgatcaccatcctcctgctactgtaaccggnagtgacgttgatgattagtagtctgtctccgtaggtaaccaacaaccacccggacaaacgcctacccaaactcattcgtatttatgtatgtactaatactccggtaccctgtaggttctttctcgtactcgtcttctctcgccctctatcgtctcggacctaacgccggtccctcccgtacgtacctacttctcgtacggtacctaccgaggtacgttacggaacgggtacgggtagggttacgtaatttaacgttacgtacgcccgtaccttacgtaacttaacgtactaacttcctaaccgttccgtacccttaccgttaccgtacggtacgttggttacggtttacggttttaccggggacgggtaacgggtaaccctaaacccgttccgtacccggttccttaccggaccgtaccgtccggtaaccgtcccg

SEQ ID NO: 217724 - DNA, 673 bp, Homo sapiens
  misc_feature: GYAE6OF01BLS3A.34.28.C06.1.454.CMB.1.raw
  modified_base (364)..(364): a, c, t, g, unknown or other
  misc_feature (364)..(364): n is a, c, g, or t
  modified_base (670)..(670): a, c, t, g, unknown or other
  misc_feature (670)..(670): n is a, c, g, or t
  modified_base (672)..(672): a, c, t, g, unknown or other
  misc_feature (672)..(672): n is a, c, g, or t
tcagtacacgtgatcacgaccggtgctcgatttagagctcacgtattgggtttggggggagtctcaggaggcagcgctctcgggacgtctccaccatggcctgggctctgctattcctcaccctcctcactcgagggcacgagggtcctgggcccagtctgccctgactcaggctgcctcgtgtctgggtctccgtggacagtcgatccacctatctcctgctacgtacggtaaccgctaaggtgacgttgatgtattatagtctgtctcctcggtaaccaaccaaccgacccggacaacgcctacccaaactctatgtatttatgtatcgtacaaatactccgtacctgtacgttcgtttacnctactcgtcttcgtctcgtccctacctattcgttcgtacggtaccaacccgtacccgtcccttacccgtactacccttacttccgttccgtcggaccctacggtacggtcggtacgggacgggtaacggacgggtaccaccgtacccggtaacggtcccgtcccgtaccccggttccggtacccttaccggtccccgtttccggttccccctacccctccgtaccgtacgtacccgttaccgttacgtaccggcggtaacgggtccgggtacggtccgggtaccggaacgccgtactaacgtggcngnc

SEQ ID NO: 217725 - DNA, 605 bp, Homo sapiens
  misc_feature: GYAE6OF01EPD6S.34.28.C06.1.454.CMB.1.raw
  modified_base (281)..(281): a, c, t, g, unknown or other
  misc_feature (281)..(281): n is a, c, g, or t
  modified_base (345)..(345): a, c, t, g, unknown or other
  misc_feature (345)..(345): n is a, c, g, or t
tcagtacacgtgatcacgaccggtgctcgatttagagctcacgtattggggtttggggggggtctcaggaggcagcgctctcgggacgtctccaccatggcctggctctgctattcctcaccctcctcactcagggcacagggtcctgggcccagtctgccctgactcaggctgcctcgtgtctgggtctctggacagtcgatcaccatctcctgcactgtaaccggcaggtgacgttgatgtattataagtctgtctcctgtaccaacaaccacccgganaaagcctaccaaactcatgtatttatgatcgtactaataacgtccggccctgtaggttgtttcncatcgtcttctctcgcctcatcgtctaggcctaaacgccggtcctccctacgacctactcctctcgtaccgtcacggcgtaggacggtacggtagggtagtattagttactcgtccacgtactatactactacttacgtactcgacctactctcgtagttgtacgttacggtttcgggaccgggtaacggtaaccctaaaccgttacccgtaacccgtttccgttacccgtacctaccggtacccgtaacgggttccccg

SEQ ID NO: 217726 - DNA, 733 bp, Homo sapiens
  misc_feature: GYAE6OF01D1OSB.34.28.C06.1.454.CMB.1.raw
  modified_base (244)..(244): a, c, t, g, unknown or other
  misc_feature (244)..(244): n is a, c, g, or t
  modified_base (341)..(341): a, c, t, g, unknown or other
  misc_feature (341)..(341): n is a, c, g, or t
  modified_base (599)..(599): a, c, t, g, unknown or other
  misc_feature (599)..(599): n is a, c, g, or t
  modified_base (610)..(610): a, c, t, g, unknown or other
  misc_feature (610)..(610): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcaggctcgcctccgtgttccgtgggtcctccgtgggactaggtcgatccaccatctcctgcacgtgtaaccggnagtgtacgttgatagtattagtaagtctagtcttaccgtacgtaacccaaaccaacccgacccggacaaacgcctaaccccaaatcagtatatttanagtagtagtactaagtaacgtccggtccctagtacggtttcttcctacacgttccgtcctttccgtcctacgtccctacctagttccgtacgtaccggaaccaacccggtacccggtacccctttccgtaaccggtacccttacgttccgtaccggtacggtacccttaccgggacgggtcgtacgggaacgggagggtcggttaattactttacgtaccgtcgaccttctaactagttaacctactactccgtaccncgtaacccgtnttacggtctaaggttcgttacggttacggtttcccggggaaggtaaacccggtaaccttaaccccttccggtacccgttacccggtttcgaaaccccgacccgggtacctaccggggtccccc

SEQ ID NO: 217727 - DNA, 649 bp, Homo sapiens
  misc_feature: GYAE6OF01EJAIY.34.28.C06.1.454.CMB.1.raw
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattatagtctgtctcctgaccaacaacacccgganaaagcctaccaaactcatgtatttangatgtacaatacgtcgacctnaggttnttcnctatcgtcttctctcgtcctccatgtcgtcggaccaacgaccggtcccttacccgtgaaccctacttcctccgtcggtaaccctcccgaggactacgggacgggtaacgggtaggggttactaagtttacttacgtcggaccctccttacaagttaactactacgttacctacgttcgaccctacgttccgtacggtaagttcggttacggtttacgggtttaccggggaaccgggtaaacgggtaaccccttaaaacgtccccgttaaccccgttcccgttactaccgtaacccggcccgtaaacggtccccg

SEQ ID NO: 217728 - DNA, 528 bp, Homo sapiens
  misc_feature: GYAE6OF01A10QH.34.28.C06.1.454.CMB.1.raw
  modified_base (281)..(281): a, c, t, g, unknown or other
  misc_feature (281)..(281): n is a, c, g, or t
  modified_base (375)..(375): a, c, t, g, unknown or other
  misc_feature (375)..(375): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggnaaagctcccaaactcatgatttatgatgtacaataactcggccctcaggtgtttctcatcgcttctctgcctcatgtctgcacaccgcctcccngaccatctctgactcgagctgaggacgagggtgatttatactgcgtcctcatatacattcactgacctactctcgattgtgtacgtttcgggacggacgggtaaccctaacgtccgtacccgttccgttacgtaccacgcccgaacggtcccg

SEQ ID NO: 217729 - DNA, 705 bp, Homo sapiens
  misc_feature: GYAE6OF01DOXVN.34.28.C06.1.454.CMB.1.raw
  modified_base (242)..(242): a, c, t, g, unknown or other
  misc_feature (242)..(242): n is a, c, g, or t
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcgagggcacgacgggtcctgggcccagtctgccctgactcaggctcgcctcgtgtcgtggtctccgtaggacagtcgatcaccatcctcctgactacgtacggtaaccgntaggtgtacgttgatagtattaagtacgttctagttcctccgtacggtaaccaaaaccaccgacccgganaaacgcctaacccaaatcagtnatttacagattgaactaagtaacgtccggtccctagtaggttcttcctatctcgtcttctcgtcgcctcgtatcgtcgtacgaccaaccgtccgtccctcccgtacgtacctacttcgtaccgtaccgtacccgtcggacggtacggtacgggaagggtaacggtagggtaacttaacgtttaaacgttccgtcgaccgtaccttaacacttaaactacccttaacttacaccgttacgtacccttacgttccgtatacggttacgttcgttaacggtttcgggaaccgggtaaaccggtaaccctaaacgttacccgttacccggtcccttaccggacgtaacccccccgtaggtcccggttacccccgg

SEQ ID NO: 217730 - DNA, 608 bp, Homo sapiens
  misc_feature: GYAE6OF01D38U4.34.28.C06.1.454.CMB.1.raw
  modified_base (230)..(230): a, c, t, g, unknown or other
  misc_feature (230)..(230): n is a, c, g, or t
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (602)..(602): a, c, t, g, unknown or other
  misc_feature (602)..(602): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtcgtgggtctcctggacagtcgatcaccatctcctgcactgtaaccgnagtgacgttgatgattatagtctgtctctggtaccaacaaccacccgganaaacgctacccaaactcatgatttangatgtacaataactccggccctagtaggttntttcnctatcgtctttctctcgcccttcattgtctggaccaaaccgccggtccctccctagaccctattcctcgtcgaccttccgaggtcgtaggacgggacggagggtaccacggacccgaacggtcccgtaccgccccccgttcgggtaccctaccgttccgttcccgttaccccctaccccgttcctacctacgtccgtaacgttcgtacgtacgggacgggtccgggtacgtcgggaccgaacgggccgacgtaagtcgancgtngn

SEQ ID NO: 217731 - DNA, 621 bp, Homo sapiens
  misc_feature: GYAE6OF01CYZ9B.34.28.C06.1.454.CMB.1.raw
  modified_base (199)..(199): a, c, t, g, unknown or other
  misc_feature (199)..(199): n is a, c, g, or t
  modified_base (281)..(281): a, c, t, g, unknown or other
  misc_feature (281)..(281): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacngtcgatcaccatctcctgcactgtaaccgcagtgacgttgatgattataagtctgtctcctggtaaccaacaacacccgganaaacgctacccaaactcatgtatttatgatgtactaataactccggaccctgaggttcgtttcactactcgtcttctctcgcctctatcgtctcggacaacgccggtcctccgtagacctacttcctcgtcggacctccgacggtcgtaggacggacgtagggtacgttaacttacgttacgtcgaccgtacctactaacgttactaacgtacttacctacttacgacctactctacgtacgttcgttacggttacgttttccgggacgggtaaccgggtaaccctaaacgtcccgtaacccgttcccgttacgtaccgaccggtacccgacggtccccg

SEQ ID NO: 217732 - DNA, 623 bp, Homo sapiens
  misc_feature: GYAE6OF01AY3PR.34.28.C06.1.454.CMB.1.raw
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcaatcaccatctcctgcactgtaaccggcagtgacgttgatgattataagtctgtctcctggtaccaacaacacccggcaaagcctacccaaactcatgtatttatgatgtacaaataactccggccctacgaggttcgtttcctctatccgtctttctactgccctacctatcgtctcggaccaacgaccggtccctccctacgaccctactcctcgtacggactccgagtcgtaggacggacggtagggtgtactttattacgtacgtcaccgtacaattactactacttaccactcgtaccctacttccgtacgtacgttcgttacggttacggttttaccgggacgggtaacggtaaccctaaaccgttacccgtacccgttcccgttacgtaccgaccgtacccgtaacggtccccg

SEQ ID NO: 217733 - DNA, 743 bp, Homo sapiens
  misc_feature: GYAE6OF01EYW7C.34.28.C06.1.454.CMB.1.raw
  modified_base (336)..(336): a, c, t, g, unknown or other
  misc_feature (336)..(336): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacgagggtcctgggcccagtctgccctgactcaggctgccctcgtgtcgtgggtctccgtggactaggtccgatccaccatcctcctgcactcggtaacccggcagtgacgttgatgattaagtacgtctgtcctccgtacgtaaccaacaacccggacccgacaaacgtccctaacccctaactaccgtacttagtanagttattagtactaagtaactacgtaaccttcgtaccgtcgttacgtcgttcttcgtacttcgtcttccgtccttccgtacctccgtactacggtccgtaccggtacccgtacccgtaccccgtcccgtacccctacgtaccgtacctcgtaccgtccgtaccgtccgtacggacggtacggtaggggtacgtaacgggttacgtacgttacgttaccgtcgtccgtaccttacctaacgttaacttaccgtaactttaccgtacccttaccgtcccgtaccgttaccgttaccggaacgtttacggtttacgggtaaccgggtttaaccgggtacccgggtaaccgggtaaccccgtaaacccgttacccgttaccccggttaccccgttcccgtcccgtaaccgg

SEQ ID NO: 217734 - DNA, 660 bp, Homo sapiens
  misc_feature: GYAE6OF01AJW72.34.28.C06.1.454.CMB.1.raw
  modified_base (286)..(286): a, c, t, g, unknown or other
  misc_feature (286)..(286): n is a, c, g, or t
  modified_base (348)..(348): a, c, t, g, unknown or other
  misc_feature (348)..(348): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcaggctgcctccgtgtctgggtctcctggacagtcgatcacctatcctcctgctacgtcgtaaccggcagtgacgttgatgaattatacgtctgtctcctacggtaccaacaaccncccggacaaacgccacccaaatcattgattatgatcgtacaatacgtccgccttgtaggttntttctctatccgtcttcgtctcgtcctcagttcgtctcgaccacgccgccctccgtacgcctactcctcgtcgtacctaccgtcggtacgtagggacgggtacggtaagggttactacgtttacgttaccgtcgtccgtacccgtactagttaactactacgttaccctacgtcgtacccgtacctccggttaccgtagttcggttacggttaacgggttttccgggaacccggggtaacggtaaacccctaaaccgttcccgttaacccggttcccttaccgaccgacccgtacccgggtccggtccccgg

SEQ ID NO: 217735 - DNA, 587 bp, Homo sapiens
  misc_feature: GYAE6OF01BSIK8.34.28.C06.1.454.CMB.1.raw
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccgcagtgacgttgatgattataagtctgtctcctggtaccaacaacacccggacaaagctcccaaactcatgatttatgatgtacaataactcgccctcaggttgtttctcatcgtcttctctcgcctccatcgtctggacctaacgacccggcccttccctacgacctatcctcgtcggactccgaggctggacgggacggtacgggtacgacgacccgaacggcctcccggcccccgtcggtcctaccttccgttccgttaccccctacccttccctcacgttaccgacggttcgtaccgtggtacgggccgggtcgtacgggcgaacgggccgtacgtaacgtacgancgtngtcg

SEQ ID NO: 217736 - DNA, 702 bp, Homo sapiens
  misc_feature: GYAE6OF01D0Z08.34.28.C06.1.454.CMB.1.raw
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatcctctgcactgtaaccggnagtgacgttgatgattatagtctgtctctggtaccaacaacacccgganaaacgcctaccaaactcaatgatttangatgtacaaataatccggcctgaggttntttccntaatccgtctttctctcgtcctaccgtattcggtctaggaccaaaccgacccggtccctacccgtacgaaccctacgttcctccgtacggtacccttacccgagggccgtgggaaacggaccggggtaagggttacgtaacttttacgttaaccgtcggtaccgtccttactaacttaactacgtacgttacccgtacgtccgtaacccttcgtaccgttacggtaagtttcggttaacggtttacgggttttacccgggggaacgggtaaaccgggttaacccctaaaacccggttacccgtaccccgtttcccgtttaccggtacccgaacccgggtaccccgtaacgggttcccccgg

SEQ ID NO: 217737 - DNA, 680 bp, Homo sapiens
  misc_feature: GYAE6OF01CRDWJ.34.28.C06.1.454.CMB.1.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
tcagtacacgtgatcacgaccggtgctcgatttagagctcacgtattgggtttggggggggtctcaggaggcagcgctctcgggacgtctccacatggcctggctctgctattcctcaccctctcactcagggcacagggtcctgggcccagtctgccctgactcaggctgcctccgtgtctgggtctcctggacagtcgatcaccatctcctgacactgtaaccggnagtgacgttnatgattanaagtctgtctcctagtaaccaanaaccacccgganaacgcctccaaactcaatgtatttatgatgtactaaataacgtccggtaccctacgacggttctttcactacttccgtctttacctctcgtcccttcgtattcgtaccgtggaccaaccgacccggtccccttacctacgtacctacttccgtacgtacggtacctaccgacggtacgtacgggacgggacgggtaaggggttacgtaacgtttacgttaccgtcggccgtaccttacgtaacttaacgtactacttactaccgtacctacctacctccgttccgtacgttacgttacggttacggttttacgggaccgggtaacggtaaccctaaaccgttacccgtaaccccgtttcccgttacccgtaaccgtcccggtaccgtaaccggtacccg

SEQ ID NO: 217738 - DNA, 677 bp, Homo sapiens
  misc_feature: GYAE6OF01EFBCS.34.28.C06.1.454.CMB.1.raw
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
  modified_base (300)..(300): a, c, t, g, unknown or other
  misc_feature (300)..(300): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccgnagtgacgttgatgattatagtntgtctctgtaccaacaaccacccgacaagcctaccaactcatgatttangatgtacaagtaactcggtacccttcgaggttcgtttctactattccgtcctttacgttcctcgtcccttaccgtagttcggtcgtcggaaccaaaccgtacccggtcccttaccccgtacgtaccctacttcccttacgtacggtaccgttacccgaacggtaccgttagggaacgggtacgggtaagggttacgtaagtttacgttaccgtgtaccgtcctacgtaacttaatacgtacttaccgtacttacgacctaccgttccgtaaaacgtcttggtacgtttacggttccgggtacgggtaaccggaacccctaaaccgtacccgtaccccgttcccgttaccgtaccgaacgtacccggtacggtccccg

SEQ ID NO: 217739 - DNA, 661 bp, Homo sapiens
  misc_feature: GYAE6OF01EH5IT.34.28.C06.1.454.CMB.1.raw
  modified_base (227)..(227): a, c, t, g, unknown or other
  misc_feature (227)..(227): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctctcactcaggcacagggtcctgggcccagtctgccctgactcaggctgcctcgtgtctgggtctcctggacagtcgatcaccatctcctgctactgtaaccgnagtcacgttgatgattatagtctgtctccgtagaaccaacaccacccgganaaacgccctaccaaactcagtgtatttacngattgtacaatactcgccctgtaggttctttcacngttcncttctctcgtcctacgtattccgtactacggaccaacgtacccggtcccttacccgtcgaactacgttcctcgtacggtaccctcgagggtacctgggaacgggtaacgggtagggtttactaatttaaccgttcggcgttacccgaccttaactaagtttactaacgttcttaccgaccgtcgtaacccagttcctaggactttcggtagtttaccgggtttacgggaacccggtaacgggtaaacccctaaacggtttcccctaaccggtttccccttaacgacccgtaacccggccgtaacggtcccccg

SEQ ID NO: 217740 - DNA, 823 bp, Homo sapiens
  misc_feature: GYAE6OF01CE0H3.34.28.C06.1.454.CMB.1.raw
tcagtacacgtgatcacgaccggtgctcgatttagagctcacgtattgggtttgggggggtctcaggaggcagcgctctcgggacgtctccaccatggcctggctctgctattcctcaccctcctcactcagggcacagggtcctcgggcccagtctgccctgactcgaggctcgcctcgtgtcgtgggtctccgtggacagtcgactccacctactctcctgacctacgtcggtaaccggcaggtcggtacgtttgaagttggtaatttaagtaacgttcttacgtccttaccgtacggtaaacccaaaaccaacccgtaacccgtggaaccaaacgcccttaaccccaaacttcaagttacgttattttagtaggtacttagtaactaaacttacgtcccggtccttacgtggtttctttcgtacctaccgttcgttcctttacgtccgttccgacccttctacgttctaccgtacggtaaccctaaacccggtacccggttaccccgttacccgtaccgtaaccccttaacgtttcccgttacggtcccggggttaccccgtccgggtacgggtacggtaacggggaacgggtaaccggtagggtaccttagttaattttaacgtttgttaccgtacgtacgtacctacgtaaccgtaaaccttaaccctaaaccgttaacgttaacccgttacgttacccgggtttacggggttaccgggaccgggtaacggtaaccgttaacggttacggttaccccgtacgttaccgtaccgtaccggtacccgaacggtcccgttaccccggtccccgttacccgg

SEQ ID NO: 217741 - DNA, 783 bp, Homo sapiens
  misc_feature: GYAE6OF01C0GS0.34.28.C06.1.454.CMB.1.raw
  modified_base (239)..(239): a, c, t, g, unknown or other
  misc_feature (239)..(239): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccaatctcgccctgactcagcctcgcctcgtgtcgtgggtcctccgtggacagtcgtactaccatctcctgcacgtacggaaccngcaggtgtacggttggtactattatcgactattcgtccttccgtacggtaaccaaactacctaaccgacggaaccaaaccccgaccccctaaaacttacttaactttatttacgtgtaacgttcggtaccgtacgttacggtcccggtaccgttacggttacgggtttactaacgttcgtcttacgtcgtcgtacctacgtagtcgtacgaccctaacgcccgtcctaccgtacgacctacttccgtcggtcggtacctccggacggtacgacgggaggtaccggtacggtacgtttaagttaatttacgttacgttccgacgacttaccgaacctaacctaactaaaccctaactaaaccgtttaccgtaccggtttacggtttaaccggggtttaccggggacgggtaaccggtaaacccggtttacggtacccggttaacccgtaccggttaacccgacgtaccccggtaaccgtaccgtacccggttccccgttaccccgttacggtacccttacccgttcccgttcccccgttaccccg

SEQ ID NO: 217742 - DNA, 673 bp, Homo sapiens
  misc_feature: GYAE6OF01CNER5.34.28.C06.1.454.CMB.1.raw
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (291)..(291): a, c, t, g, unknown or other
  misc_feature (291)..(291): n is a, c, g, or t
  modified_base (553)..(553): a, c, t, g, unknown or other
  misc_feature (553)..(553): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctgccctgactcaggctgcctcgtgtctgggtctcctggacagtcgatcaccatcctcctgccacgtgtaaccgnagtgtacgttnatgattacgtagtctgtctccgtggtaacccaacaaccgacccgganaaaacgcctaccccaaaagtcctaattagtaacttttgaggtaattcgtaactaaagttaaccgtccgggacccccttaggtaacggtttcggttacctcgtaccgttccggtctttacccttcgtccgccttctagtcgtacgtccgaacccaacggtcccggtccctacccgtacgtaccctagttccctaccgtcggaacctcccgtaacgggcttacgggaggtacggtaaggtgtacttaacgtcgtcgcgtacctntaacgtatactacgttacacctctaccgacttcgtctaggttcggtgttaccggtccgggtacggaacgtaccctaacctccggtaccttccgtacgaccaaccggtccgaacgtccccg

SEQ ID NO: 217743 - DNA, 652 bp, Homo sapiens
  misc_feature: GYAE6OF01E3U7F.34.28.C06.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcaggctgcctcgtgtctgggtctcctggacngtcgatcaccatctcctgcactgtaaccgcagtcgtacgttgatgaattatagtctgtcctcgtagtaaccaacaaccacccgganaacgcctacccaaactcatgtattatgatgtactaataacgtccggtccctgtaggttcttcactatccgtcttctcgtcgcctcatcgtctacggacctaaccgcccggtccctaccgtaccgaccctacgttcctccgtacgtacccgtacgacggtcgtaggacggacggtaggttagtaatttacgttacgtcgaccgtcctataacttaactactattacctaccgtctaccctacttacgtgtagttcgtacgtttacgggtttacccggggacggtaaacccgggtaacctaaacccgtaccccgttacccgtttacccgttacgaacccgtaccggtaccccggaacgtcccccggg

SEQ ID NO: 217744 - DNA, 623 bp, Homo sapiens
  misc_feature: GYAE6OF01DNX1W.34.28.C06.1.454.CMB.1.raw
  modified_base (251)..(251): a, c, t, g, unknown or other
  misc_feature (251)..(251): n is a, c, g, or t
  modified_base (320)..(320): a, c, t, g, unknown or other
  misc_feature (320)..(320): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccaatctgccctgactcagcctgcctcgtgtctgggtctcgtggacagtcgattaccatcctcctgcacgtggaaccagcagtgacgttggcattangactatgtctctggtaccaacattaccaggaccaaacgacccccaaactctaatttattagtgatgtcnctagtccgtcctgtacgggtttctaactcgtcttctctcgctaccgagtctggaccaacaccggcctcctgacctatctcgtcggctaccgagctaggaggcgagtctagtattattattcgcacgctacacataacctaactaacttaactacttcgttcgggttttacgggcgggtaacggtaacttaaggtcgttacccgttaccgttaacggtccgtaccggtacccgtaaaccgggtcctacccggtccccccggtttacggtacccgttaaccttcccgttccgttaaccccccccg

SEQ ID NO: 217745 - DNA, 693 bp, Homo sapiens
  misc_feature: GYAE6OF01A5JUT.34.28.C06.1.454.CMB.1.raw
  modified_base (135)..(135): a, c, t, g, unknown or other
  misc_feature (135)..(135): n is a, c, g, or t
  modified_base (255)..(255): a, c, t, g, unknown or other
  misc_feature (255)..(255): n is a, c, g, or t
tcagtacacgtgatcacgaccggtgctcgatttagagctcacgtattgggtttggggaggctctgcttcagctgtgggcacaagaggcagcactcaggacaatctccagcatggcctggtctcctctcctcctcnctctcctcgctcactgcacgacgggtcctcgggcccagtctgtgctgacgcacgcccgcctcagtcgtcgtccggggcccagggcaggacgggtcacctatcctcctgctacgtgggacncgacgcctaccgaacacgggtcggggactaggttatagtagttcggtaacctacgtagtaacgaacgcgtacgtcctaccgaacggaaccacccgtaaccccctaaactcctacacttactaacgtactaacctaaacaccgtaacgtcccggtacccgtacgggtacccggggttaccctacggtaaccgttacgttccgtccgtacgtaccgtacttaaccggtccgttcgacctacccgtccgaccgtccctccgacgtccctagtacccgtccggtcgggtcccggtcggtacgtacggacgggtactcggaacgtcgttattaacgtttactacgttcgaccgtttacgttccgttacgacgtacgtcgtacggtccgtaggtacgttcgttacgtttacgttaccgttcggttaaccggtaaacgggtccgg

SEQ ID NO: 217746 - DNA, 642 bp, Homo sapiens
  misc_feature: GYAE6OF01B085U.34.28.C06.1.454.CMB.1.raw
  modified_base (506)..(506): a, c, t, g, unknown or other
  misc_feature (506)..(506): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccgcagtgacgttgatgattataagtctgtctcctggtaccaacaacacccggacaaacgctacccaaactcaatgtatttatgatgtacaaataatccggaccctcgtaggttcgtttcctcaattcgtcttctcgtacgcctcccattgtctggacaacgacggtccctccctgaccattcctcgtggaccttccgagggtcgtaggaacggacgggtagggtataagtttaacttaccgtcggccgtacctactaacttaactaacgtactttaaccncttccgacctaccgttactaccggttacttgggttcttacggttttccgggaacggggaacgggtaaacccctaaaccggttacccacccggtttcctttaccggtaccaaccggtacccccgtaaggtacccccg

SEQ ID NO: 217747 - DNA, 656 bp, Homo sapiens
  misc_feature: GYAE6OF01DLW8J.34.28.C06.1.454.CMB.1.raw
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
  modified_base (347)..(347): a, c, t, g, unknown or other
  misc_feature (347)..(347): n is a, c, g, or t
  modified_base (454)..(454): a, c, t, g, unknown or other
  misc_feature (454)..(454): n is a, c, g, or t
  modified_base (502)..(502): a, c, t, g, unknown or other
  misc_feature (502)..(502): n is a, c, g, or t
tcagtacacgtgatcacgaccggtgctcgatttagagctcacgtattggggtttgggggggggtctcaggaggcagcgctctcgggacgtctccaccatggcctggctctgctattccctcacccctcctcactcagggcacagggtcctggcccagtctgccctgactcaggctgcctccgtgtctgggtctccgtggacagtcgatcacatctcctgcactgtaaccgnagtgacgttgatgattanaagtctgtcctcctggtaacccaaccaaccacccggacaaacgcctacccaactcatgtatttatgatgtacaatactccgtccctgagttcgtttcncgtactcgtcttctctacgcctctatcgtacgtcggaccaacgaccgtccctaccctacgacctactccgtacgtcgtacctcgaggcgtaggacggacggtaggtntacgtttagttacgcgtccgacctataacgttattacctacgttaccnccgttcgtacccctagttccgtaacgttagttcggtttaacggttaccggtttaaccgggggacgggtaaacccgggtaacccctaacccggttcccgttaaccccgttacccgtttacccgaccgaaccccgtcccgggaaccggtcccccgg

SEQ ID NO: 217748 - DNA, 742 bp, Homo sapiens
  misc_feature: GYAE6OF01BKTHE.34.28.C06.1.454.CMB.1.raw
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
  modified_base (384)..(384): a, c, t, g, unknown or other
  misc_feature (384)..(384): n is a, c, g, or t
tcagtacacgtgatcacgaccggtgctcgatttagagctcacgtattggggtttggggggggtctcaggaggcagcgctctcgggacgtctccaccatggcctggctctgctattcctcaccctcctcactcagggcacgaggtcctgggcccagtctgccctgactcaggctgcctcgtgtctgggtctccgtggacagtcgatccaccgntcctcctagctactggtaaccggnagtggtacggttggttggttagtggtagtgtcctccgtcggtaaccgacaatacgacaagacgacgaccgaccccctaacttacttttaagttttgattcgtactaactacgtccgtccctgttagggttctcactcgtcttcgtacncggtacctacgtagtcgtcgactacgccgacccgtccgttcccagtacctcgttccgtacgtcgggtcctaccggacggtacggtacggtaacgggaaccgggtacgttaccgttaacgttttaaccgacgttccggtcgtacgttactaacttaacttaacgttactttacgttaccgtaccgtacggtccggttacttacggtaccggttacggttaccggggaacgggtaaccggggaacccgttaacgggtaccccggtacccgttacccgtacggtacgttacccggaacggtaccccggtaaacccggtcccgttaacccggtccccccgttaacggtccgtttaacccccg

SEQ ID NO: 217749 - DNA, 879 bp, Homo sapiens
  misc_feature: GYAE6OF01B1GWD.34.28.C06.1.454.CMB.1.raw
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
  modified_base (342)..(342): a, c, t, g, unknown or other
  misc_feature (342)..(342): n is a, c, g, or t
tcagtacacgtgatcacgaccggtgctcgatttagagctcacgtattggggtttgggggggggtctcaggaggcagcgctctcgggacgtctccaccatggccgtgggctctgctattcctcaccctcctcactcagggcacgacgggtcctcgggcccagtctcgccctgactcgaggctcgccctcggtcggtccgggtctccgtggacagtcgatcaccatctcgnacctacgtacgtaaccggcagtcgacgttnatgaattatagtctcgtctcgtacgtaaccaacgaaccgacccggaacaaacgcctaacccaaactctattcgtaattttagngtaatacgtaacaaacgttacgtcccggtactcgtaggttttcttcctactcgttaccgttcctttaccttcgttcgtaccccttactacggttccggttacccgtacggtaacccgtaaacccgggtccccggttaccccctttcccctaccgtaaaccccgtcgtttacccgtccggttaacccggtacccggttacccggtaaaggtccggtaacggggaacgggtaacgggtttaagggttacgtttaaccgtttaacgtttccgtaccggtacccgttacccgttaactaacgtttaacctttaaccttaaccgtttaccgtaaccgtttcccggtaaccccttacccggttcggttaaaccgttttcgggttttaacgggttaccggggttttaaacgggtttacccgggggggtaaacccgggtaacccggggttaaaaccccttaacccggttacccggttaccccggtttcccggttacccgtacggaaaccccggtccccgttaaacggggtcccccttcccccggg

SEQ ID NO: 217750 - DNA, 558 bp, Homo sapiens
  misc_feature: GYAE6OF01ERTPS.34.28.C06.1.454.CMB.1.raw
  modified_base (206)..(206): a, c, t, g, unknown or other
  misc_feature (206)..(206): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (342)..(342): a, c, t, g, unknown or other
  misc_feature (342)..(342): n is a, c, g, or t
  modified_base (392)..(392): a, c, t, g, unknown or other
  misc_feature (392)..(392): n is a, c, g, or t
  modified_base (437)..(437): a, c, t, g, unknown or other
  misc_feature (437)..(437): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (481)..(481): a, c, t, g, unknown or other
  misc_feature (481)..(481): n is a, c, g, or t
tcagtacacgtgatcacgaccggtgctcgatttagagctcacgtattgggtttgggggggggtctcaggaggcagcgctctcgggacgtctccaccatggcctggctctgctattcctcaccctcctcactcagggcacagggtcctgggcccagtctcgccctgactcaggctgcctcgtgtctggtctctggacagtcatcacntctctgcactgtaaccgcagtgacgttgattgattatagtctcgtctctcgtaccaaacaccacccgacaaacgctaccaaactcactgtattntacgntacgactaataacgtccggcttacgtaggttctttcncatcgtcttctctcgccttcgatcgtgtacgacaaccgtcgtccctccgngtacctcttactcgtagtactccgagtcgtaggaggacgtaggtntaacttatcgtagcctctanatntactatacacgtcacctactntctagtcgtagttagtttcggaggtaacgtacctaaacgtcctaccgttaccgtactaccgacgacgaccggtcccg

SEQ ID NO: 217751 - DNA, 599 bp, Homo sapiens
  misc_feature: GYAE6OF01ELAN4.34.28.C06.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctggtctcgtgacngtcgatcacatctctgcactgtaaccgnagtgacgttnatgtattatagtctgtctcctgtaaccaacgaaccacccgganaaacgcctaccaaactcatgtatttanagatgtacaagtactccggtcctgtagttgttcactatcgtctttcnctacgccttcagttcgtcgtacggaccaaccgtccgtccctaccgtacgacctcgtccgtcgtacgacctcgaaggctagggaacggtacggacggcaaccggacccgtaggtccctacccggccccgttacgtcctcccttcgtacccttacccccgtacccttccgtactacgtccgtacgttcgtacgtcgggacggtccgggtatacgggacgaaccgggctacggtaacgtacggatgctagc

SEQ ID NO: 217752 - DNA, 686 bp, Homo sapiens
  misc_feature: GYAE6OF01ACRFS.34.28.C06.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
tcagtacacgtgatcacgaccggtgctcgatttagagctcacgtattgggtttggggggggtctcaggaggcagcgctctcgggacgtctccaccatggcctggctctgctattcctcaccctctcactcagggcacagggtcctgggcccagtctgccctgactcaggctgcctcgtgtctgggtctcctggacagtcgatcaccatctcctgcactggaccgntagtgacgttgatntattatagtctgtcctccgtagtaaccaacaaccgacccggtacaaacgcctaccccaaactcgatcgtattatgtatcgtacaagttacgtccggccctaggtaggttcgtttactctacgttccggtcctttcgttctacgtccctaccgtagtttcgaccgttcggaccgaacgtccccggtccctcccgtaccggtaccctagtcccttccgtacgggtaccctaccggtaggctagggaacggacggttaggtacgtaatttacgtacgtcgacctactaactacgtactacgtacttccgaaccttcgacccttcgtaccgttagtagttcggttacgtttacgggtttacccggggaacgggttaaccgggaccctaaacgttccccgtaccccgtttaccggtacgtacccgaacccggttacccgcggttacccccgg

SEQ ID NO: 217753 - DNA, 758 bp, Homo sapiens
  misc_feature: GYAE6OF01EWGQS.34.28.C06.1.454.CMB.1.raw
  modified_base (100)..(100): a, c, t, g, unknown or other
  misc_feature (100)..(100): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (656)..(656): a, c, t, g, unknown or other
  misc_feature (656)..(656): n is a, c, g, or t
tcagtacacgtgatcacgaccggtgctcgatttagagctcacgtattggggtttgggggggggtctcaggaggcgagcgctctcgggacggtctccaccnaagtggcctgggctctgctattccctcacccctcctcactcagggacaccgagggtcctgggcccagtctcgccctgactcgaggctgcctccgtggtctgggtctcctggacagtcgatcaccatctccngacactggtaaccgntaggtgtacgttgatntaattagtatctctctcgtacgaaccaaccaccaccgacaacncctaaccncaaactcgactttagctttagacgtattacgacgtaaacttacggcccggttccctacggtacggttttacgtttccgtacttacgtccgttcctttcccttacgtccgttccctactagttccgttacggtccggaacccctaaacccgggtacccgtcccccttacccgtacccgtaacccttacgttacccttaccggttacgggtaaccccgttcggaacgggttaccggtaacggggtacggtaccgggttacgggtacgttacgtttaaccgttacgtacgtaccgtacctactaacttaactacttactacctacgtccgtacctactacgtacgnttacgttacggttacgggttaccgggtttacccgggtaacccgggtaaccggtaaacccgttaaccgttaccccgttacccgttcccgttacccggtacccg

SEQ ID NO: 217754 - DNA, 668 bp, Homo sapiens
  misc_feature: GYAE6OF01C8AH9.34.28.C06.1.454.CMB.1.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
tcagtacacgtgatcacgaccggtgctcgatttagagctcacgtattggggtttggggggggtctcaggaggcagcgctctcgggacgtctccacatggcctgggctctgctattcctcaccctcctcactcagggcacgagggtcctgggcccagtctcgccctgactcgaggctgcctccgtgtctgggtctcgtggacngtcatcaccatctcctgcacgtacgtaaccggcagtgtacgttgatgtattataagtcttgtcctccgtaggtaaccaaaccgaaccgacccgganaaacgtccctaccaactcaatcgtatttangtatgtacaatacgtccgtccctagaggttactttcnctagttccgtactttcgtactcgcccttacntcgtcgcgaccaacgcggtccctcctagacctctcgtcgtacgaccctcgacgcgtaggaacggtcggtagggtctaagttacgttacgtcgccgtacctacgtaataacgttacttacgttacctaccgtctacccgtacttcgtaccggtagttacggttcggttaacggttttaccgggaaggtaaccggttaaaccccaaccgttcccggttaaccccgtttcccggttaaccgtacccaccgggaaccccgtacgggttacccccgg

SEQ ID NO: 217755 - DNA, 621 bp, Homo sapiens
  misc_feature: GYAE6OF01EU4Q6.34.28.C06.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (520)..(520): a, c, t, g, unknown or other
  misc_feature (520)..(520): n is a, c, g, or t
  modified_base (607)..(607): a, c, t, g, unknown or other
  misc_feature (607)..(607): n is a, c, g, or t
tcagtacacgtgatcacgaccggtgctcgatttagagctcacgtattgggtttggggggggtctcaggaggcagcgctctcgggacgtctccaccatggcctgggctctgctattcctccaccctcctcactcagggcacagggtcctgggcccagtctgccctgactcaggctgcctccgtgtcgtgggtctctggacagtcgatcactatctcctgctactcgtaaccgcagtcgtacgttnatgtattatagtctgtctcgtacgtaaccaacaaccncccgganaacgcctacccaaatcatgtatttacgnatgtactaagtactccgcctntattgtttattctaccagttccttccttctacgtctaccctcgtattcgttccaggacctaaccgtacccggtcccttacccgtacgacccttacttctcgtacgacctacgaggtccgaggacgggaggtaaggtctttaacttacgtcgcggtcctactagtaactacgttactacttacnccgtacgtccacttcgtactagttcgttacggttcggttaccggacgggtaacgtaacctaacccgtcgtacccgttctacgtaccncccggtccgtaccg

SEQ ID NO: 217756 - DNA, 735 bp, Homo sapiens
  misc_feature: GYAE6OF01AFU45.34.28.C06.1.454.CMB.1.raw
  modified_base (338)..(338): a, c, t, g, unknown or other
  misc_feature (338)..(338): n is a, c, g, or t
  modified_base (726)..(726): a, c, t, g, unknown or other
  misc_feature (726)..(726): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacgagggtcctgggcccagtctcgccctgactcaggctgcctcgtgtctgggtctccgtggacagtcgatccaccatcctcctgcactcggtaaccgcagtgtacgttgatgtattatagtctcgtcctaccgtacggtaacccaaacgacccgacccggacaaacgtccctaaccaaaacctcgaattagtattttacngtaagttacgtactaaataaccgtccggtaccccttagtacgggtttcgttttacctcctacgttcccgtcctttacctcctccgtcccttacccgtagtccgttcgtacgggaccctaaccggtccgtcccctaccgtacgaccctctaccgtcgtaccgacgtcccgaaggtcgtacggacgggaacggtacggggtacccacggacccgacggtccccgtacccggtccccccgttcggtaccctacccgttcccggttcccggttcccccgtacccgtcccgttacctacccgttaccgtaccggttccggttaacgtccgggtacgggtcccgggttacggaccgggttaacccgggacggggtacccaggtaacggtacgcncgtcgatcg

SEQ ID NO: 217757 - DNA, 655 bp, Homo sapiens
  misc_feature: GYAE6OF01A0RIK.34.28.C06.1.454.CMB.1.raw
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcacctatcttctgcactcgtaaccggcagtgacgttgatgattagtagtctgtctctggtaaccaacaccacccgganaaacgcctaccaaactcatgtatttangatgtacaataacgtccggcccttgtaggttctttcactactcgtcttctctctaccctctattcgtctacggaccaacgaccgtcccttaccctacgacctactccgttcgtcggtaccctccgagggcgtaggaacgggtaacggtagggtagtaactttacgttacgtcggaccttaccgtactaagttaactactaacgttcctaaccgttcgaccctacttacgtacgtacgttcggttacggtttacggtttccgggtaccgggaacggtaaaccctaaccgttcccgtacccgtttcccgttaccggtaccgtaccggtaccccgtacggtaccccgg

SEQ ID NO: 217758 - DNA, 535 bp, Homo sapiens
  misc_feature: GYAE6OF01BCF6T.34.28.C06.1.454.CMB.1.raw
  modified_base (329)..(329): a, c, t, g, unknown or other
  misc_feature (329)..(329): n is a, c, g, or t
  modified_base (375)..(375): a, c, t, g, unknown or other
  misc_feature (375)..(375): n is a, c, g, or t
  modified_base (434)..(434): a, c, t, g, unknown or other
  misc_feature (434)..(434): n is a, c, g, or t
  modified_base (465)..(465): a, c, t, g, unknown or other
  misc_feature (465)..(465): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatcctcccgcactgtaaccggcagtgacgttgatgattataagtctgtctcctggtaccaacaacaccccggcaaagctacccaaactcatgattttatgatgtacaataatcggccctnaggttgtttctcatcgctttctctcgtcctccatcgtctggcaacncggccctcccgtgacctatcctctgactccaggctgaggacgagggtgtaattattacngtccgctcatactactattcactgcccatcncgtatgtgtacgtttcggacggacgggaccaactccacccgtccttcgcacgccctaaggcctaccccgg

SEQ ID NO: 217759 - DNA, 655 bp, Homo sapiens
  misc_feature: GYAE6OF01C5Z51.34.28.C06.1.454.CMB.1.raw
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (296)..(296): a, c, t, g, unknown or other
  misc_feature (296)..(296): n is a, c, g, or t
  modified_base (425)..(425): a, c, t, g, unknown or other
  misc_feature (425)..(425): n is a, c, g, or t
  modified_base (459)..(459): a, c, t, g, unknown or other
  misc_feature (459)..(459): n is a, c, g, or t
  modified_base (643)..(643): a, c, t, g, unknown or other
  misc_feature (643)..(643): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (653)..(653): a, c, t, g, unknown or other
  misc_feature (653)..(653): n is a, c, g, or t
tcagtacacgtgatcacgaccggtgctcgatttagagctcacgtattggggtttgggggggggtctcaggaggcagcgctctcgggacgtctccaccatggcctggctctgctattcctcaccctctcactcagggcacgagggtcctgggcccagtctgccctgactcaggctgcctccgtgtctgggtctccgtaggacagtcgaatccaccatctcngcactggaaccgnaggtgacgttgatgtattacgaattcgtcgtactctacggtaaccaaacaaccgaacccgganaaacgtcctaaccccaaaactaccagttagtaatttactagtatacgtaacaaactaacgtaccggtcccttaagtcggttacgtttcctataccgttcgtactttcctctcgtcctaacgattgtacngaaacctacgaccgtacctcccgtagaccttacnccttagtacgacgtcgacggactaggacggtacggacggtacgacgaccgacgtcccgtaccggccccgttcggtacctaaccgtccgttacccgttccccgtaccctacccgtactacctacgtaccgttacgtaccgtagggtaccggcgggtacgtacgggacgaaacgggcgaccgtaanaacggnangngc

SEQ ID NO: 217760 - DNA, 651 bp, Homo sapiens
  misc_feature: GYAE6OF01DSDYU.34.28.C06.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (326)..(326): a, c, t, g, unknown or other
  misc_feature (326)..(326): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctctcactcagggcacgagggtcctgggcccagtctgccctgactcaggctgcctccgtgtctgggtctccgtggacngtcgatccacntctccgtgcactggtaaccgcagtgacgttggtacattangactagtntcctccgtaggtaaccaacgtactaccgaggaccaaacgcccccaaatctatttattatgatgtcncgtagtcgcctgtaggttcagtcgtcttctctagctacacgtctcgacaacgccgtccctcctacgacctacgttcgtcgtcggtcctaccgtaggtccgtaggaacggtacggtacggtacgttacggttaatttacgtttacgtcgacctagtcctaacactaactaccgaaacctaacttacctacgtttccggtttacgggtttacgggacgggtaaccgggtactaacggttaccgtacccgttaccgtaccgtaccgaacggtcccgaacggtcacccgtccgtaccccggttagttacccgtacgttcccgttccccg

SEQ ID NO: 217761 - DNA, 685 bp, Homo sapiens
  misc_feature: GYAE6OF01D4AAS.34.28.C06.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (223)..(223): a, c, t, g, unknown or other
  misc_feature (223)..(223): n is a, c, g, or t
  modified_base (395)..(395): a, c, t, g, unknown or other
  misc_feature (395)..(395): n is a, c, g, or t
  modified_base (425)..(425): a, c, t, g, unknown or other
  misc_feature (425)..(425): n is a, c, g, or t
  modified_base (674)..(674): a, c, t, g, unknown or other
  misc_feature (674)..(674): n is a, c, g, or t
tcagtacacgtgatcacgaccggtgctcgatttagagctcacgtattggggtttggggggggtctcaggaggcagcgctcgtcgggacgtctccaccatggcctgggctctgcttattcctcaccctcctcactcagggcacgagggtcctcgggcccagtctcgccctgactcgaggctcgcctccgtgtctggtctcgtggacngtcatcaccntctcgtncactggaaccggctagtcgtacgtgagttataacttatacgtcttacgtctaccgtacgtaaccaaaccgaacccgaacccggtacaaaccgtcctaccgtaactctagttagttactttagagtacttacgtaactaaacgtacctcggtccctaagttggttttccttcncgtactcgtcttccgtctccgtcctacttntccgacgtacgacctaccgtcccgttccacccgtactaacctcttaccgtacgtcggtaactacggaggtcgtagggaacggtcgggtttaagggtaacttacgttagtaacgtccgaccgtactctaacgttaacgtcctacgtactccgacgttaccctagttctacgttaggtccgtagtttacgggtcccggagtaaccgtacccgcgtacccgtacccgtttctaaccggaaccgtcgtcccgngttacccccgg

SEQ ID NO: 217762 - DNA, 723 bp, Homo sapiens
  misc_feature: GYAE6OF01BTBBT.34.28.C06.1.454.CMB.1.raw
  modified_base (200)..(200): a, c, t, g, unknown or other
  misc_feature (200)..(200): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcaggctgcctcgtgtctgggtctcgtggacngtcgatccacatctctgcacgtcgtaaccgcagtcgtacgttgatgtattagtacgtctagtcctccgtacggaacccaacaccgacccggacaaacgccctaaccaactcatgtaatttatgatagtactaagtaccgtccggtacccttaggtacggtttcgtttctactattccgtcttcctcgtccgtacctactgttcgtcgtacggacctaaccgcccggtcccttccctacgtacctacttcccgtacgtacgtacctacccggtaggtacgtacgggacgggtacgggtagggttaacttacgtttacgttaccgtccggtacccgtaccttaacgtaacttaactacctacgtttacccgtaccgttccggtacccttacccgttgttaacggtacgtttgggtttacggttaccgggtttccggggaacggggtaaacccggtaaacccgtaaccgtccccgttaccccggttccgttaccggtacccgaacccggtcccgtaccggtccccg

SEQ ID NO: 217763 - DNA, 697 bp, Homo sapiens
  misc_feature: GYAE6OF01EVRB1.34.28.C06.1.454.CMB.1.raw
  modified_base (228)..(228): a, c, t, g, unknown or other
  misc_feature (228)..(228): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctgccctgactcaggctgcctcgtgtctgggtctcgtggacagtcatcaccatctctgcactgtaaccgnagtgacgttgatgtattagtaagtctgtctctacgtaaccaacacacccgganaaagccctaccaaactcatacgtatttanagtatagtacaaataacgtccgcccgtagtaggttacgtttctacacgttcgtccgtttctcctacgtcctcgtaatcggttctacggaccctaacgtaccccgggtaccctccccgttaacgtacccgtacttccttccgtaccggtaaccccgttcccggaacgggtacgttcgggaacggggaaccgggtaaggggttcggttaatttaccgttaccgtcggccgtacctcgtaattaactacgtaaccttctaactctacccttacgtcctagtattacggttacggttcggttaccggtaaccgggaacgtaaacccgtaaccccgtacgttccccgttaccgtttccgaacccggtccgtaacccggtaaccggtccccgg

SEQ ID NO: 217764 - DNA, 841 bp, Homo sapiens
  misc_feature: GYAE6OF01BUR7V.34.28.C06.1.454.CMB.1.raw
  modified_base (326)..(326): a, c, t, g, unknown or other
  misc_feature (326)..(326): n is a, c, g, or t
tcagtacacgtgatcacgaccggtgctcgatttagagctcacgtattgggtttggggggggtctcaggaggcagcgcgtctcgggacgtctccaccatggcctggctctgctattcctcaccctcctcactcagggcacagggtcctgggccctagtctgccctgactcgagtctgcctccgtgtcgtcgggtctccgtggacagtcgactcgtaccagtcctccgtcgcctacgtacggtaaccggctacggttacgtacgttagactagtattatacggttctcgttcctaccgtaggtaacccaaacgtaccgacccggtaanaacgtcctaaccccaaactctaaagtcggttactttagtcgtaagttcgtaaccggtaaattaaccgggtcccggtaccccgtttaggtaccgggttttacctttaccgttaacgtcgtttacccggttccgttttacccggtttacctacccggttccctttaacggtaccgtttcggttacccgggttaacgggaaaccctaaccccgggtacccggttcccccgttaacccggttacgaacccttaaccggttccgttaccggtaccgggtttacccgacccgtaagggtacccggtagggtaaccgggtaacgggttaggggttaaccttagtttaacccgttaggtcccgtacgtacctaacgttactacttaacggttacttccgtaaccgtccgtacctacgtcacgttagttcgtaggttccgggttacggggaccgtaccggtaacctaacccgttccgttacccggtaccgtttaccaacgggtccgaaccctgggttacccccg

SEQ ID NO: 217765 - DNA, 793 bp, Homo sapiens
  misc_feature: GYAE6OF01CPZBO.34.28.C06.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (785)..(785): a, c, t, g, unknown or other
  misc_feature (785)..(785): n is a, c, g, or t
  modified_base (788)..(788): a, c, t, g, unknown or other
  misc_feature (788)..(788): n is a, c, g, or t
tcagtacacgtgatcacgaccggtgctcgatttagagctcacgtattggggtttgggggggggtctcaggaggcagcgctctcgggacgtctccaccatggcctggctctgctattcctcaccctcctcactcgagggcacgacgggtcctgggcccagtctcgcctgactcgaggctgcctcgtgtctgggtctcgtggacngtcatcaccatctcngcacgtcgtaaccgcagtgacgttgatagtattataacgtctcgtcttccgtacggtaacccaacgaacccgacccggacaacgtcctacccgtaaaactcgtaatcgttaacttttagacgtataacgttacgtaaacttacggttcccgtacccgttacgtacgggtttctttccgtacgtaccttccggttacctttcgttccgtaccgtcccgtacttacgttggttccgacgggtaacctaaacccggtccggtaccccttacccgacgtaacccttacggttacccttcggtaccggtcctaccggtaccgggttacggtacgggtaacccgggtacgggtacgggtaccgtacccgggaacccggtacccggtacccggttcccggtacccccggtttccggtaacccgttaccccgtttcccggtttacccctcccccctttaaccgtcccttacccgttaccgtaaccggtttaccgtccgggtttacggacgggttaccgggtcccgggacccgggttacgggaccggtaaccgtacccggtacgttacgaacggtntcngccag

SEQ ID NO: 217766 - DNA, 755 bp, Homo sapiens
  misc_feature: GYAE6OF01BLASQ.34.28.C06.1.454.CMB.1.raw
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacgagggtcctgggcccagtctgccctgactcaggctgcctccgtgtcgtgggtcctcgtggacagtcgatccaccattcctcctgacctaacgttcggtaaccggcaggtcggtacgttgatgtaattaagtacgtctcgtcgtaccgtaggtaacccaaaccgaacccgacccggaacaaacgtcctaacccaaaactctaatacgtattttaactaggattacggtaactaaacgttaacgtcccggtacccttacggtagttttcgtttacacctagttcccgtacctttcgtacgttccgtacccttacgtacgtttcgtcgaaccggtacccaaaccgtcccggttacccctcccgtacgaccttaccgttccgtacgtccggtaccgtacggacggtacgtaacgggacgggtaaccgggacggtaccgtaaccgacccggtacgtcccgtacccggccccgttacggtccctaccgttccgttcccgttacccctcccgttaccctacgtaccgtacgtaccgttcggtaaccgttgggaaccgggtccgggtacggtaccgggtaaccgggtaaccggaccggttacgaacggttacgactgcgtgac

SEQ ID NO: 217767 - DNA, 782 bp, Homo sapiens
  misc_feature: GYAE6OF01E016D.34.28.C06.1.454.CMB.1.raw
  modified_base (772)..(772): a, c, t, g, unknown or other
  misc_feature (772)..(772): n is a, c, g, or t
  modified_base (774)..(774): a, c, t, g, unknown or other
  misc_feature (774)..(774): n is a, c, g, or t
  modified_base (779)..(780): a, c, t, g, unknown or other
  misc_feature (779)..(780): n is a, c, g, or t
tcagtacacgtgatcacgaccggtgctcgatttagagctcacgtattggggtttgggggggggtctcaggaggcagcgctctcgggacgtctccaccatcggcctgggctctgcttattcctccaccctcctcactcgagggcacgacgggtcctcgggcccagtcctcgaccctgacctcgacggtctcgtcccgtccgttgtccgtcgggtccttccggtaggactacggtacgactccacctacttcctccgtgaccgtacgtacggtaaccggtctaggttacggtacgttagaattaggttaaactttaacgtttaacgtccgttcggttaccccttaaccggtaaccggtaaaacccaaacccgtaacccggacccggaacaaacgtcccctaacgaacttcgattagttacttagcgtactacgtaacctaagttaccgtcccgtacttcggtagttttccgtttacacgtaccttaccgttccttttacgcccgttctccctacttaggttccgtcgtacccggaaacctaacccgggtcctcccttacccacgtaacttccgttaccgtacgtccgtaccgtacggtacggacgtaacgggaaccggtacgggaacgtacccggaacggtacccggtaccgtcccgtaccccggtcccgtcccgttacctaccggttccccttacccgtccccttccgttacctcgtactaccggtccgtactcgggtaccgacggtcgtaggacggtccgacgctacggtananctcgnngc

SEQ ID NO: 217768 - DNA, 627 bp, Homo sapiens
  misc_feature: GYAE6OF01EJGTH.34.28.C06.1.454.CMB.1.raw
  modified_base (285)..(285): a, c, t, g, unknown or other
  misc_feature (285)..(285): n is a, c, g, or t
  modified_base (367)..(367): a, c, t, g, unknown or other
  misc_feature (367)..(367): n is a, c, g, or t
  modified_base (415)..(415): a, c, t, g, unknown or other
  misc_feature (415)..(415): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
  modified_base (517)..(517): a, c, t, g, unknown or other
  misc_feature (517)..(517): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcaggcacagggtcctgggcccagtctgccctgactcaggctgccctccgtgtcgtgggtctccgtggacagtcgatcaccatctcctgcacgtgtaaccggcagtcgtactgatgattatagtctgtctctcgtaaccaacaaccacccganaaagcctaaccaactctatgtatttagcgatacgactaaagtacgtccggaccctgtagttcgtttcactatccgtcttccncttccgccttaccagttcgtcgtacggacaacgtaccgtcccctaccngtaccctatccgtcgtcgtacctcgaaggcgtaggaccgggtagggnggttactattactcgtctccnccttataagtatacctagttcctacgtactaccngttctcgtagtcggttagttaccggttcggggacggtaaccgtaaacccgaaccttccggtaccccgtttaaccctcggacccctaaacggtccccgaaggtcccccggg

SEQ ID NO: 217769 - DNA, 718 bp, Homo sapiens
  misc_feature: GYAE6OF01E0NG5.34.28.C06.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (356)..(356): a, c, t, g, unknown or other
  misc_feature (356)..(356): n is a, c, g, or t
  modified_base (708)..(708): a, c, t, g, unknown or other
  misc_feature (708)..(708): n is a, c, g, or t
  modified_base (713)..(713): a, c, t, g, unknown or other
  misc_feature (713)..(713): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctcgtgtctgggtctctggacngtcgatcacatctctgctactgaaccggnagtgacgttgnttgtattatacgttctgttctccgtaggtaacccaaccaaccgaacccggacaaacgtcctaccccaaactcaagttgtattttatgattgtacaataactccggccctcgtaggttntttctactactctctttcgtctcgtcccttacatcgtcgtacgaccgaaccgccggccttcccgtacgttaccctaacgttccgttaccgttacggtacccgttaccggtaaccgggtacggttacgggaacgggtacgggtaaccgggtaccgaaccggacccgtaaccgggtccgtccccgggttcccccggttacggttcccgttaacccttcccgtttacccggtttccccccgttacccttcccgttaccgttaccgtaccgttaccggttcggtaccggttaccgggaccggtcccggggttacgaacggggttccggaacggttacccgggatacccgggttaanagtgngngng

SEQ ID NO: 217770 - DNA, 648 bp, Homo sapiens
  misc_feature: GYAE6OF01D8KBI.34.28.C06.1.454.CMB.1.raw
  modified_base (215)..(215): a, c, t, g, unknown or other
  misc_feature (215)..(215): n is a, c, g, or t
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
  modified_base (645)..(648): a, c, t, g, unknown or other
  misc_feature (645)..(648): n is a, c, g, or t
tcagtacacgtgatcacgaccggtgctcgatttagagctcacgtattggggtttggggggggtctcaggaggcagcgctctcgggacgtctccaccatggcctggctctgctattccctcaccctctcactcaggcacagggtccgtgggcccagtctgccctgactgaggctcgcctccgtgtctgggtctctgacagtcatcacatctcctancactacggaaccgcagtgtacgtgatgtattaatagttctcgtctaccgttacggaacccaaccaacccgacccgganaaaccgtcctaaccccaaactctaatacgttatttagngattacactaaagtactccggtaccctgttagtttgttaccacgtacctcgttcctctacgctcctntagtcgtcgtacgaccgtaaccnccgtccctaccgtaccgtcctaccttccgtacggtaccgtaaccgttcccggagtaccggtaacggtaacgggaccggtacgaccgacggtacccgacgtcccgtccgtcccctagccctacttccgttaccctccccgttaacccttcgtcctatacccgtatacggtaaccgtggtaccggcgggtcgtaacgggacgacgggttaccgactacgtacgcgnnnn

SEQ ID NO: 217771 - DNA, 720 bp, Homo sapiens
  misc_feature: GYAE6OF01D9VFD.34.28.C06.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
  modified_base (361)..(361): a, c, t, g, unknown or other
  misc_feature (361)..(361): n is a, c, g, or t
tcagtacacgtgatcacgaccggtgctcgatttagagctcacgtattggggtttgggggggggtctcaggaggcagcgctctcgggacgtctccaccatggcctggctctgctattcctcaccctcctcactcagggcacgagggtcctgggcccagtctgccctgactcaggctgcctccgtgtctgggtctcctggacagtcgatcaccntctcctgcactgtaaccgnagtgacgtgatgattatagtctgtctcgtagtaccaacaaccgaccganaacgcctaccaaactcatcgtatttatgtactcgtaactaaattaacgtccggtccccttacgtacggtttcgttttaccnccgtacttccgtccttcttcctcgtccctctagttcgtcgtacggaccaaccgcccggtccctcccgtacgtacctacttccgtacgtcgtacctaccgacgggtcgtacgggaacgggtaacgggttagggtaacgttaacgtttacgttaccgtcggtacccgtaccgttaactaacttaaccttacgttacgttaccctacgttccgtaaccctacttccgtacggttacgttcgggtttaacggtttaccgggtttaccggggaccgggtaaacccgggtaaccccttaaacccggtcccgttacccccgtttacttacccggaccgtaaccccggacccgtcgggtaccccccg

SEQ ID NO: 217772 - DNA, 751 bp, Homo sapiens
  misc_feature: GYAE6OF01BOT01.34.28.C06.1.454.CMB.1.raw
  modified_base (245)..(245): a, c, t, g, unknown or other
  misc_feature (245)..(245): n is a, c, g, or t
  modified_base (333)..(333): a, c, t, g, unknown or other
  misc_feature (333)..(333): n is a, c, g, or t
tcagtacacgtgatcacgaccggtgctcgatttagagctcacgtattggggtttggggggggtctcaggaggcagcgcctctcgggacgtctccaccatggcctggctctgctattcctcaccctcctcactcgagggcacgagggtcctgggcccagtctggccctgactcaggctcgccttcgtgtcgtgggtctcctggacagtcgactccaccgattctcctgccaacgttgtaacccggntagtcgacgttgattgatttagacgtgtcgtctcgtacggtaaccaacaaccgacccgacaaagcccacctaaactctatggtatttncgtatgtacaagtacgtccggtcctagtacggtttctttccacgtcgttcctctttcctcgttccgtccttaccgtgttcgtaccgggtacgtacccgaaaccgtccccggtcccgttaccccgtcgtaaaccccgtctttcccgttccggtaccggtacccgttacccgggagggtaccgttacggggaacgggtacgggtaagggttcgtttaatttacggtaaccgtccgtcccgtaccttactaacgttaactaccgttatacccgtaccttaccggacttaccgttaccgtgaccggtttggtaaccggttttcgggtttcgggggaaccccgtaaacgggaaccctttaaccggtccccttaccggttcccttacgacccgggttaaacccgccgttaacggtccccccggg

SEQ ID NO: 217773 - DNA, 738 bp, Homo sapiens
  misc_feature: GYAE6OF01BBZ5V.34.28.C06.1.454.CMB.1.raw
  modified_base (246)..(246): a, c, t, g, unknown or other
  misc_feature (246)..(246): n is a, c, g, or t
  modified_base (728)..(728): a, c, t, g, unknown or other
  misc_feature (728)..(728): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctcgccctgactcaggctcgcctccgtgtcgtggggtcctccgtggacaggtcgactcaccatcctcctgcctacgtcgtaaccggnaggtcgtacgttgatagtaattagtaacgtctgtcctaccgtacggtaaccaaaccaaccgacccggaacaaacgcctaaccctaaactctatagtatttatagtatagtacaattaacgtccgtccctagtacggttctttacctctacgtcgtccttctcgtaccgcctacctagttcgtcgtacgaccaacccgcccggtcccctaccgtacgaacctcgttccgtaccgtcggtacctacgtacggtcgtacgggaacggtaccgggtacgggtacccgaccggtaccccgtaacggtcccgttaccccgggtacccccgttcggttacccttacccgtttccgtttcccgtttaccccttaccccgttacccccttaccggtacctaccggtacccggtacggtttggtaacccgtggggacccgggtccggggacgggttaccgggaccgggttaacggcccggtaacgtaacggngtcgctatcg

SEQ ID NO: 217774 - DNA, 585 bp, Homo sapiens
  misc_feature: GYAE6OF01AH8Q7.34.28.C06.1.454.CMB.1.raw
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (359)..(359): a, c, t, g, unknown or other
  misc_feature (359)..(359): n is a, c, g, or t
  modified_base (386)..(386): a, c, t, g, unknown or other
  misc_feature (386)..(386): n is a, c, g, or t
  modified_base (430)..(430): a, c, t, g, unknown or other
  misc_feature (430)..(430): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
tcagtacacgtgatcacgaccggtgctcgatttagagctcacgtattgggtttggggggggtctcagggaggcagcgctctcgggacgtctccaccatggcctggctctgctattcctcaccctcctcactcgagggcacgcgggtcctgggcccagtctcgccctgactcgaggctcgcctcgtgtcgtggtcctcgtggactagtccgactcaccactctcctgctacctacggtaaccggctagtcggtacgttgagtagtacttatacgtctcgtcctccgtacgaaccaacgaccgacccganaacgcctaccaactcagtnattngtaatgtacaactacgccgctagcgttnttactcgagtcgtctctctcgctcgtntcgtcgcgacgtaccgccgtcctccacgctctcgtcgcgctcgngcgtagggcgtacgggagccgcgtacgaccgtccgtaccgtcccgtacgtcctacgttcccgtcccgtacccgtaccctcacgtacgtaccgtacgtccgtacggtccggtacgggtcggaccgtcgggcggtacgcgtacgtacgnacgntngn

SEQ ID NO: 217775 - DNA, 689 bp, Homo sapiens
  misc_feature: GYAE6OF01BFYY9.34.28.C06.1.454.CMB.1.raw
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcgagggcacgagggtcctgggcccaggtctcgaccctgactcgacggtctgccctccgtggtcgttcgggtcctccgtggacagtcgatcaccatcctctcgctacgtacgtaccggcaggtcgtactgatgtattaatacgtctcgtcctcgtacggtaaccaaaccaacccgacccggaacaaacgccctaccaaactctatacgttattagntatacgtataaactccgccgtccgttagtggtttacttcgtacncgttcgtcttcncgtccgtacctttacgnttcgtacgacgacctaccgtaccccgtcctacccgatacctctcctaccgtacgtaccgtcgacgggtcgtaacgggcgggtaacggtggttaacttcgtttacgtcgtcgtccctacttacaacttaacgtcttagtacctacgtccgtacctaactccttaaggtcttcgtcggttaacgggttccggaacggtaaaccggtaaccctaacgttcccgtaccggttaccgttaccgaacgtcccgaccgtaacccggttcccccgg

SEQ ID NO: 217776 - DNA, 854 bp, Homo sapiens
  misc_feature: GYAE6OF01A9KA7.34.28.C06.1.454.CMB.1.raw
  modified_base (728)..(728): a, c, t, g, unknown or other
  misc_feature (728)..(728): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcgaggctgcctcgtgtctgggtctccgtggacagtcgactcaccgatcctcctgctacgtggtaaccggcaggtcgacgttgaactgtaagttacaacgttccgttacgtctaccggttacggtaaacccaaacgtaacccgaccccgggaactaaaacggtccccttaaacccccgtaaaattcccgtaagtttacggtttaacgtttttaaacgtcggttaaacgtttacggtaaccgttaaaaccgtttaaaccggtccccgggttaaccccgttaagggtttaccggttttccggtttaacctaccggtaacgtttcccggtttaacctccggttcggttcccttaacccgttacttacggtttccgtacggtacccgaaaccggttaacccggtcccggtacccctacgtaccggtaaccttccggtaccgttacgtaccggtaccacgggtacgtaacggacgggaacggttacgggtaggttaactttaacgtacgttaccggcgtacctaacctttctaacgttaacgtacccttactaccgtacgttacccnccgttacctaggttccgtacggtttccgttaacgggttacgggttaccgggaccgggttaacctaaaccgtccgttaccgttccgtaccgttcgaaaccgtcccggttaaccggccgttacccccg

SEQ ID NO: 217777 - DNA, 686 bp, Homo sapiens
  misc_feature: GYAE6OF01D0BJN.34.28.C06.1.454.CMB.1.raw
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
  modified_base (666)..(666): a, c, t, g, unknown or other
  misc_feature (666)..(666): n is a, c, g, or t
  modified_base (677)..(677): a, c, t, g, unknown or other
  misc_feature (677)..(677): n is a, c, g, or t
tcagtacacgtgatcacgaccggtgctcgatttagagctcacgtattgggtttggggggggtctcaggaggcagcgctctcgggacgtctccaccatggcctgggctctgctattccctccacccctctcactcagggcacgacgggtcctcgggcccagtctcgccctgactcgaggctcgtcctccgtgtcgtcgggtctccgtggacngtcgactccaccacttcctctgcacgtacgaaccgnagtgacgttgatgtattanacttctgtcctcgtacgaaccaacaccgacccgaanaccgcctacccaactnattatattangtatcgtaataacgtaccggtccgtaccttagttacggtttcgttcctactaccgttcgttcctttctaccgtccgtacctcgtacgtcgtcgtaccggaccgaaccgttcccgtccccgtacctagtaacctccgttactaccggtacgtacccgtcggtacggacggtaggtaccggtagggtacgtttacgtttaaactttaccgtcggtcccgtaccgtacctaataaccgttacttaacgtcgtttccaaccgtccttaccgtacttccgtaagtcgttacggttagtttcggtaaccgggacgaccggttaccaccgtcttacccgtctacncccgaacgtcnccggtcccg

SEQ ID NO: 217778 - DNA, 501 bp, Homo sapiens
  misc_feature: GYAE6OF02HEIW8.34.28.C06.1.454.CMB.1.raw
  modified_base (280)..(280): a, c, t, g, unknown or other
  misc_feature (280)..(280): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggnaaagctcccaaactcatgatttatgatgtcaataatcggccctcaggtgtttctcatcgcttctctgcctcatgtctgcaacacggcctccctgaccatctctggactccaggctgaggacgagggtgattattactgcgcctcatatacattcactgccactctcgatgtgtagtttcggcggagggaccaactcaccgtccttcgtcacgcccaggtcc

SEQ ID NO: 217779 - DNA, 520 bp, Homo sapiens
  misc_feature: GYAE6OF02F7592.34.28.C06.1.454.CMB.1.raw
  modified_base (325)..(325): a, c, t, g, unknown or other
  misc_feature (325)..(325): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctnaggtgtttctcatcgcttctctgcctcatgtctggcaacacggcctcctgaccatctctggactccagctgacggacggagggtgattattactgcgcctcatatacattcactcgccactctcgatgtgtacgttttcggacggtacgggaacctaacgtccgaccgttccttccgtccacgacccgaggtccg

SEQ ID NO: 217780 - DNA, 165 bp, Homo sapiens
  misc_feature: GYAE6OF02G8MV1.34.28.C06.1.454.CMB.1.raw
  modified_base (165)..(165): a, c, t, g, unknown or other
  misc_feature (165)..(165): n is a, c, g, or t
tcagtacacgtgatcacgaccggtgctcgatttagagctcacgtattgggtttgggggtgtggtggtctccactcccgccttgacggggctgctatctgcccctcggtcactctgttcccgccctcctcatcacgtgtactgagcgggctggcaaggcgcatagn

SEQ ID NO: 217781 - DNA, 549 bp, Homo sapiens
  misc_feature: GYAE6OF02JP4Q3.34.28.C06.1.454.CMB.1.raw
  modified_base (409)..(409): a, c, t, g, unknown or other
  misc_feature (409)..(409): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctcaggtgtttctcatcgcttctctcgcctcatgtctgcaacacggcctcctgaccatctctcggactccgagctgacggacgaggtntattattctgcgtacctcgatactacattccactcgcctacttcctcgtacttgtgtaacgttttcgggacggtacgggtaaccctaacgttccgtaacccgttccctttaccggtcctaccggacccgtaacggtcccg

SEQ ID NO: 217782 - DNA, 643 bp, Homo sapiens
  misc_feature: GYAE6OF02J3D2V.34.28.C06.1.454.CMB.1.raw
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (336)..(336): a, c, t, g, unknown or other
  misc_feature (336)..(336): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattatagtctgtctctaggtaccaacaaccaccccgganaaagctaccaaatcaatgatttangatgtcaatactcggcctcgaggttgtttcncactcgtcttcctctcgtcctacatcgtacgtcggaccaacgccggtccctcctacgtaccactctcgtacgtaccgtccgacggtcgtacggagggtacggtagggttagtaactttacgttaccgtcgtaccgtaccttactactaactactaacttacctacgtaccgtacctacctaccgttacgtacgttagttcggttacggttttaccgggaccgggtaaccgggtaacccgtaaacccgttacccgtacccgttacccgttaccgtacccgtacccggtacccggtaaccggtccccgg

SEQ ID NO: 217783 - DNA, 505 bp, Homo sapiens
  misc_feature: GYAE6OF02GZW27.34.28.C06.1.454.CMB.1.raw
  modified_base (247)..(247): a, c, t, g, unknown or other
  misc_feature (247)..(247): n is a, c, g, or t
  modified_base (324)..(324): a, c, t, g, unknown or other
  misc_feature (324)..(324): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattanaagtctgtctcctggtaccaacaacaccccggcaaagctcccaaactcatgatttatgatgtcaataatcggccctnaggtgtttctcatcgcttctctgcctcatgtctggcaacacggcctccctgaccatctctggactccagctgacggacgagggtgattattactgcgcctcatatactattcactgccactctcgatgtgtagtttcggcggtacggaccaactccaccgtccttcgtcacgccaggtccg

SEQ ID NO: 217784 - DNA, 508 bp, Homo sapiens
  misc_feature: GYAE6OF02GJXY8.34.28.C06.1.454.CMB.1.raw
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctcaggtgtttctcatcgcttctctgcctccatgtctggcaacacggcctccctgaccatctctgactccaggctgaggacgagggtgattattactgcgcctcatatacattcactcgccactctcgatgtgtagtttcggcggtacgggaccaactcgaccgttccttcgtcacgcccaggtccg

SEQ ID NO: 217785 - DNA, 166 bp, Homo sapiens
  misc_feature: GYAE6OF02GYUWZ.34.28.C06.1.454.CMB.1.raw
  modified_base (166)..(166): a, c, t, g, unknown or other
  misc_feature (166)..(166): n is a, c, g, or t
tcagtacacgtgatcacgaccggtgctcgatttagagctcacgtattgggtttgggggtgtggtggtctccactcccgccttgacggggctgctatctgccccctcggtcactctgttcccaccctcctcatcacgtgtactgagcgggctggcaaggcgcatagn

SEQ ID NO: 217786 - DNA, 532 bp, Homo sapiens
  misc_feature: GYAE6OF02H45ZT.34.28.C06.1.454.CMB.1.raw
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgatttataagtctgtctcctggtaccaacaacaccccggnaaaacgctacccaaactcatgatttangatgtcaataatcggccctnaggtgtttcncatcgcttctctgcctcatgtctgcaacaccggcctccctgaccatctctggactccagctgaggacgagggtgtattattactgcgcctcatatacattcacttgccactctacgatgttgtagttttcgggaccggtacgggaccctaaacgtccgtaccgttccgttccgtaccacggtccccaggtcccg

SEQ ID NO: 217787 - DNA, 511 bp, Homo sapiens
  misc_feature: GYAE6OF02HD8R6.34.28.C06.1.454.CMB.1.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (508)..(511): a, c, t, g, unknown or other
  misc_feature (508)..(511): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttangatgtcaataatcggccctnaggtntttctnatcgcttctctgcctcatgtctggcaacgcggcctcctgaccatctctgactccaggctgaggacgagggtcacgccgaaggcctcggcccctcggtcctaccttctcgttccccaccttcctcactccacgtcgtactggacgcgggtctcgggacgacggcgcagtacgnnnn

SEQ ID NO: 217788 - DNA, 565 bp, Homo sapiens
  misc_feature: GYAE6OF02HX181.34.28.C06.1.454.CMB.1.raw
  modified_base (281)..(281): a, c, t, g, unknown or other
  misc_feature (281)..(281): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggnaaagcctacccaaactcatgtatttatgatgtacaattaactccggccctcgtaggttcgtttctctactcgtcttctctcgccctctatcgtctggacaacgccggcctccctgacctatcctcgtcggtacctccgagcgtaggacggacggtaggtgtattattactgcgtcctactatatactattccactcgcctactctacgattgtgttacgtttcggcgggtacggtaacctaaccgtccgtaccgttccttccgtaccacgcccgtacggtcccg

SEQ ID NO: 217789 - DNA, 513 bp, Homo sapiens
  misc_feature: GYAE6OF02FQQ2I.34.28.C06.1.454.CMB.1.raw
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacggtgatgattataagtctgtctcctggtaccaacaacaccccggcaaagctcccaaactcatgatttatgatgtcaataatcggccctcaggtgtttctcatcgcttctctgcctccatgtctggcaacacggcctccctgaccatctctgactccagctgaggacgagggtgattattactgcgcctcatatacattcacttgccactctcgatgtgtagttttcggcggtacgggaaccaaactcgaccgttccttcgtcacgacccaggtcccg

SEQ ID NO: 217790 - DNA, 500 bp, Homo sapiens
  misc_feature: GYAE6OF02F79Y3.34.28.C06.1.454.CMB.1.raw
  modified_base (496)..(500): a, c, t, g, unknown or other
  misc_feature (496)..(500): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctcaggtgtttctcatcgcttctctgcctccatgtctggcaacacggcctccctgaccatctctggactccaggctggaggacgaggtcacgcccaaggcctcgcccctcggtccactcctcgttcccaccctcctcactccacgtgtactgagcgggctgggcaaggcgcatgnnnnn

SEQ ID NO: 217791 - DNA, 542 bp, Homo sapiens
  misc_feature: GYAE6OF02JVA59.34.28.C06.1.454.CMB.1.raw
  modified_base (305)..(305): a, c, t, g, unknown or other
  misc_feature (305)..(305): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttangatgtacaataatcggccctcaggttgtttctcatcgcttctctgcctcatgtctggcaacgacggccctccctgacctatctctcggacctccacggtctggacggacgagggtgtattattactgcgcctcatactactattctactcgccactctcgtatgtgtagtttcgggacggtacgggaacctaaccgtcctacccgttccttaccgtcgtacgtcccgtaaggtcccg

SEQ ID NO: 217792 - DNA, 165 bp, Homo sapiens
  misc_feature: GYAE6OF02IXS0L.34.28.C06.1.454.CMB.1.raw
  modified_base (165)..(165): a, c, t, g, unknown or other
  misc_feature (165)..(165): n is a, c, g, or t
tcagtacacgtgatcacgaccggtgctcgatttagagctcacgtattgggtttgggggtgtggtggtctccactcccgccttgacggggctgctatctgcccctcggtcactctgttcccaccctcctcatcacgtgtactgagcgggctggcaaggcgcatagn

SEQ ID NO: 217793 - DNA, 522 bp, Homo sapiens
  misc_feature: GYAE6OF02F02NM.34.28.C06.1.454.CMB.1.raw
  modified_base (326)..(326): a, c, t, g, unknown or other
  misc_feature (326)..(326): n is a, c, g, or t
  modified_base (425)..(425): a, c, t, g, unknown or other
  misc_feature (425)..(425): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaaactcatgatttatgatgtcaataatcggccctnaggttgtttctcatcgcttctctgcctccatgtctggcaacacggccctccctgaccatctctggactccaggctgaggacgagggtgattatactgcncctctatatactattcactgccactctcatgtgtagttttcgggacggagggaacctaacgtcctaccgttccttccgtcacgtacccgaggtcccg

SEQ ID NO: 217794 - DNA, 614 bp, Homo sapiens
  misc_feature: GYAE6OF02H4WLS.34.28.C06.1.454.CMB.1.raw
  modified_base (278)..(278): a, c, t, g, unknown or other
  misc_feature (278)..(278): n is a, c, g, or t
  modified_base (470)..(470): a, c, t, g, unknown or other
  misc_feature (470)..(470): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggcagtgacgttgatgattataagtctgtctcctggtacaacaacacccggnaaacgctccaaactcatgatttatgattgtacaataactccggccctacgtaggttcgttttctacctattccgtcttttcgtctcgtcctcctattcgtctaggcaacgaccggtcctccctcgacctatcctcgtcggacctccgaggtctaggaggacggagggttatattattacgtcgcgtacctanacgttaactctaacttcaccgttcaccctactcgtcgtaagtgttcgttaacggtttcgggaccgggtaacgggaaaccccttaaaccgttccgtaccccggttccgtttacccgtaccgaacgtacccccgaaggtacccccg

SEQ ID NO: 217795 - DNA, 644 bp, Homo sapiens
  misc_feature: GYAE6OF02H4JGD.34.28.C06.1.454.CMB.1.raw
  modified_base (250)..(250): a, c, t, g, unknown or other
  misc_feature (250)..(250): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
tcagtacacgtgatcacgaccggtgctcgatttagagctcacgtattgggtttgggggggttcgtcgaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggcagtgacgttgatgacttanaacgtctgtcctcgtcgtaaccaacaccacccggataaagcctaccaaactcagtntatttangatntacaataacgtccgcctgaggttnttcnatccgtcttctcgntccctaactgtcgttcgaacgacaaaccggcccggtccctttcccgacaacctacttccgttccgtacggtacccttacgacggtcgtaacggacgggaaccggtagggttagttaactttacttaacgttcgcgtccctaactactaattacctaactttcgacctcgtccctaaccttcgtaaccgtgtggttacgtttacggtttccggggaccggaccgggtaaaccctaaaccgtccgttacccgttacccgttcggttaccaccgtacccgaggtcccg

SEQ ID NO: 217796 - DNA, 513 bp, Homo sapiens
  misc_feature: GYAE6OF02IWIAR.34.28.C06.1.454.CMB.1.raw
  modified_base (324)..(324): a, c, t, g, unknown or other
  misc_feature (324)..(324): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacggtgatgattataagtctgtctcctggtaccaacaacaccccggcaaagctcccaaactcatgatttatgatgtcaataatcggccctnaggtgtttctcatcgcttctctgcctcatgtctggcaacacggcctcctgaccatctctggactccaggctgaggacgagggtgattattactcgcgcctcatatactattcactcgccactctcgatgtgtagtttcggacggtacgggaaccaactcgaccgttccttccgtcacgcccgaggtccg

SEQ ID NO: 217797 - DNA, 561 bp, Homo sapiens
  misc_feature: GYAE6OF02HD0H1.34.28.C06.1.454.CMB.1.raw
  modified_base (281)..(281): a, c, t, g, unknown or other
  misc_feature (281)..(281): n is a, c, g, or t
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggnaaagctcccaaactcatgatttatgatgtcaataatcggccctnaggtgtttctcatcgcttctctgcctcatgtctgcaacncgcctccctgaccatctctgactccagctgaggacggagggtgtattattactgccgcctctatatactattcactcgcctacctctcgtattgtgttacggttttcgggacgggtaacggggtaaccctaaaccgttcccgtaaccccggtttcccgtttacccggttccgtaccggtaccccgtaacggtccccg

SEQ ID NO: 217798 - DNA, 514 bp, Homo sapiens
  misc_feature: GYAE6OF02GAIDR.34.28.C06.1.454.CMB.1.raw
tcagtacacgtgatcacgaccggtgctcgatttagagctcacgtattgggtttggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctcaggtgtttctcatcgcttctctgcctccatgtctggcaacacggcctccctgaccatctctggactccaggctgaggacgagggtgattattactgcgcctcatatacattcactgccactctcgatgtgtagttttcggcggtacgggaccaaacctccacccgttccttccgtccacgcccaggtcccg

SEQ ID NO: 217799 - DNA, 167 bp, Homo sapiens
  misc_feature: GYAE6OF02IWOWK.34.28.C06.1.454.CMB.1.raw
  modified_base (166)..(167): a, c, t, g, unknown or other
  misc_feature (166)..(167): n is a, c, g, or t
tcagtacacgtgatcacgaccggtgctcgatttagagctcacgtattgggtttgggggtgtggtggtctccactcccgccttgacggggctgctatctgccccctcggtcactctgttcccaccctcctcatcacgtgtactgagcgggctggcaaggcgcatagnn

SEQ ID NO: 217800 - DNA, 535 bp, Homo sapiens
  misc_feature: GYAE6OF02GYHUV.34.28.C06.1.454.CMB.1.raw
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaacgctacccaaactcatgatttangatgtcaataatcggccctnaggttgtttctcatcgtcttctctgcctcatgtctggacaacacggcctccctgaccactctctcgactccaggctggacggacgagggtgtattattactgctcctcatactactacttcactcgcctactctcgattgtgtacgtttcggacggtacggaaccaacgtccgaccgttccgttccgtccgacgtacccgaggtcccg

SEQ ID NO: 217801 - DNA, 548 bp, Homo sapiens
  misc_feature: GYAE6OF02GYH8Z.34.28.C06.1.454.CMB.1.raw
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (445)..(445): a, c, t, g, unknown or other
  misc_feature (445)..(445): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggnaaagcctacccaaactcatgatttangatgtacaataatcggccctnaggtntttctcatcgcttctctcgcctccatcgtctcggacaaccgaccggtccctccctagaccactcctctcggacctccgaggctggaggacggagggtgtattattactcgcncctcatatactattacactcgcctactctcgtatgtgttacgtttcggacggtaacggacctaacgtccgtaccgttccttcgtaccacgtacccgagtcccg

SEQ ID NO: 217802 - DNA, 514 bp, Homo sapiens
  misc_feature: GYAE6OF02G00UB.34.28.C06.1.454.CMB.1.raw
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
  modified_base (466)..(466): a, c, t, g, unknown or other
  misc_feature (466)..(466): n is a, c, g, or t
  modified_base (509)..(511): a, c, t, g, unknown or other
  misc_feature (509)..(511): n is a, c, g, or t
  modified_base (513)..(514): a, c, t, g, unknown or other
  misc_feature (513)..(514): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattatagtctgtctctggtaccaacaacaccccggnaaagctcccaaactcatgatttangatgtcaatatcggccctnaggttnttctcatcgcttctctgcctcatgtctggcaacacggcctccctgaccatctctggacctccgaggctggacggacgagggtcacggcccgaaggcctcgcccccgtcgtccgacttcctcgttcccgtccctcctccnctacgcgtgtacgtgcggcgggcgtcggcacggcgcgactagnnngnn

SEQ ID NO: 217803 - DNA, 551 bp, Homo sapiens
  misc_feature: GYAE6OF02FRYFQ.34.28.C06.1.454.CMB.1.raw
  modified_base (282)..(282): a, c, t, g, unknown or other
  misc_feature (282)..(282): n is a, c, g, or t
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
  modified_base (547)..(551): a, c, t, g, unknown or other
  misc_feature (547)..(551): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaaccaccccggnaaagctacccaaactcatgatttangatgtacaataactccggccctcaggttgtttcnctatcgcttctctgccctcatcgtctggaccaacgaccggccctccctgacctatctcgtcggacctccgaggctaggacgggacggagggtcacgcccgaaggcctccgcccccgtcggtccacctccgtccgttccccgtcccttcctcactccacgttcgtacgcggacggtccgggacgtcgggtacgaacggcgcagtagnnnnn

SEQ ID NO: 217804 - DNA, 689 bp, Homo sapiens
  misc_feature: GYAE6OF02I3UF0.34.28.C06.1.454.CMB.1.raw
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
tcagtacacgtgatcacgaccggtgctcgatttagagctcacgtattgggtttggggggggtcgtcgaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcaggtgacgttgatgacttataacgtctgtctcctggtaccaacaacnccccgganaaacgctacccaaactcagtcgtatttangatgtacaataatccggcctcgacggttgtttctctatccgtcttacttctgtaccctccattgttctggacctaacgaccggtccccttccctacgacctactccttccgtacggtaccctccgaacgggtcttacggaacgggtaccggaaggggttacgttaacgtttaagtttaaccgttcgtcccggtaccttccgaactttaactaaccttaacttttaccaactttccggaccctaccgttaccttaccgttacttaggttcgttaacggtttttccggggacggtaacggggtaaccctaaaccgttacccgttacccgttacccgtttaccggtcccgtaaccgtaccccggtaacggtccccg

SEQ ID NO: 217805 - DNA, 546 bp, Homo sapiens
  misc_feature: GYAE6OF02F3JY3.34.28.C06.1.454.CMB.1.raw
  modified_base (333)..(333): a, c, t, g, unknown or other
  misc_feature (333)..(333): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtacaataatccggccctgaggttntttctcatcgtcttctctcgcctcattgtctggccaacaccggtccctccctgaccactctcgtgactccaggctgacggacgagggtagtattattacgtcgccgtcctcatactactattcactcgacctactctcgtatgtgtacgtttcgggacggtacggtaaccaactccgtaccgttccgttaccgtccacgacccgacggtcccg

SEQ ID NO: 217806 - DNA, 543 bp, Homo sapiens
  misc_feature: GYAE6OF02H5HQ7.34.28.C06.1.454.CMB.1.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (365)..(365): a, c, t, g, unknown or other
  misc_feature (365)..(365): n is a, c, g, or t
tcagtacacgtgatcacgaccggtgctcgatttagagctcacgtattggggtttggggggggtctcgaggaggcagcgctctcgggacgtctccaccatggcctgggctcctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggnaaagctaccaaactcatgatttangatgtacaatatcggcctnaggtnttcncatcgcttctctgcctcatgtctgcaacncggcctcctgaccactctctgactccgaggctggacggacggagggtgtattacttactcgctcctcattactactattctactcgcctactctacgtattggtcgtacgttttcgggacggtacgggtaacctaaactaccgtaccgttccgttccgtcgacgtcccgaaggtcccg

SEQ ID NO: 217807 - DNA, 523 bp, Homo sapiens
  misc_feature: GYAE6OF02FJFTA.34.28.C06.1.454.CMB.1.raw
  modified_base (365)..(365): a, c, t, g, unknown or other
  misc_feature (365)..(365): n is a, c, g, or t
  modified_base (409)..(409): a, c, t, g, unknown or other
  misc_feature (409)..(409): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctcaggtgtttctcatcgcttctctgcctcatgtctggcaacncggcctccctgaccatctctggactccagctgaggacgagggtnattattctgcgcctcatatactattcactgccactctcgattgtgtacgttttcggcggtacgggaccctaacgtcctacccgttcccgttcgtccgacgtcccaacggtcccg

SEQ ID NO: 217808 - DNA, 502 bp, Homo sapiens
  misc_feature: GYAE6OF02HI2WC.34.28.C06.1.454.CMB.1.raw
  modified_base (498)..(502): a, c, t, g, unknown or other
  misc_feature (498)..(502): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctcaggtgtttctcatcgcttctctgcctccatgtctggcaacacggcctccctgaccatctctggactccaggctgaggacgaggtcacgcccaaggctcgcccctcggtccactcgtcgttcccgcccttcctcactccacgttgactgacggcgggctgggcaaggcgcatagnnnnn

SEQ ID NO: 217809 - DNA, 521 bp, Homo sapiens
  misc_feature: GYAE6OF02HW8QC.34.28.C06.1.454.CMB.1.raw
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (518)..(519): a, c, t, g, unknown or other
  misc_feature (518)..(519): n is a, c, g, or t
tcagtacacgtgatcacgaccggtgctcgatttagagctcacgtattggggtttgggggggtctcaggaggccagcgctctcgggacgtctccaccatggcctgggctctgctattcctcaccctcctcactcagggctacgagggtcctgggcccaggttctgccctgacttcaggctgcctccgtgtctgggtctcctggacagtcgatcaccatctcctgcgactgtaaccgcagtgacgttgatgattataagtctgtctcctggtaccaacaacaccccgganaaagctacccaaatccatgattttangatgtacaatatcgcctnaggtntttcnctatcgcttctctgcctcatgtctgcacgcggccctcctgaccatctctcgactcagctgacggacgaggtcagacccgaaggctcgccccgtcgtcctactctcgtccctaccttcctcactccacgttcgtacgtgacggcgggtctgggcgtaacggcgacgtagagngngtnncg

SEQ ID NO: 217810 - DNA, 516 bp, Homo sapiens
  misc_feature: GYAE6OF02FNZEM.34.28.C06.1.454.CMB.1.raw
  modified_base (280)..(280): a, c, t, g, unknown or other
  misc_feature (280)..(280): n is a, c, g, or t
  modified_base (378)..(378): a, c, t, g, unknown or other
  misc_feature (378)..(378): n is a, c, g, or t
  modified_base (455)..(455): a, c, t, g, unknown or other
  misc_feature (455)..(455): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctctggtaccaacaacaccccggnaaagctcccaaactcatgatttatgatgtacaataatcggccctcaggttgtttctcatcgtcttctctcgcctcatcgtccgcaacacggcctcccngaccatctctcggactccgaggctgaggacgaggtgtattattactgcgctcatatacattcactcgccactctcgntgtgtgtttcggcggtacggacctaactccgaccgttccttcgtcacgccgagtcctcccg

SEQ ID NO: 217811 - DNA, 552 bp, Homo sapiens
  misc_feature: GYAE6OF02INBA0.34.28.C06.1.454.CMB.1.raw
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattanagtctgtctcctggtaccaacaacaccccggcaaagcctacccaaactcaatgtatttatgatgtactaaataactccggccctcaggttgtttctcatcgcttctcttcctcatgtctgaccaacaccggcctccctgaccatctctcggactccgaggctggaggacgagggtntattattacgtgtcgtcctanatactactatttcactcgacctacttctgtattgtagttagtttccgggacggtaacgggaacctaacgtcctaccgtccttcgtccgacgcccgtaggcctcccgg

SEQ ID NO: 217812 - DNA, 503 bp, Homo sapiens
  misc_feature: GYAE6OF02GGIYH.34.28.C06.1.454.CMB.1.raw
  modified_base (305)..(305): a, c, t, g, unknown or other
  misc_feature (305)..(305): n is a, c, g, or t
  modified_base (499)..(503): a, c, t, g, unknown or other
  misc_feature (499)..(503): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttangatgtcaataatcggccctcaggttgtttctcatcgcttctctgcctcatgtctggcaacacggcctccctgaccatctctggactccaggctgaggcgagggtcagcccaaggctcgccccctcggtccactcctcgttcccaccctcctcactccacgtgtactgacgcgggctgggcaaggcgacagtagnnnnn

SEQ ID NO: 217813 - DNA, 618 bp, Homo sapiens
  misc_feature: GYAE6OF02GE9NQ.34.28.C06.1.454.CMB.1.raw
  modified_base (279)..(279): a, c, t, g, unknown or other
  misc_feature (279)..(279): n is a, c, g, or t
  modified_base (331)..(331): a, c, t, g, unknown or other
  misc_feature (331)..(331): n is a, c, g, or t
  modified_base (613)..(613): a, c, t, g, unknown or other
  misc_feature (613)..(613): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctctgcactgtaaccggcagtgacgttgatgattataagtctgtctctggtaccaacaacaccccggnaaagcctacccaaactcatgatttatgatgacaataatccggcctcaggttntttctcatcgcttctctcgacctccattcgtctggaccaacgacggccctccctacgaccattcctcgtcggtaccttccgacggctaggacgggacggacgggtaccacgtacccgaacggcctcccggcccccgtacgggttcccaaccgttccgtttacccggttccccccgccccgtttacccctaccgtacttacccgtaccggttacgttaccgttcgggaacgggtccggggtccgttacgggaaccgtacgggaccgtactacggtaccgcgancgntn

SEQ ID NO: 217814 - DNA, 608 bp, Homo sapiens
  misc_feature: GYAE6OF02HVDDF.34.28.C06.1.454.CMB.1.raw
  modified_base (248)..(248): a, c, t, g, unknown or other
  misc_feature (248)..(248): n is a, c, g, or t
  modified_base (307)..(307): a, c, t, g, unknown or other
  misc_feature (307)..(307): n is a, c, g, or t
  modified_base (427)..(427): a, c, t, g, unknown or other
  misc_feature (427)..(427): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattanaagtctgtctcctggtaccaacaacaccccggcaaagcctacccaaactcatgatttangatgtacaataatcggccctcaggttctttctcatcgcttctctcgcctccatgtctggcaacaccggcctccctgaccacttctcgtcggacctccgaggctggacgggacggagggtntattattacgtgccgtccctataacttactactacttccacgtccacctactcgtacgttagtttcgttacgtttacgggttcgggaaccggggtaaccggtaaacccgttaacccgttacccggttaccccgtttcccgttaccggtaccgtaccccgtacccgggtaccgttcccccgg

SEQ ID NO: 217815 - DNA, 592 bp, Homo sapiens
  misc_feature: GYAE6OF02IU62E.34.28.C06.1.454.CMB.1.raw
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
  modified_base (339)..(339): a, c, t, g, unknown or other
  misc_feature (339)..(339): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattatagtctgtctctgtaccaacaacaccccganaaacgcctacccaaactcatgtatttagngatgtacaataacgtccggaccctgtaggttnttctcatcgtcttctctcgcctcatcgtctgacaacgcgtccctcctgaccatctctcggacctcgagcgtaggacggacggtagggttagtattacttacgtcgccgtacctacgtaacttagtactacgttacctactcgtaccctacttacgtacgtattcggttagttacggtttcgggaacggtaacgggtaaccctaaccgttaccgtacccgttccgttaccggacaccgtacccgtaaggtcccg

SEQ ID NO: 217816 - DNA, 550 bp, Homo sapiens
  misc_feature: GYAE6OF02IXC34.34.28.C06.1.454.CMB.1.raw
  modified_base (281)..(281): a, c, t, g, unknown or other
  misc_feature (281)..(281): n is a, c, g, or t
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggnaaagctacccaaactcatgatttatgatgtacaataatccggccctnaggttgtttcncatcgcttctctgcctcatgtctggcaacgacggcctccctgacctatctctcgacctccgacgctaggaggacggagggtagtattattacgtgcgcctcatatactattcactcgcctactctcgtatgttgttacgttttcgggacgggtaacggtaacctaaccgtccgtacccgttcctttaccgtccacgtacccgaaggtcccg

SEQ ID NO: 217817 - DNA, 506 bp, Homo sapiens
  misc_feature: GYAE6OF02GXILG.34.28.C06.1.454.CMB.1.raw
  modified_base (324)..(324): a, c, t, g, unknown or other
  misc_feature (324)..(324): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctnaggtgtttctcatcgcttctctgcctccatgtctggcaacacggcctccctgaccatctctggactccagctgaggacgagggtgattattactgcgcctcatatacattcactgccactctcgatgtgtagttttcggcggagggaccaaactcgaccgtccttcgtcacgcccaggtccg

SEQ ID NO: 217818 - DNA, 593 bp, Homo sapiens
  misc_feature: GYAE6OF02GNJNY.34.28.C06.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattataagtctgtctcctggtaccaacaacaccccggcaaagctcccaaaactcatgatttangatgtacaataatcggccctnaggttgttctcatcgcttctctcgcctccattcgtctggaccaacgaccggtccctaccctgaccctactctctcggacctccgaggctaggaggacggagggttgtattattactgccgtcctacgtaatacttactattccacgttcgccctactcctcgtattcgttaggttacgttttccggggacgggtaaccgggtaaccctaaaccgttccgtaacccggtttccgtttccgtaccgtaccggtaccccgaaggtccccg

SEQ ID NO: 217819 - DNA, 527 bp, Homo sapiens
  misc_feature: GYAE6OF02J0NWW.34.28.C06.1.454.CMB.1.raw
  modified_base (248)..(248): a, c, t, g, unknown or other
  misc_feature (248)..(248): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccaggtctgccctgactcaggctgcctccgtgtctgggtctcctggacagtcgatcaccatctcctgcactgtaaccgcagtgacgttgatgattanaagtctgtctcctggtaccaacacaccccggnaaagctcccaaatcatgatttangatgtcaataatcggcctnaggtgtttacncatcgacttcnctgcctcatcgtctggcaacnccggcctcccgtagaccatctctcggactccaggctgaggacgaggtgattatactgacgcctacatatacattcactcgcctactctcgatgtgtagtttcggcggtacgggtaaccaacgtaccgtaccgttccgttccgtctacggacccgaggtcccg

SEQ ID NO: 217820 - DNA, 545 bp, Homo sapiens
  misc_feature: GYAE6OF02GDIRH.34.28.C06.1.454.CMB.1.raw
  modified_base (542)..(545): a, c, t, g, unknown or other
  misc_feature (542)..(545): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctacccaaactcatgatttatgatgtcaataatcggccctcaggttgttctcatcgcttctctcgcctcatgtctggcaacaccggccctccgtcgaccactctctcggactccgagcgtggacggacggagggtcacgcccgaaggcctacgcccctcggtccaccttcctccgttccccacccttcctcctactccgtacgtcgttacgtcggacggccgggtcgtcgggccgaacgggccgacgaagtaggcnnnn

SEQ ID NO: 217821 - DNA, 619 bp, Homo sapiens
  misc_feature: GYAE6OF02G813P.34.28.C06.1.454.CMB.1.raw
  modified_base (308)..(308): a, c, t, g, unknown or other
  misc_feature (308)..(308): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaaccaccccggcaaagcctacccaaactcatgatttangatgtacaataactccggccctcgtaggttgtttctcatcgtcttctctcgcctcatgtctggaccaacgaccggtccctaccctcgacctactcctcgtcggacctccgaggcgtggaacgggacggtagggtagtattacttacgtcgtccgtcctactaagttaactacgtacttctaccgttcgtaccctacttccgtacgtacttggtacgtttacggtttccggggacgggtaaccgggtaaccctaaccgttaccgtacccgtttcccgttaccgttaccgtacggtaccccgaacgggtcccg

SEQ ID NO: 217822 - DNA, 589 bp, Homo sapiens
  misc_feature: GYAE6OF02IY5EQ.34.28.C06.1.454.CMB.1.raw
  modified_base (326)..(326): a, c, t, g, unknown or other
  misc_feature (326)..(326): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctnaggttgtttctcatcgtcttctctgcctccattcgtctcggccaacaccggccccttccctacgacccactcctctcggacctcccgaggctaggacgggacggagggttagatttagttactgtccgcctagattaactactaatttccacgtcaccaccttccgtcgattgtacgttagttttccgggacgggaacgggtaacccaaaccgttccgtacccggttccctttaccgtccgacggtaccccgtaaggtccccg

SEQ ID NO: 217823 - DNA, 560 bp, Homo sapiens
  misc_feature: GYAE6OF02G0QWD.34.28.C06.1.454.CMB.1.raw
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (553)..(553): a, c, t, g, unknown or other
  misc_feature (553)..(553): n is a, c, g, or t
  modified_base (557)..(558): a, c, t, g, unknown or other
  misc_feature (557)..(558): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcacatctcctgcactgtaaccggcagtgacgttgatgattacctaagtctgtctcctggtaccaacaacaccccggnaaagctcccaaactcatgatttangatgtacaataatcggccctnaggttgtttctnatcgcttctctgcctcatgtctggcaacacggcctcctacgaccatctcgtcggtacctccgaggctggacggacggagggtcgacggcccgaaggcctaccgcccccgtcggtccaccttccgtccgttccccgcccttccctcctactccgtaccgttcgtaccgtcggacgggtccgggtccgtcgggaccgacggacgtacaagttagntcgnngc

SEQ ID NO: 217824 - DNA, 641 bp, Homo sapiens
  misc_feature: GYAE6OF02HRJ1K.34.28.C06.1.454.CMB.1.raw
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctctgtaccaacacaccccggnaaagctaccaaactcatgtatttangatgtacaataactccggcctcgtaggttctttctcatccgtctttctctcgtccctctatcgtctgaccaacgaccggtccctccctacgacctactcctcgtcgacctcgacgtcgtaggaacgggacggtagggtagttaactttacttacgtcgtccgtaccttactacttaactacgtacttacctacgtccgaccctacttccgtacgtacgttcgttacggttacggttttcggggaccgggtaaccgggtaaacccgtaaacccgttacccgtaacccggtttcccgtttacccggtaaccgtaccggtaccccggtaacggttccccgg

SEQ ID NO: 217825 - DNA, 540 bp, Homo sapiens
  misc_feature: GYAE6OF02FZXIH.34.28.C06.1.454.CMB.1.raw
  modified_base (325)..(325): a, c, t, g, unknown or other
  misc_feature (325)..(325): n is a, c, g, or t
  modified_base (535)..(535): a, c, t, g, unknown or other
  misc_feature (535)..(535): n is a, c, g, or t
  modified_base (537)..(539): a, c, t, g, unknown or other
  misc_feature (537)..(539): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctnaggttgtttctcatcgtcttctctcgcctcatgtctgcaacgacgtccctcctgaccatctctcggactcgaggccgtggacggacggagggtaccacggcccgaaggcctccggtcccccgtcggtcctaccgttcgtccgttccccgtcccttcctcacttcgacgttcgtacgtgacggccgggtcgtcggccgaggcgctagacgncnnnc

SEQ ID NO: 217826 - DNA, 649 bp, Homo sapiens
  misc_feature: GYAE6OF02IEGIA.34.28.C06.1.454.CMB.1.raw
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcaggctgccctccgtgtctgggtctcctggacagtcgatccaccatctcctgcactcggtaaccggctaggttgacgttgatgatttataacgtctgtctccgtggtaaccaaacaaccaccccgganaaacgcctacccaaaactcagtanatttatgatntacaataacnccggtcctcgtaggttntttctcatctcttctcctctccctctagtcgttcgtcggacctaaacgacccggtcccttcccgtacgaaccctcttccgttcgttaccggaccctaccggaacgggtcgtaacggaggggtaaccggtagggttacgttaagtttaactttaccgtcgcctccgtacaaattactacgtaatcctaactcgaccctactcgtacgtattgtagtttcgtttccgggaagggaaccgggttaacccaaacgttcccgccgttccgtcgtacgacccgtaccgacggtcccg

SEQ ID NO: 217827 - DNA, 555 bp, Homo sapiens
  misc_feature: GYAE6OF02FWI19.34.28.C06.1.454.CMB.1.raw
  modified_base (248)..(248): a, c, t, g, unknown or other
  misc_feature (248)..(248): n is a, c, g, or t
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (329)..(329): a, c, t, g, unknown or other
  misc_feature (329)..(329): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattanaagtctgtctctggtaccaacacaccccggnaaagctcccaaactcatgatttangatgtacaataatcggcctgaggttntttctcatcgcttctctgcctcatgtctggacaacgacgcctcctgaccatctctgactcagctgacgacgaggtagtattacttactgcgtctcagtatactacttctactcgacctactcgtcgtagttcgttagtacgttttcgggacgggtaacgggtaacccgtaaccgttaccgtacccgttcccgtttaccgtaccgtacgtaccccgtaacggtcccg

SEQ ID NO: 217828 - DNA, 524 bp, Homo sapiens
  misc_feature: GYAE6OF02GW4YH.34.28.C06.1.454.CMB.1.raw
  modified_base (280)..(280): a, c, t, g, unknown or other
  misc_feature (280)..(280): n is a, c, g, or t
  modified_base (324)..(324): a, c, t, g, unknown or other
  misc_feature (324)..(324): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggnaaagctcccaaactcatgatttatgatgtcaataatcggccctnaggttgtttctcatcgcttctctcgcctcatcgtctggcaacgcgcctcctgaccactctctgactccagctgacggacgaggtgtattattctgcgcctcatatacattctactcgccactctcgatgtgtacgtttcggacggtacgggaacctaacgtccgtaccgttccgttccgtacgacgtcccgaaggtcccg

SEQ ID NO: 217829 - DNA, 637 bp, Homo sapiens
  misc_feature: GYAE6OF02GRKA4.34.28.C06.1.454.CMB.1.raw
  modified_base (231)..(231): a, c, t, g, unknown or other
  misc_feature (231)..(231): n is a, c, g, or t
  modified_base (284)..(284): a, c, t, g, unknown or other
  misc_feature (284)..(284): n is a, c, g, or t
  modified_base (348)..(348): a, c, t, g, unknown or other
  misc_feature (348)..(348): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattataagtctgtctcctggtaaccaacaacaccccgganaaaagctacccaaaactcatgtatttatgatgtacaaataacgtccggccctgaggttgtttcncattcgtcttctctcgtcctccattcgtctggacctaaaccgaccggtccctcccgtagacccaacttcctcgtacggaccttccggaacggtcgtagggaacgggtacggaaggggttagtaagtttaacgttaacgtcggaccgtaccgtactaacttaactactaactttaccacttacgacccacttcgtcgtagttgttaggttacgtttcgggacggtaacgggtaaccctaaacgttcccgacccgttccgttaccgtaccgaccgtacccgaagtaccccg

SEQ ID NO: 217830 - DNA, 504 bp, Homo sapiens
  misc_feature: GYAE6OF02F60KF.34.28.C06.1.454.CMB.1.raw
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (491)..(491): a, c, t, g, unknown or other
  misc_feature (491)..(491): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaaagctccccaaaactcatgatttatgatgtcaaataatcggccctcaggttgtttactaatcgcttctctgcctccatgtctggcaacgacggcctccctgaccatctctgactcagctgagacgaggtgattatacngcnctnatatacattcactgccactctcatgtgtatttcggcggaggaccaactcacccgtcttcgtacncgccagtctcccg

SEQ ID NO: 217831 - DNA, 618 bp, Homo sapiens
  misc_feature: GYAE6OF02IT8UI.34.28.C06.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (279)..(279): a, c, t, g, unknown or other
  misc_feature (279)..(279): n is a, c, g, or t
  modified_base (306)..(306): a, c, t, g, unknown or other
  misc_feature (306)..(306): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacngtcgatcaccatctcctgcactgtaaccgnagtgacgttgatgattanagtctgtctctggtaccaacaacaccccggnaaagcctacccaaactcatgtatttangatgtacaataactccggccccttgtaggttcgtttcctcattcgtcttctctcgcctctagttcgtcgtggaccaaccgaccggtccctccctgacctactctcgtacggtaccttccgaacggtcgtaggaacggaccggtagggtccacgacccgaacggtcctcccggccccgtcggtccctaccgttcccgttacccgttcccccgtaccccgttcccttacaccttccgtaaccggtttcgttaccgtggaccggggtccgggtcctacggggaccgaacgggccgtacgacgttacgcgagctga

SEQ ID NO: 217832 - DNA, 594 bp, Homo sapiens
  misc_feature: GYAE6OF02I6QZD.34.28.C06.1.454.CMB.1.raw
  modified_base (248)..(248): a, c, t, g, unknown or other
  misc_feature (248)..(248): n is a, c, g, or t
  modified_base (339)..(339): a, c, t, g, unknown or other
  misc_feature (339)..(339): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattanaagtctgtctcctggtaccaacaacaccccggacaaacgcctacccaaactcatgtatttatgatgtcaataatccggaccctcgaggttntttctctagtcgtcttctctcgtccctctatcgtctggaccaacgccggccctccgtcgacctactctctcggtacctccgaggcgtgaggtaccggagggttagtattacttacgtcgcctcctacattactactattacacctcgccctacttcctcgtattcggtgtttacgtttccgggacggtacgggtaaccctaaacgttccgtacccggtttcccttaccggtacccacggtaccccgacggtcccg

SEQ ID NO: 217833 - DNA, 614 bp, Homo sapiens
  misc_feature: GYAE6OF02HCZON.34.28.C06.1.454.CMB.1.raw
  modified_base (335)..(335): a, c, t, g, unknown or other
  misc_feature (335)..(335): n is a, c, g, or t
tcagtacacgtgatcacgaccggtgctcgatttagagctcacgtattgggtttggagggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaaccaccccggacaaacgcctacccaaactcatgtatttatgtatgtacaataactccggccctnaggttcttctctatccgtcttctctcgtccctctatcgtcgtcggaccaaccgtaccggtcccttcccgtacgaccctacttccgtcgttcggaccttccgacggtctagggacggacgggtagggtcgtaatttacgttacgtcgccgtcctactatactactagttaccacttccgacctactcgtcgtattcgttacggtcgtttcgggacgggtacggtaaccctaaccgtcccgttacccggttccttaccggtacctaccgtacccgtaccgg

SEQ ID NO: 217834 - DNA, 694 bp, Homo sapiens
  misc_feature: GYAE6OF02FLPIM.34.28.C06.1.454.CMB.1.raw
  modified_base (233)..(233): a, c, t, g, unknown or other
  misc_feature (233)..(233): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcacgtcagggcacagggtcctgggcccagtctgccctgactcaggctgcctccgtgtctgggtctcctggacgagtcgatcaccatctcctgcactgtaaccggnagtgacgttgatgattatagtctgtctcctggtaccaacaaccaccccggacaaaggcctaccccaaactcactggatttacgtgtatggtcaaataacgtcggacccttcgacgggttgtttcgtctatccgtcttactctcgtcctacgatggtctgggaccaaaccgaccggtccctacccgtacggaccctaacgtcgtaccgtacggtacccgtaccgtacgggtaccgtacgggacgggtaacggtaaggggttaggtaacgtttacgttaaccgtcgtacccggtaccctccgtaacgttacgttactacgtttacgaccgttaccgtaccgtaaccttcgttacgtacgttaggttgtacggttttccggggacgggtaacgggtaacccgttaaccgtaccgttacccgttacccttccggttaccgtacggtaccccgtaacggtacccgg

SEQ ID NO: 217835 - DNA, 557 bp, Homo sapiens
  misc_feature: GYAE6OF02H40DJ.34.28.C06.1.454.CMB.1.raw
  modified_base (230)..(230): a, c, t, g, unknown or other
  misc_feature (230)..(230): n is a, c, g, or t
  modified_base (282)..(282): a, c, t, g, unknown or other
  misc_feature (282)..(282): n is a, c, g, or t
  modified_base (452)..(452): a, c, t, g, unknown or other
  misc_feature (452)..(452): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattataagtctgtctcctggtaccaacaaccaccccggnaaacgcctacccaaactcatgattttatgattgtacaataactccggccctgaggttgtttctcatcgtcttctctcgcctcatcgtcgtgcaacgccggcctccctgacctatctcgtcggacctccgacggcgtggacggaggtagggttgtaattacttacgtcgcncctacattagtactattcactcgcctactctgtatgttcgtagtttccggacggtacggaacctaacgtccgtaccgttcctaccgtcgacgtcccgtagtcccg

SEQ ID NO: 217836 - DNA, 636 bp, Homo sapiens
  misc_feature: GYAE6OF02FRCKF.34.28.C06.1.454.CMB.1.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (478)..(478): a, c, t, g, unknown or other
  misc_feature (478)..(478): n is a, c, g, or t
  modified_base (617)..(617): a, c, t, g, unknown or other
  misc_feature (617)..(617): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacngtcgatcacatcctcctgcactcggtaaccgcagtgtacgttgatgtattatagtctgtctctgtaccaacaccgaccccgganaacgcctacccaaactcactagtatttagtgtatgtactaaatacgtccgtaccctcgtaggttcgtttctctactccgtcttctcgtccgtccctactagttcgtcgtcggtaaccaaccgccggtccccttacccgtcgacctactccgtcgtaccggtacctccgaggtccgtaggacgggacggtagggtntatttacgtcgtcgccgtcctagtaactacgtactacgttacaccgtcgccctaccgtctagtacgttgttacggttacggtttccgggacgggtaaccgtaaccctaaccgttcccgtaccgtttcccgtccgtaccnccggtacccgagtcccccg

SEQ ID NO: 217837 - DNA, 587 bp, Homo sapiens
  misc_feature: GYAE6OF02GGP8P.34.28.C06.1.454.CMB.1.raw
  modified_base (286)..(286): a, c, t, g, unknown or other
  misc_feature (286)..(286): n is a, c, g, or t
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
  modified_base (345)..(345): a, c, t, g, unknown or other
  misc_feature (345)..(345): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtcctcctaggtaccaaacaaccaccccggnaaagcctacccaaactcatcgatttangatgtacaattaactccggcccttnagggttntttcctcatcgtctttcctctcgccctcatcgttcgtgacaaaccgccggtcccctcccgtagaccctactcctcgtcggacctccgacggcgtaggacgggacggtagggtagtattattacgtcgtcgacctcaactatactatactactcgacctactctacgatgtgtacgtttcggcggtaacggaacctaacgtaccgtaccgttccttaccgtacgtaccgaccgaacggtcccg

SEQ ID NO: 217838 - DNA, 668 bp, Homo sapiens
  misc_feature: GYAE6OF02H2ZT5.34.28.C06.1.454.CMB.1.raw
  modified_base (282)..(282): a, c, t, g, unknown or other
  misc_feature (282)..(282): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctctggtaccaacaaccaccccgganaaacgcctacccaaactcatgtatttatagattgtactaaataacgtccggaccccttgtaaggttcgtttcctctacttccgtcttccttctcgcccttctatcgttctcggacctaaccgaccggtccctaccctcgaacctacttcctccgtacggtacctccgacggtccgtagggacgggtacggtagggttagttagtttacgttacgtcgtccgccttactaactaacgttactactttacctacgttacgtccctaacgtccgttacgtagttcggttacggtttacggttttaccgggaccgggtaacgggaacccgttaacccgttaccgtacccggttccgttaccgtaccgtaccggtacccgtacggtccccg

SEQ ID NO: 217839 - DNA, 749 bp, Homo sapiens
  misc_feature: GYAE6OF02H01M5.34.28.C06.1.454.CMB.1.raw
  modified_base (230)..(230): a, c, t, g, unknown or other
  misc_feature (230)..(230): n is a, c, g, or t
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattataagtctgtctcctggtaccaacaaccaccccgganaaacgcctacccaaactcatgtatttangtatgtacaataacgtccggtccctgtaggttcgtttctactatcgtcttctctcgccctctatcgtcgtcggaccaaccgtaccggtcccttacccgtacgtaccctaacttcccttaccgtcgggtacctacccgtacgggtccgttacgggtaacggggtaacgggtaacgggggttacggttaaacgttttaacgtttaaccgtcggtaccggtacccttacgtaacttaacttaaccttacctttacctaaccgttaccgtaccccttaaccgttaccgttaccggttaacgttcggtttacgggttttacggtttttacccgggggaccggggttaaaccggggtaaaccctaaaacccgttcccgttaaccccggtttcccgtttacccggttacccgtaaccggtacccccggtaacgggttcccccccg

SEQ ID NO: 217840 - DNA, 597 bp, Homo sapiens
  misc_feature: GYAE6OF02IBSUW.34.28.C06.1.454.CMB.1.raw
  modified_base (284)..(284): a, c, t, g, unknown or other
  misc_feature (284)..(284): n is a, c, g, or t
  modified_base (350)..(350): a, c, t, g, unknown or other
  misc_feature (350)..(350): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactacgtaaccgcagtgacgttgatgattataagtctgtcctctggtaccaacaacaccccgganaaacgcctacccaaactcatgtattttactgatgtacaataactccggccctgtacggttgtttcncgtatcgtccttctctcgcctcatcgtctgacacgacgccctccgtcactctctcgtacgctccgagctggacggacggtagggttacgtattaacgttactggcctcctacgtaatactactacgttaccacttaccgacctactaccttcgtcttagttcggttagtttccgggaacggtaaccggaacccttaaccgtacccgtccgtttaccgttccgtaccaccggtacccgaacggtcccg

SEQ ID NO: 217841 - DNA, 610 bp, Homo sapiens
  misc_feature: GYAE6OF02H2JQK.34.28.C06.1.454.CMB.1.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
  modified_base (466)..(466): a, c, t, g, unknown or other
  misc_feature (466)..(466): n is a, c, g, or t
tcagtacacgtgatcacgaccggtgctcgatttagagctcacgtattgggtttggggggggtctcaggaggcagcgctctcgggacgtctccaccatggcctggtctctgctattcctcaccctcctcactcagggcacagggtcctgggcccagtctgccctgactcaggctgcctccgtgtctgggtctcctggacagtcgatcaccatctccngcactgtaaccgnagtnacgttnatgattanagtctgtctctgtaccaacaaccnccccgganaaacgcctacccaaaacgtcatgtatttacngattgacaataactccggcctgtaggttnttctatctcgtccttctctacgtcccttacattcgtctggacctaaacggcgtcctacccgtagacctactcctcgtcggacctccgtaggctaggacgggacggtaggttacgtatttaagttccnggacctcctaacgaatttaactaccgtaatttcccgaacgttccgtaacctcgttaccgtagtacttggttacgttacggtttcgggacggacggtaacctaaccgtcttacccgttccgttacgcgtaacgcccgaagtcccg

SEQ ID NO: 217842 - DNA, 633 bp, Homo sapiens
  misc_feature: GYAE6OF02F9TM2.34.28.C06.1.454.CMB.1.raw
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (623)..(623): a, c, t, g, unknown or other
  misc_feature (623)..(623): n is a, c, g, or t
  modified_base (630)..(630): a, c, t, g, unknown or other
  misc_feature (630)..(630): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccgatctcctgcacgtcgtaaccggcagtgacgttgatgattataagtctgtctcgtgtaccaacaaccgacccgganaaacgcctacccaaactcatgtatttangatgacaatacgtccgcctagaggttcttctcatcgtcttctctcgcctctatcgtctggacaaccgaccggtccctaccgtagaccctatcctcgtacggacctccgacggtctacgggaacggtacggtacggtaccgacggaccccgaaacggaccccctaaaccccgtacgttacgtaccctaccgttcccgttacccggttcccccgccccttaccgtacctaccgttacccgtacggttacgttacgtcgggacgggtccgggtaccgttacgggaccgtaacgggcctaacgtacgtacgcncgtacgncgg

SEQ ID NO: 217843 - DNA, 595 bp, Homo sapiens
  misc_feature: GYAE6OF02I93SH.34.28.C06.1.454.CMB.1.raw
  modified_base (229)..(229): a, c, t, g, unknown or other
  misc_feature (229)..(229): n is a, c, g, or t
  modified_base (336)..(336): a, c, t, g, unknown or other
  misc_feature (336)..(336): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccgnagtgacgttgatgattataagtctgtctcctggtaccaacaacaccccggacaaagctccccaaactcatgatttatgatgtacaataactccggccctcgaggttntttctcatccgtcttctctcgtccctcctatcgtctgacaaccgacggtcccttccctcgacctactcctcgtcgtacctccgacggcgtacggacggacggtaggtgtattagttactcgcgtcctcgtactatactacttactacttcgtcctactccgtcgtatacgtgttacgttttacgggaccgggtacggtaaccgtaaccgtaccgtacccgttccgttaccgtccgtaccggtaccccgtacggtacccg

SEQ ID NO: 217844 - DNA, 750 bp, Homo sapiens
  misc_feature: GYAE6OF02H7KA5.34.28.C06.1.454.CMB.1.raw
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
tcagtacacgtgatcacgaccggtgctcgattttagagctcacgtattgggtttgggggggggtctcgaaggacggcagcgctctcgggacgtctccaccatggcctgggctcgtcgctattcctcaccctcctcgactccagggctacgagggtcctggggcccctaggtctcgcccctggacttcgaggctgcctcgtgtcctcgggtctcctggactcgtcgatcaccatctcctgacactgtaccggntacgtgacgttnatgagttagaagtctcggtctcgtacggtaaccaaactaccgtaaccccggacaaacggtcctaccaaaactcaacgtagtaagtttagngaatntacataacgtccgacctgaggtttacttcactacgttcgttaccttactccgtacgacccgttacctagttcggttaccgtacgaaccgtaaccggtcccggaccctttcccgtacgtaaccccgtagttacccgttacggttacgtacccttacccggagggtaccttaacgggaacggtaccgggtaagggttaccttaaagtttcggttaccgcgggtaccctaaccttagtaaacgtttaacgttacttacgttaccctaacgtttccgtacctaacgttaacttacgtacgttacggttacgttacgggtttcccgggaaccgggttaccggtaaccctaaccgtccgttaccgttctacggtaccgacgttacccgaggtccccg

SEQ ID NO: 217845 - DNA, 587 bp, Homo sapiens
  misc_feature: GYAE6OF02I9PN8.34.28.C06.1.454.CMB.1.raw
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (450)..(450): a, c, t, g, unknown or other
  misc_feature (450)..(450): n is a, c, g, or t
  modified_base (585)..(586): a, c, t, g, unknown or other
  misc_feature (585)..(586): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcaagtgacgttgaatgattanagtctgtctcctggtaccaanaaccaccccgganaaaacgctacccaaaactccatgtaatttatgatgtacaataaacgtcgcccctgtaggtntttcncaactcgtaccttctactgcccttccatgtactggaaccaacgaccggtcccttccctgaacctatcctcgtacggacctcgaggctggaacggtacgnggtacgacgacccgaacgccgtacgcccccgtgtcctacctccgttaccggtcccgtcccttcctacctagttccaacgttcgtaccgtaggcggtccgggtcgcggtaacgaacggtcgctaacgtggactcgnnc

SEQ ID NO: 217846 - DNA, 685 bp, Homo sapiens
  misc_feature: GYAE6OF02G93TL.34.28.C06.1.454.CMB.1.raw
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcaggctgcctcgtgtctgggtctctggacagtcgatcacatctcctgcactgtaaccggcaggtgacgttgatgattatagtctgtctctgtaaccaacaaccacccgganaaacgcctacccaatcatgtattangatgtacaagttactccggccctagtagggttctttcgtactagttccgtccttactccgtcgtccctttacacgtttcggtaccgtcggaaccctaaaccgtacccggtccccttacccgtacgaaccctctaccgttaccgtacggtaccctacccggtaaggtccgttacgggaacgggtcgggttaacgggttacttaacgttttaacgtaccggtcgtacccgtccttactagttaaccttacgtacttcctaacgtcgtaccctacttccgtagtacgtttgtacgtttacggttacgggaccgggtaacggtaaccgtaaccgttccgtacccgttccgttaccgtaccgtaccggacccgtaccgtccccgg

SEQ ID NO: 217847 - DNA, 530 bp, Homo sapiens
  misc_feature: GYAE6OF02FJL7P.34.28.C06.1.454.CMB.1.raw
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataancggcctcaggtgtttctnatcgcttctctgcctcatgtctggccaacacggcctccctgaccatctctgactccagcgtgaggacgtagggtgattattactgcgcctcatatactattcactacgccactctcgatgtagtagttttcggacggtaacggtacctaaacgtccgtaccgttcccgttaccgtccgacgtacccgaagtcccg

SEQ ID NO: 217848 - DNA, 578 bp, Homo sapiens
  misc_feature: GYAE6OF02HRPGH.34.28.C06.1.454.CMB.1.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (306)..(306): a, c, t, g, unknown or other
  misc_feature (306)..(306): n is a, c, g, or t
  modified_base (396)..(396): a, c, t, g, unknown or other
  misc_feature (396)..(396): n is a, c, g, or t
  modified_base (437)..(437): a, c, t, g, unknown or other
  misc_feature (437)..(437): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggnagtgacgttgatgattatagtctgtctcctggtaccaacaccaccccggnaaagctacccaaactcatgtattttangatgtacaaataatccggccctgaggttgttctctatcgtcttctctcgtcctccatcgtcgtcggaccaacgccggtcctccctgaccnttctcgtcggacctcagggctaggacgtcgaggtacggttntactttagacttggacctctacgtattacacttactcgactcgcctacgttcgtagtgttacgtcgtttaacggttccgggacggaaccgtaaccctaacgttcccgtaccgttcctttcgaccgtaccgtaccgtaccgg

SEQ ID NO: 217849 - DNA, 583 bp, Homo sapiens
  misc_feature: GYAE6OF02HY4Q6.34.28.C06.1.454.CMB.1.raw
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaaccaccccggcaaaacgctacccaaaactcatgtatttatgatgtacaattaatcggtaccctgtaggttgtttctcattcgcttctctcgccttccattcgtctcggacaacgaccggtccctccctacgacctactctctggtacctccgaggctaggacggtacggaggtgtaattacgttacgtcgccactacatactacatttcactcgccctactctacgattgtcgttacgtttcgggaccgggtaacggtaacctaaccgtcgtaacccggtttcttccgtacgaccgtaccgacggtcccg

SEQ ID NO: 217850 - DNA, 637 bp, Homo sapiens
  misc_feature: GYAE6OF02HRBOM.34.28.C06.1.454.CMB.1.raw
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcacatctctgcactgaaccggcagtgacgttgatgattataagtctgtctctggtaccaaacaacaccccgganaaagctaccaaactcatgatttangatgtacaatactcggccctnaggtntttcncatcgcttctctgcctacatcgtctgaccaacgaccggtccctcccgtacgaccactcctcgtcggacctcccgaggtcctgggaacgggtacggtagggttagtaatttacgttacgcgtccgtaccttagaacttaactactaactttccgtaaccttacggaccctaacgttaccgtagtacgttaggtttacggttaacggttttccggggaccggggttaaacgggaaacccttaaacccgttcctaaccccggtttaccgttccgtacccggaacgtaccccgaacgggttacccc

SEQ ID NO: 217851 - DNA, 558 bp, Homo sapiens
  misc_feature: GYAE6OF02FVUFR.34.28.C06.1.454.CMB.1.raw
  modified_base (284)..(284): a, c, t, g, unknown or other
  misc_feature (284)..(284): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (416)..(416): a, c, t, g, unknown or other
  misc_feature (416)..(416): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgaattataagtctggtctcctggtaccaacaacacccccggtnaaaagctccccaaactcatgatttatgatgtcaataatcggccctnaggtgtttcncatcgcttctctgcctccatgtctgcaacacggcctccctgaccatctctggactccaggctgaggacgtagggtnattatactgccgctccatacgtactattcacttcgccgtacttacctcgagttgtacggtagttttccgggacgggtacgggaaccctaaaccgtcgtacccggttacctttccggttaccacggtacccgtaggtaccccg

SEQ ID NO: 217852 - DNA, 717 bp, Homo sapiens
  misc_feature: GYAE6OF02FGNEL.34.28.C06.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
  modified_base (389)..(389): a, c, t, g, unknown or other
  misc_feature (389)..(389): n is a, c, g, or t
tcagtacacgtgatcacgaccggtgctcgatttagagctcacgtattgggtttgggggggtctcaggaggcagcgctctcgggacgtctccaccatggcctgggctctgctattcctcaccctctcactcaggcacgagggtcctgggcccagtctcgccctgacctcgaggctgccttccggtgtcctgggtcctccgtggaccngtcatccacctntctcctgcacgtcgtaaccggctagtgtacgttgattagtacttagtaacgttcctacgtcctccgtaccggtaaccaaccgaacccgaccccggacaaaccncctaacccaactcatagtattagtntactactactaacgtaccgtcccgtacgttacgtggttcttcncgtactccgttccttctcctcgtacctatacgtcgtacctacgacccaacccggtcccgttaccctaccgaccgtaacctcgtaccttaccggactaccgtccgggtagtacggtaacggacggtacggttagtacttaacgttcttaccgcgtaccctactaacgtctaacgttacctacgttacccgactccgaaccttagtccgttaggtaactttcgggtaacccgtacgggtaacccgggacccggtaaacccttaacccgccgttacccggtcccttaacccgggtcaccccgggtaaccgtaccgggtccccttccccggg

SEQ ID NO: 217853 - DNA, 612 bp, Homo sapiens
  misc_feature: GYAE6OF02IUGIA.34.28.C06.1.454.CMB.1.raw
  modified_base (232)..(232): a, c, t, g, unknown or other
  misc_feature (232)..(232): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
tcagtacacgtgatcacgaccggtgctcgatttagagctcacgtattgggtttgggggggggtctcgggaggcagcgctctcgggacgtctccaccatggcctgggctctgctattcctcaccctcctcactcagggcacagggtcctgggcccagtctgccctgactcaggctgcctccggtgtctgggtctcctggacagtcgatcaccatctcctgcactgtaaccggnagtgacgttgatgattataagtctgtctctaggtaccaacaaccgacccgganaaacgcctacccaaactcaattgaattttangatgtacaataactccggaccctgtaggttcgtttctcatccgtctttctctcgcctcatcgtctaggaccaacgccgtccctccctgacctactctcgtgacctccgaggcgtaggacggacggtaggtagtactttaagttacgtcgccgtcctactagtactacgtacttacactaccgtacctacttctacgtgttcgtacgttacgtttacggggacggtaaccggaacctaaccgttaccgttacccgttccgttaccgtaccgaccggtaccgtacggtcctaccccgg

SEQ ID NO: 217854 - DNA, 633 bp, Homo sapiens
  misc_feature: GYAE6OF02G5V1X.34.28.C06.1.454.CMB.1.raw
  modified_base (353)..(353): a, c, t, g, unknown or other
  misc_feature (353)..(353): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctcgtgtctgggtctccgtggacagtcgatcaccatctcctgcactgtaaccggcagtgacgttgatgattataagtctgtctctggtaaccaacaaccaccccggacaaacgcctacccaaaactcactgtatttactgatgtacaaataagtccggaccctgtaggttcgtttcnctatcgtcttctctcgtcctcatcgtctcgactaacgccggtcctccgacgtaccactcctcgtacggctccgagtctggaacggtacgtaggttacgtattacgtacgtgtcccgtctacgtattaactaccgtaattaccgacttcgtacccgtacttcgtacgtagttacggttacgttacggttttcgggaacgggtaaacggtaaacccttaaccgttacccggttaacccgttcgttttaaccgaccggtaaccgtaccccgaacggttccccg

SEQ ID NO: 217855 - DNA, 554 bp, Homo sapiens
  misc_feature: GYAE6OF02GFWZI.34.28.C06.1.454.CMB.1.raw
  modified_base (230)..(230): a, c, t, g, unknown or other
  misc_feature (230)..(230): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (425)..(425): a, c, t, g, unknown or other
  misc_feature (425)..(425): n is a, c, g, or t
  modified_base (489)..(489): a, c, t, g, unknown or other
  misc_feature (489)..(489): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (551)..(552): a, c, t, g, unknown or other
  misc_feature (551)..(552): n is a, c, g, or t
  modified_base (554)..(554): a, c, t, g, unknown or other
  misc_feature (554)..(554): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgagttgatgattataagtctgtctcctggtaccaacaaccgaccccgganaaagcctacccaaaactcatgtattttangatgtacaaataacgtccggccctgaggttgtttcctcatcgtcttctctcgcctccagtcgtctggacctacgaccgtccctccctacgacctactctcgtacgacctccgngtcgtgacgggacgaggtcacgaccgagtccgtccgtccccgtacgtctcctctccgttccccnccttccgtcactcacgttntacgnggacggcggctcgggaccgaacggcgacgacgngncgnntn

SEQ ID NO: 217856 - DNA, 650 bp, Homo sapiens
  misc_feature: GYAE6OF02HEI3D.34.28.C06.1.454.CMB.1.raw
  modified_base (239)..(239): a, c, t, g, unknown or other
  misc_feature (239)..(239): n is a, c, g, or t
  modified_base (288)..(288): a, c, t, g, unknown or other
  misc_feature (288)..(288): n is a, c, g, or t
  modified_base (313)..(313): a, c, t, g, unknown or other
  misc_feature (313)..(313): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcaggctgcctccgtgtcgtgggtctccgtggacagtcgatccaccatcctcctgcacgtacgtaaccggnagtgtacgttgatgtattatagtctgtctcgtgtaccaacacacccganaagcctaccaactcatagtatttanagatagtacaatacgtccgaccctagtaggttcgtttccacgtactcgtcttactcgtcgtcctcagttgtcgtcgacctaaccgtacccggtccctccgtacgacctatcctcgtacgtcctacgacgcgtcggaacggtacggacggttcgtagttaactttagttacgttcgactacgtcctacgaacctaactaaacctaacctaacgttaaaccctctttacggtttcgggtttaccgggaccggggtaacggtaccttacgggtacccgtaccgttaaccgaccgtacgaccgtaacccgaccggtcccgtcccgtcccggtacgtacccg

SEQ ID NO: 217857 - DNA, 612 bp, Homo sapiens
  misc_feature: GYAE6OF02HRTF4.34.28.C06.1.454.CMB.1.raw
  modified_base (230)..(230): a, c, t, g, unknown or other
  misc_feature (230)..(230): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (602)..(602): a, c, t, g, unknown or other
  misc_feature (602)..(602): n is a, c, g, or t
  modified_base (607)..(607): a, c, t, g, unknown or other
  misc_feature (607)..(607): n is a, c, g, or t
  modified_base (611)..(611): a, c, t, g, unknown or other
  misc_feature (611)..(611): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattataagtctgtctcctggtaccaacaccacccggnaaacgcctaccaaactcatgtatttangatgtacaatactcgcctgtaggttntttcnctatccgtacttctctcgcctcatcgtctacggcaacgccggtccctcctacgactactctacgtcgaccttccgacggtacgttacgggaacggtacgaacgggttaccgaccggtaccgaacggtccgtcccggtacccccgttcggtacctaccgttcccgtcccgttacccctacccttccctacgtacctccgtaccgttacgtaccgtcggtaccggcggtccgttacggaccggtaacggccgtacgtacggtacgnggtcngagng

SEQ ID NO: 217858 - DNA, 694 bp, Homo sapiens
  misc_feature: GYAE6OF02HPEH5.34.28.C06.1.454.CMB.1.raw
  modified_base (250)..(250): a, c, t, g, unknown or other
  misc_feature (250)..(250): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctgccctgactcaggctgcctccgtgtctgggtctcctggacagtcgatcaccatctcctgcactgtaaccggcagtgacgttggtcattangactatgtctcctggtaccaacattacccagcaaagcccccaaatccattatttatgatgtcgctacgtcggccctcgtaggggtttctaatcgtcttctctggtctcaagtcttggacaacgcggccctccccgacgtacctctccgtcggtcgtcccgtacggcgtcgacgggacggacgggacgtcgtagttacttattacgtcgaacgtcgtactacgaacttaaccgaaacctaaccgttaaacttaccttaccgtttacgggtttttaccgggttccggggaaacggtaaccgggtaacgttaccgggttacccgttacccgttacccggttaacccggtacgtaccccggaacccggtaccggttacccggtcccccgggttccccggtacccggttacccgttacccgtttaccccggttaccccgttaccccccg

SEQ ID NO: 217859 - DNA, 585 bp, Homo sapiens
  misc_feature: GYAE6OF02GI9RV.34.28.C06.1.454.CMB.1.raw
  modified_base (343)..(343): a, c, t, g, unknown or other
  misc_feature (343)..(343): n is a, c, g, or t
  modified_base (578)..(578): a, c, t, g, unknown or other
  misc_feature (578)..(578): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaaagcctacccaaactcatgatttatgatgtacaataactccggccctgtaggttgtttcncatcgtcttctctcgcctccatcgtctggacaaccgaccggtccctccctagaccctacttcctcgtcggacctccgacggtcgtggaacggacggacgggtcgacgacccgaacggtcctccgccccccgttcggtaccaccgttccgttccggttccccgcccttcctccactccgtacgttcgtactcggacggtccggtaccgtcgggacgacggtcgacgtacgtaacgncgagntn

SEQ ID NO: 217860 - DNA, 623 bp, Homo sapiens
  misc_feature: GYAE6OF02FVYGI.34.28.C06.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (278)..(278): a, c, t, g, unknown or other
  misc_feature (278)..(278): n is a, c, g, or t
  modified_base (343)..(343): a, c, t, g, unknown or other
  misc_feature (343)..(343): n is a, c, g, or t
  modified_base (617)..(617): a, c, t, g, unknown or other
  misc_feature (617)..(617): n is a, c, g, or t
  modified_base (622)..(622): a, c, t, g, unknown or other
  misc_feature (622)..(622): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctctcactcagggcacagggtcctgggcccagtctgccctgactcaggctgcctccgtgtctgggtctcctggacagtcgatcaccntctcctgcactgtaaccgcagtgacgttgatgattanagtctgtctctggtaccaacaaccgcccgganaagcctacccaaatcatgtatttatgatgtactaatacgtccggacccttagtaggtttctttcncgtacgttccgtcctttctctcgtccctacgtagttcgtcgtcggaccaaaccgtccggtcccctacctacgtacctacttcctcgtcggacctccgaggtcgtaggacggacggtacggtacgaccggaccgtaacgggcctccgtacccccgttggtcctaccgttccgttcccgttaccccacccttcctactacgtacgtacgttacgttacgacggtaccggtcgggtccgtacggaaccggtacggccgtacgtacggtacgcgtacngtacnc

SEQ ID NO: 217861 - DNA, 778 bp, Homo sapiens
  misc_feature: GYAE6OF02JYD8P.34.28.C06.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
  modified_base (295)..(295): a, c, t, g, unknown or other
  misc_feature (295)..(295): n is a, c, g, or t
  modified_base (328)..(328): a, c, t, g, unknown or other
  misc_feature (328)..(328): n is a, c, g, or t
  modified_base (371)..(371): a, c, t, g, unknown or other
  misc_feature (371)..(371): n is a, c, g, or t
tcagtacacgtgatcacgaccggtgctcgatttagagctcacgtattgggtttggggggggtctcaggaggcagcgctctcgggacgtctccaccgatggcctgggctctgctattcctcaccctctcactcagggcacgagggtcctggcccagtctgccctgactcaggctgcctccgtatctgggtctcctggacngtcatcaccntctcctgctacgtgtaaccggnagtgtacgttgatagtattagtagtctagtcgtacgtcggtaacaacgtaaccgaccccggtanaaacgtcctaccctaaatctacgtagtacttancgtaagtctactaacgacgtcggcctacgtcggtacggtttanactacgtccgtactgtacctcgtaccctcgtaatcgtacgttcgaaccgtaaaccgtcccgggtaccttacccgtacggtaaccctaagttcccgtcggttaacgtaacccgtccggtaaacggtacccgtaaggtccgggttaaaaccggtgggtttaaccggtaactttaaccggttccgttaacgggtcccttaacggttaacccgtaacggtttaaccttacgtaacccggttacccttaacgtcccgggtaaacccttccggttaaccggtaaaccccgttgttacgggttaacctttggggttaaacccggccggttaaacggtaacccctaaaccgtaccggtttccccggtaccgtttaccgtacccggtaaccggtacccgtaaaggttccccccggg

SEQ ID NO: 217862 - DNA, 805 bp, Homo sapiens
  misc_feature: GYAE6OF02HAVHK.34.28.C06.1.454.CMB.1.raw
  modified_base (290)..(290): a, c, t, g, unknown or other
  misc_feature (290)..(290): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcacatctctgcactcgtaaccggcagtgacgttgatgaattagtaagtcttgtctccgtcggtaaccaaccaaccgaccccgganaaacgtccctacccaaaactcattacgtattttagagtatgtaacaaattaacgtccggcccttagtacgggtttctttacctacgtacttccgtctttactccgtacgtcccctttacgagttcgttacgacggtaacccgaaccggtacccgtcccgttacccgtaccggtaaacccctacgtttacccgtacccggttaccgggtaaccccgttcccggtaagggtcccgttaacgggggaaacggggtacgggttaacgggggttaacgtttaacgttttaaacttaccggttcgtacccggttaccttacgtaagttaccttaacgtacccttaccgtaccgtccgtacccttaccgttacgttaccgtaggtttacgtacgggttttaccgggtttccggggaaccggggttaaccgtaaaccccgttaaccgttacccggtaaccccggttttacccggttcccggtaacccgtaaccccgggtaccccggtaaggtttaccccccgg

SEQ ID NO: 217863 - DNA, 617 bp, Homo sapiens
  misc_feature: GYAE6OF02GCAEA.34.28.C06.1.454.CMB.1.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggnagtgacgttgatgattataagtctgtctctggtaccaacaacaccccggacaaagctacccaaactcatgtatttangatgtacaataactccggccctcgaggttntttcnctatcgtcttctctcgtcctcatgtctggaccaacgccggtccctccctgaccctactcctctacggacctccgaggaccgtaggaacggtacggtaaggggttacgtagtttaacttaccgtcgtccgtacctactacttaacgttacctacttacctacgtcgtacctaccttcgtacgtattgtagttacggtttcgggacggtaacgggaacccttaaacgtccgtacccgttaccgttccggtaccgtaccggtacccgaacggtccccg

SEQ ID NO: 217864 - DNA, 631 bp, Homo sapiens
  misc_feature: GYAE6OF02H7Q1Y.34.28.C06.1.454.CMB.1.raw
  modified_base (249)..(249): a, c, t, g, unknown or other
  misc_feature (249)..(249): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacaggtcctgggcccagtctgccctgactcaggctgcctccgtgtctgggtctcctggacagtcgattacatctcctgcactggaaccagcaggtgacgttggtacattangtactatgtctcctggtaccaacacttaccaggacaaacgaccccaaactacaactttatttactgatcgtcgctacgtccgtcctcgtagggtttactaacgtcgcttctctggtcctcgtaacgtctggactaaaccacggtccctcccgtcgaccctattccgttcgtacgggtcctaccgacggtcgtacggacggtacggaggtccgtagtatttaattacttgacacgtctacacactaaccaaacctattaaccacgttcgtttcgggtttcgggacgggtaacggtaacgtaggttacgaccgttaccgtcgtaccgtacgacccgtaacggcgtaccgtcccccgtcgtacctaccttccgtccttacccccg

SEQ ID NO: 217865 - DNA, 664 bp, Homo sapiens
  misc_feature: GYAE6OF02IV7Q2.34.28.C06.1.454.CMB.1.raw
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
  modified_base (514)..(514): a, c, t, g, unknown or other
  misc_feature (514)..(514): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcactgtaaccggcagtgacgttgatgaattataagtctgtctcctggtaaccaaacaaccacccccgganaaaacgcctacccaaaactcactgtaactttangtatgtactaaataacgtccggcctagaggttgtttctctatcgtctttactccgtcgtcctacctattgtactcggactaaaccggaccggtccctcccgtagtaccctagtccttacgtcggaccttcccgagggtccgtacggaagggaccgtaggggttactaattttacttacgtcgaccgtacccttanaacgttactacctagttccaccgttcaccctacttaccgtggtaacttggtaacgtttacgggttttccggggaaccggtaacggtaaacccctaaccgttccgttaaccgtttcccggtttacgaccgtaaccgacccgtacggtcccg

SEQ ID NO: 217866 - DNA, 694 bp, Homo sapiens
  misc_feature: GYAE6OF02F4SKL.34.28.C06.1.454.CMB.1.raw
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctctggacagtcgatcaccatctcctgcactgtaaccggcagtgacgttgatgattataagtctgtctcctggtaccaacaaccaccccggcaaagcctacccaaactcaatgtatttatgatagtcaaataatccggtccctcgtaggttgttttctcctacgttccgtctttcttccgtcgtaccctcctattcggtactaggacccaaaccgcccggtaccctccccgtacgacctacttcctcgtcggtcctaccgaggtccgtaggacggtaacgggtacggggttataacgtttacttaaccggtcgtacccggtccctttaactaacttaacttaacctactttaccgaaccttccgtaccctaccgttccgttaccggtagtttggttaccggtttacggttttccggggtaaccggggtaacgggtaacccctaaacgttcccgtaaccgttccccgtttacggtacccgtaacccgtacccggaacggttccccg

SEQ ID NO: 217867 - DNA, 631 bp, Homo sapiens
  misc_feature: GYAE6OF02G92AY.34.28.C06.1.454.CMB.1.raw
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
  modified_base (376)..(376): a, c, t, g, unknown or other
  misc_feature (376)..(376): n is a, c, g, or t
tcagtacacgtgatcacgaccggtgctcgatttagagctcacgtattgggtttggggggggggtctcaggaggcagcgctctcgggacgtctccaccatgggcctgggctctgctattccttccaccctccctccactcagggcgacagggtccgtcgggccgacgtctcgcctcgactcacggcgtcgtccgtcccgtcgttcgttcggggtcgtccgtcggtacgacgtcgatcaccactctcctgcactcgtaaccggcagtcgtacgttgatgtattataagtctgtctctggtaccaacaacacccgcgaaanctcccaaactacatcgtatttntagatagtctaataatccggtcctcgagtgttttcnctactcgtctctctcgcctcattcgtctcggacaaccaccggtccctacctcgactactcctcgtcgccgtccgacggtcgtacgtagggacggtaagggtcgtaattgttaccgtgtccgtccctcgtaatacttactacttctactcgtaccttacctcgttcgacgttgtacggttggttttacgggcgggaacgggaacccttaacgtccctacccggttccgttactcccggcgtacccgaggtccccgg

SEQ ID NO: 217868 - DNA, 620 bp, Homo sapiens
  misc_feature: GYAE6OF02HLUEK.34.28.C06.1.454.CMB.1.raw
  modified_base (229)..(229): a, c, t, g, unknown or other
  misc_feature (229)..(229): n is a, c, g, or t
  modified_base (285)..(285): a, c, t, g, unknown or other
  misc_feature (285)..(285): n is a, c, g, or t
  modified_base (425)..(425): a, c, t, g, unknown or other
  misc_feature (425)..(425): n is a, c, g, or t
  modified_base (451)..(451): a, c, t, g, unknown or other
  misc_feature (451)..(451): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctccgtggacagtcgatcaccatctcctgcactgaaccgnagtgacgttgatgtattagtagtctgtctccgtgtaaccaacaaccgaccccgganaaacgcctaccctaaactcatacgtattttagagattcgtaactaactaacgtccggtccctagttacggttctttactctagttccttccttctctcgtaccctcgtatcgtcgtcgaccaacgtcccgcctcccgtanaccttactctcgtacggtcctaccgnggtctagggaacggtaggtaggttataacgttacttacgcgacctcgtaactattaactacctacgttaccacgtacgcctacctcgtactgtacgttgttacggttcggaccggtaacgtaccttaaccgtcccgtacgttccctgtacctacgacccgtagccccgg

SEQ ID NO: 217869 - DNA, 633 bp, Homo sapiens
  misc_feature: GYAE6OF02GG13Y.34.28.C06.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (280)..(280): a, c, t, g, unknown or other
  misc_feature (280)..(280): n is a, c, g, or t
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctgccctgactcaggctgcctccgtgtcgtgggtctccgtggacngtcgatcacatctcctgcactcgtaaccgnagtgacgttgatgattatagtctgtctctcgtacaacaccgccgganaagctacccaatcatgtattangatgtacaatacgtcgccctgtaggttntttccnctacttcgtcttctcgtcgtccctcgatcgtcgacggaccaacgccggtcccctaccgtacgacctactcctacgtacgtaccctcggaggtcgtagggaacggacgggtaaggttacgttaactttacgttaccgtcgtacctcctaactagtaacttacgttcctacgtacctccgtacctaccttcgtacgtagttcgtacggttcggtttaccggggaaccggtaaccggtaaccttaaccgtccccgttaccgttaccgttccggtaccaccggtacccgtaccgttcccgg

SEQ ID NO: 217870 - DNA, 706 bp, Homo sapiens
  misc_feature: GYAE6OF02GFVZD.34.28.C06.1.454.CMB.1.raw
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctccgtggacagtcgatcaccatctcctgcactgtaaccggcagtgacgttgatgattataagtctgtctcctgaccaacaacaccccggaaagcctacccaaatcatgtattatgatgtactaagtactccggacccttgaggtttctttacctctacgttccgtcttccttcgtccgtccctaccgtatcggttcgtacgaccaaccgtccggtccccttcccgtacgaaccctacttccgttaccgtaccgggtacctacccggtacgggtaccgtagggtaaccgggtacgggtacggggttagttaacgttttaaccgttaccgtcgtcccgtaccgttactaaacttacgttaactactttaccgtacgttacccgtccctacgttaccgtacgttagttcggttagttaccgggttttacgggggaccggtaaaccggtaaccctaaccggttcccgttaacccgtttcccggtaccgtaccgaacccggtacccgacggttcccccgg

SEQ ID NO: 217871 - DNA, 713 bp, Homo sapiens
  misc_feature: GYAE6OF02IOE1K.34.28.C06.1.454.CMB.1.raw
  modified_base (202)..(202): a, c, t, g, unknown or other
  misc_feature (202)..(202): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctcgccctgactcaacctgcctccgtctctgggtctcctggacngtcgatcacctatcctcctgcacgtacggaaccacgctacgtggtaccggttgggttaggttagtgggttatcgtccttccgtacggtaaccgaactaactaccaacacgacacgaccgacccccctaacttactttaaattttcgacttcgtactaacttaacgtccggtaccgtacggttacgggtttcctacgtacgtccgtccttctcgtcgtcctacgtacgtcgtcggactacctcaccgtcccttccgtcggtcctacgtcgaccggtcgggtccggtaccgggtcgtaggacggtagtcggacgtcgtagttacttacgttacgtcgtacgttacgttccgttagacgaggtactacggtcgtagtcgttcggttacccgttttagttcggttaccggttacgggtaacgtacgggtaaccgtacggttcccgtaccggttaccgtaacggcccgtaaccggacccgaaccggtacccgtaacccgtacttccggtactcccg

SEQ ID NO: 217872 - DNA, 681 bp, Homo sapiens
  misc_feature: GYAE6OF02G0T19.34.28.C06.1.454.CMB.1.raw
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactcgtaaccggcagtgacgttgatgattataagtctgtctccgtggtaaccaacaaccaccccgacaaagctacccaaactcatgtatttatgatagtacaaataacgtccggcccctagtagggttctttctactatccgtcttctcgtctccctactagtcgtacgtacgaaccaccgtaccgtccctacctacgactactctcggtacctacgaccgagtcgacggtacggaacgggttaggtaatttacttacgtactccgtacgtacctaacttaacttaactacttaacctccgtaacctccgtaacttaccgtagtaacgttggttacgttaacgggtttaccgggttaacggggaaccggttaaaccggtaaaacccttacccgttaccccgtacccggtttttacccgtaaccggtaacccgtaacccggtaccgggtacccgttcccccgg

SEQ ID NO: 217873 - DNA, 696 bp, Homo sapiens
  misc_feature: GYAE6OF02G2GAS.34.28.C06.1.454.CMB.1.raw
  modified_base (294)..(294): a, c, t, g, unknown or other
  misc_feature (294)..(294): n is a, c, g, or t
  modified_base (323)..(323): a, c, t, g, unknown or other
  misc_feature (323)..(323): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcaggctgcctcgtgtcgtggtctcctggacagtcgatcacatctctgcactacgtaaccggcaggtcgacgttgatgtattagtaagtctgtcctccgtacgtaaccaacaaccgaccccgganaaccgcctaccaaactcagtagtatttangtatacgtacaatacgtccgcctagtacgttgttctctatcgtctccgttcgtcgtccctcgtacgttcgtccgtacggtacccaaccggtccggtacccctaccgtacgaccctactccttaccggtccgtacctccggacgtcgtacggagggtacggtagggttactagtttactacgtcgtacctactacgtaactacgtactagtttaccaacgttccgaccctaacgttcccgtaacgttagttacggttacggtttaccggtttccggggaaccggggtaacggtaaaccccttaaccgttacccgttacccgtttaccccgttacgtaccccggtaaccgggtacccgttaacccggtcccccgg

SEQ ID NO: 217874 - DNA, 639 bp, Homo sapiens
  misc_feature: GYAE6OF02JBZ8H.34.28.C06.1.454.CMB.1.raw
  modified_base (234)..(234): a, c, t, g, unknown or other
  misc_feature (234)..(234): n is a, c, g, or t
  modified_base (287)..(287): a, c, t, g, unknown or other
  misc_feature (287)..(287): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
tcagtacacgtgatcacgaccggtgctcgatttagagctcacgtattgggtttggggggggtcgtcaggaggcagcgctctcgggacgtctccaccatggcctgggctctgctattcctcaccctcctcactcagggcacagggtcctgggcccagtctgccctgactcaggctgcctcgtgtatgggtctcctggacagtcgatccaccatcctcctgaccactgtaaccggnagtgacgttgatgaattacaagtctgtctcctggtaccaacaaccaccccggnaaacgctaccccaactcatgatttangatgttcaataatccggccctcaggtgtttctcatcgtcttctcgtntcctaccatgtctggcctaaaccgccggtcccttccctcgacctactccgtcctcgggtacccttccgaagggtccgttacggacgggtaaccgggtagggggttacgtaacgttttaacgtttaaccgttacgtccggtccctaccgtaattaacgtacctattcgtaactcgccctactcttcgacttggttacgtacgttttcgggacggtacggaacgtaacccgtaacgtaccctacccgttccctttaccgtaccgtcgtaccccgtaacggg

SEQ ID NO: 217875 - DNA, 712 bp, Homo sapiens
  misc_feature: GYAE6OF02JXRVZ.34.28.C06.1.454.CMB.1.raw
  modified_base (393)..(393): a, c, t, g, unknown or other
  misc_feature (393)..(393): n is a, c, g, or t
tcagtacacgtgatcacgaccggtgctcgatttagagctcacgtattgggtttggggggggtctcgaggaggcagcgctctcgggacgtctccaccatggcctgggctctgctattcctcaccctcctcactcagggcacagggtcctgggcccagtctgccctgactcaggctgcctccgtgtctgggtctccgtggacagtcgactcaccatcctcctgccacgtcgtaaccggcagtgacgttgatgaattataagtctgtctcctaggtaaccaacaaccgaccccggacaaacgcctacccaaactcaatgtactttagtgtacttagtactaactaacgtcccggtaccctacgtaggtttcttactctacttcgtcttcctcgtcncccttactacttcgtcgtacgaccaaccgtccggtccctaccgtacgacctacttcctcgtacgtacctaccggtacggcgttaaggaaccgggtacgggtaggttacttaacgttacgttaccgtcggtcccgtacctacgtaacttaactacctacgttaccacgttaccgaccctacgttcgtacgtagttcgttaacggtttaccgggttaccgggaacgggttaaccggtaaaccccgttaaccgttaccccggttacccgttcccggttaccggtaaccggtaccccgggtaccccgtaaccggttcccccgg

SEQ ID NO: 217876 - DNA, 637 bp, Homo sapiens
  misc_feature: GYAE6OF02GHDDX.34.28.C06.1.454.CMB.1.raw
  modified_base (244)..(244): a, c, t, g, unknown or other
  misc_feature (244)..(244): n is a, c, g, or t
  modified_base (308)..(308): a, c, t, g, unknown or other
  misc_feature (308)..(308): n is a, c, g, or t
  modified_base (334)..(334): a, c, t, g, unknown or other
  misc_feature (334)..(334): n is a, c, g, or t
  modified_base (588)..(588): a, c, t, g, unknown or other
  misc_feature (588)..(588): n is a, c, g, or t
  modified_base (630)..(630): a, c, t, g, unknown or other
  misc_feature (630)..(630): n is a, c, g, or t
  modified_base (633)..(634): a, c, t, g, unknown or other
  misc_feature (633)..(634): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcaggctcgcctcgtgtctgggtcctccgtggacagtcgatccaccattcctcctgctacgttcggtaacccggntaggtgtacgttgatgtaattagtacgtctgtcctcgtacggtaaccaaacaaccgaccccganaaacgcctacctaactcatgtattangatgactaatacgtcgcctagtagttcgttctctactcgtcttcgtctcgtcctactagtcgtcgtcgaccaaccgtcccggtaccctccgtacgacctactccgtacgtaccggtacctaccgtacggttcgaagggaccgggtaacggtcggtaccgacggtaccgacggtcctaccccggtcccgtacgtccgtaccgttcccgttcccggtccccgtccctacgttccctacgtccgtacgtcggtaccncgggtacggcggtcgacggtaaccgacgtcgtactaggcgancgnntgg

SEQ ID NO: 217877 - DNA, 695 bp, Homo sapiens
  misc_feature: GYAE6OF02F0M3U.34.28.C06.1.454.CMB.1.raw
  modified_base (287)..(287): a, c, t, g, unknown or other
  misc_feature (287)..(287): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtcctccgtggacagtcgatccaccatcctcctgcactcggtaaccggcagtgacgttgatgattatagtctgtctctaggtaccaacaccacccgganaacgcctacccaaactcatgtatttagtgatgtactaatacgtccggtccctagtaggttcgtttcctctactcgtcttctctcgtcctcagttcgtcgtcgacaaccgtccggtcccctacgacgtacctcttccgtacgtcggtacctccgtaggtcgtacgggaacgggtacggtagggttaagtaacgttttacgtaccgtcgtaccgtcccgttactaagttaccttacgttaccttacgtaccgttccgaccctacgttcgtacgttacgtttacggttacggttttacgggtttccgggggaaccgggttaaaccggtaaaccccgttaacccgttacccgtttacccggtttcccggttaccggtaccgaacccgggttaccccggacggttccccccgg

SEQ ID NO: 217878 - DNA, 678 bp, Homo sapiens
  misc_feature: GYAE6OF02IYC76.34.28.C06.1.454.CMB.1.raw
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcaggcacagggtcctgggcccagtctgccctgactcaggctgcctccgtgtctgggtctcctggacagtcgatcaccatctcctgaccactcgtaaccgcagtgacgttgatgtattanaagtctgtctcgtgtaaccaacaaccacccgganaaancctaccaaactcaatgatttangtatacgtactaaataacgtccggtaccctgtaaggttctttactactacgttcgtcttctacgtcgtcctacagttcgtcgtcgaccaaaccgtccggtcccctaccgtacgtaacctactacctcgtacggtacctaccgacggtacgtacgggacggtacgggaacggttccgaccggacccgaacggtcccgtacccggcccccgttccggtaccctaccgttcccgttacccgttacccccgtaccccttcccgttaacctacctaccgttaccgttacgttaccgtacggtaaccgggtcgggtaccgtaccggggtaaacggtaaccgggacgtaccggaacggttacgtagacgtctagc

SEQ ID NO: 217879 - DNA, 773 bp, Homo sapiens
  misc_feature: GYAE6OF02HH78Y.34.28.C06.1.454.CMB.1.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctctcatcaggcacagggtcctgggcccagtctgccctgactcaggctgcctccgtgtctgggtcctccgtgacagtcgatcacntcgctnctactcgaaccggcagtcacgttgatagtatttacgtaagtccgttgtccgtacccgttaggtaacccaaaccgtaaccgacccccgggaataaaaccgtccgtaaaccccccaaaaattcctaaacggttagttaactttttacgacgtaatcggttaacctaaaggttaaacgtcccgggtaccccttacggtaggtttccgttttacctacctaacggtttccggtcttttccgactttcccggcccgtttaaaccgtagtttccggttaaccgtcggggtaaacccctttaaaccggaccccgggttaccctacccgttacgaacccgttacgtcccgtaacgttccgaaccgttccgacggtacgtaacggaacggtacggtacggttacgtacgttaacgttaccgtcggtccctacgtcgtaactaccttacgtactaccgtcgtacctccgtactacgtcgtagttgttcggttacggttccggaccggtaacgaaccgttaccgtaccgtacccgtttccgtacccgttcgaaccgtacgtccgtacccgg

SEQ ID NO: 217880 - DNA, 806 bp, Homo sapiens
  misc_feature: GYAE6OF02HC88L.34.28.C06.1.454.CMB.1.raw
  modified_base (215)..(215): a, c, t, g, unknown or other
  misc_feature (215)..(215): n is a, c, g, or t
  modified_base (358)..(358): a, c, t, g, unknown or other
  misc_feature (358)..(358): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcgagggcaacgagggtcctgggcccagtctgccctgactcaggctgcctccgtgtctgggtctccgtggactgtcgatcaccntcctctagactacgtacggtaaccgctaggtgtacggttgatgtaattaagtaacgtcttcgtcctccgtaggtaaccaaaccgaaccgtaaccccggataaaccgtcctaaccctaaaactcgtaacgttgttaaactttancgtaacgttacgtaactaaacttaacgtcccggtacccttacggttaggttacgttttccgtacgtacgtcccgttccgttttacctaacgttccgtacccgttcttaacgtttcggttacgtaccgggtaacccctaaacccggtaaacccggttccccgtttaaccccgtaccgtaaacccgtttacggtaccccgttaccgggtacccgttacccgtcggaacggttcggttaacgggacgggttaacggggttacgggttaacgtttaacgttacgttacgtacccgttaccgtctaaacgttataaccttatttaacctacgtctaaccgtccttacgtctacgatttcgtacggtttacggttcgggaccggttaacggaaacccgttaaccttccgtaccggttaccttacggcccgtaaccggtacgtacccggtcccgg

SEQ ID NO: 217881 - DNA, 175 bp, Homo sapiens
  misc_feature: GYAE6OF02F1A0V.34.28.C06.1.454.CMB.1.raw
  modified_base (167)..(175): a, c, t, g, unknown or other
  misc_feature (167)..(175): n is a, c, g, or t
tcagtacacgtgatcacgaccggtgctcgatttagagctcacgtattgggtttggagggtgtggtggtctccactcccgccttgacggggctgctatctgccccctcggtcactctgttcccgccctcctcatcacgtgtactgagcgggctggcaaggcgcatagnnnnnnnnn

SEQ ID NO: 217882 - DNA, 701 bp, Homo sapiens
  misc_feature: GYAE6OF02FXLFT.34.28.C06.1.454.CMB.1.raw
  modified_base (285)..(285): a, c, t, g, unknown or other
  misc_feature (285)..(285): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctgggacagtcgatcaccatcctcctgcactggtaaccggcagtgacgttgatgtattatagtctgtctcctggtaccaacaccaccccganaaagcctacccaaactcaatcgtatttatgattcgtactaataaacgtccggtcccctagtaggttcgtttacctactacgttacgtcctttctaccgttcgacccttaccctaattcggttctacgggacctaaacccgtacccggtccccttcccgtactaaccctactccttcgttacggaccttacccgacggtacgtacggtacgggaacgggtagggttagttatttacgttaccgtgtacccgtaccttactaattactaactacttaccgaccttacgaccctaccgttcctacgttattcggttagttaccggttttccgggacggtaaccgggtaaccctaaacccgtcccgttacccgtttaccgtttaccggtacccgtacccgtacccgtacggtacccccgg

SEQ ID NO: 217883 - DNA, 665 bp, Homo sapiens
  misc_feature: GYAE6OF02HTNNQ.34.28.C06.1.454.CMB.1.raw
  modified_base (395)..(395): a, c, t, g, unknown or other
  misc_feature (395)..(395): n is a, c, g, or t
  modified_base (462)..(462): a, c, t, g, unknown or other
  misc_feature (462)..(462): n is a, c, g, or t
  modified_base (561)..(561): a, c, t, g, unknown or other
  misc_feature (561)..(561): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctcgggcccagtctgccctgactcaggctgccctccgtgtcgtcgggtctccgtaggacagtcgatccacatcctctgacctacgttacggaaccgggcaggtgaacggtttgattgaattaattacgtctgtccgtcctcggtaacaaccaaccgaccccggacaaacgcctaaccctaaactcacgtagttactttagtagtatacgtaactaaactaacggtcccgtccgttagttcggttcttacnctacgtcttccttctctacgtccctactgtctacgtcggacctaaccgccgtccctccgtactaccncgttactccgtcgtaaccgtccgaggtcgtacggacgggacgggtaggttacgtaatttacgttcgtacgtcgtcctatactaacgtactacgttaccncgtcctacactccgttagcgttaggttccttaggtacggggtaccgtacggtaacctaaccgtccgtacgttcccgttagtcccgaccgtcgtacccgtcccgg

SEQ ID NO: 217884 - DNA, 662 bp, Homo sapiens
  misc_feature: GYAE6OF02HN2XZ.34.28.C06.1.454.CMB.1.raw
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (358)..(358): a, c, t, g, unknown or other
  misc_feature (358)..(358): n is a, c, g, or t
  modified_base (508)..(508): a, c, t, g, unknown or other
  misc_feature (508)..(508): n is a, c, g, or t
  modified_base (552)..(552): a, c, t, g, unknown or other
  misc_feature (552)..(552): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcacatctcctgcactcgtaaccggcagtcgacgttgatgattaatagtctgttctctcggtaccaacaccaccccgganaaacgccctaaccaactctatnttattagtacgtatagtactaagtaccgtccgtacctgtacgttgttaccntacgtcgtcttactctacgtcctacgagttccgtcgtaccgaccaaccgtcccgtaccttccgactaccgttctaccgttcggtacgtaccgcgacggtcgtacggacgggtaggtagttacgttattacgttacgtccgtcgtaacctntaattactacttactacgtactacctaccgtcaccggtttaagngtttacggtaacttttcgggggtaaccgggaccggtaactaaccccgtacgtttacccctacccgttcgggttaccccacggtaaccccgtaccgttacccggtaccccg

SEQ ID NO: 217885 - DNA, 684 bp, Homo sapiens
  misc_feature: GYAE6OF02F356A.34.28.C06.1.454.CMB.1.raw
  modified_base (379)..(379): a, c, t, g, unknown or other
  misc_feature (379)..(379): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtctgggtctccgtggacagtcgatcaccatcctctgcactgtaaccggcagtgacgttgatgtattataagtctgtctcctgtaccaacaaccaccccggacaagcctaccccaaactcatgtatttatgatcgtactaataacgtccggccctagtacggttgtttcctctacttcgtcctttctctcctcctacncttacgtctacggaccaacgtaccggtccctccctacacctactaccttccgtacggtaccgtaccgacgggtacgtacggacgggacgggagggttagtaaccgtttacgttaacgtccggtacccgtcccgttactacttaacttacgtaactttctacccgttcgtccctaccgttaccgtcgtaagttcggttacgttacggtttttccgggggaccggggttaaaccgggaaccctaaccgttacccgttacccggttccgtttccggtaccgtaacccggtacccgtaccggtccccgg

SEQ ID NO: 217886 - DNA, 655 bp, Homo sapiens
  misc_feature: GYAE6OF02F0HE2.34.28.C06.1.454.CMB.1.raw
  modified_base (356)..(356): a, c, t, g, unknown or other
  misc_feature (356)..(356): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctccgtggacagtcgatcaccatctctgcacgtcgtaaccggcagtcgtacgttgatgattataagtctgtcctctacgtaccaacaaccaccccggacaaacgcctacccaaactcatcgtatttagtgatgtactaatacgtccggtacctgtaggtttcttcntactcgtcttctctcgcctcgattcgtcgtcgacgtaaccgcgtccctccgtacgacctatcctacgtcgtaccgtccgaggtcgtaggacgggtacgagggttactagtttactacgtcgtccgtcctagtacgttaactacgtacttacgaccttcgacctaccgttcgaacgttgttacggttacggtttaccggtttccggggaaacgggtaaccccgggtaaaccctaaaccgtttcccggtaccccgtttcccgtttaccggacccgaacccggtaccccggtaggtcccccg

SEQ ID NO: 217887 - DNA, 757 bp, Homo sapiens
  misc_feature: GYAE6OF02JY4ZP.34.28.C06.1.454.CMB.1.raw
  modified_base (285)..(285): a, c, t, g, unknown or other
  misc_feature (285)..(285): n is a, c, g, or t
  modified_base (395)..(395): a, c, t, g, unknown or other
  misc_feature (395)..(395): n is a, c, g, or t
  modified_base (417)..(417): a, c, t, g, unknown or other
  misc_feature (417)..(417): n is a, c, g, or t
  modified_base (443)..(443): a, c, t, g, unknown or other
  misc_feature (443)..(443): n is a, c, g, or t
tcagtacacgtgatcacgaccggtgctcgatttagagctcacgtattggggtttgggggggggtcgtcaggaggcagcgctctcgggacgtctccaccatggcctgggctctgctattcctcaccctcctcactcgagggcacgacggtctcgggccagtctgccctgactcagctgccgtccgtgtctcgggtccttccgaggtactacggtcgataccacctatcctctcgctacgtcggtaaccggctaaggtgtaccgttgatcgtattaactagttcctntccgttccgtacggtaaacccaaacaacccgaccccggaacaaacgtcccacccaaactaccattacggttaacttaatcggtatcctaacaaactaacgtccggccctntacgggttctttcgaaccttanccgtccttctcgtacgccctacgttntcgtacgtgtaaccgacccgtacccgcccgttcctaacgtacctacgtaccgtacgtccgtaccgacgtacggtacggttaagggacgggtacgggtaaggttacgtttaagttacggttacctcggtacccgtaccgtaaccgttaataaccgttacttacctacctaccttacctaccttacctaccgttacgttacgttcggttacggtttaccgggttacgggtaaccgggtaaccggtaacccgttaacctacccggttacccgttacccggtccggtacccgtaaccggtacccggtaacgttccccg

SEQ ID NO: 217888 - DNA, 821 bp, Homo sapiens
  misc_feature: GYAE6OF02JF1EK.34.28.C06.1.454.CMB.1.raw
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtcctgccctgactcaggtctgcctccgtgtctgggtcctccgtggacagtcgatccaacctatcctcctgctacgtcgtaaaccgctagtgacgttgatagacttataacgtctacgtctccgtacggtaaccaacaacccgcccgganaaaccgcctaccaaccttctagttagtactttancgtaattgtaacctaaacgttaagcccgtacccgtacgtagggttactttcgtaacgtctccggttacttcttacgcgtacccgttaccctaagttccgttacgacgtacccgtaaccgaacccggtttccctccgttaacgacccttacgtaccgttacggtccgtaaccgtaccgtacggtcggttaaaccgtaacggggtaccgttaaggggtccgttaaacttttacgttacccgttacggtcccggttcccttaaacggttccttaaacgggttaaccttaacctttacccggacggttaccctaaacccgtttaacgtcccgttacgttaaaccgttccgggtttaagtttaacccgggttttacgggaaaccccgggtacggggttaaaccccccttaccggttaaccccgttacccggttacccgtttaccccggttaccgttaaccccggtacccgggttaccgttacccccgg

SEQ ID NO: 217889 - DNA, 621 bp, Homo sapiens
  misc_feature: GYAE6OF02F6UNM.34.28.C06.1.454.CMB.1.raw
  modified_base (258)..(258): a, c, t, g, unknown or other
  misc_feature (258)..(258): n is a, c, g, or t
  modified_base (407)..(407): a, c, t, g, unknown or other
  misc_feature (407)..(407): n is a, c, g, or t
tcagtacacgtgatcacgaccggtgctcgatttagagctcacgtattggggtttggggggggggtctcaggaggcagcgctctcgggacgtctccaccatggcctgggctctgctattcctcaccctcctcactcagggcacagggtcctgggcccaatctcgccctgactcagcctgcctccgtgtctgggtctcctggacagtcgacttacatcctcctgcacgtggaaccagcacggtgacgtttggactattancgactatgtctctcggtaccaactacttacccagacaaacgcccccaaactctaattacttatgtatgtacgctaggtccgccttgtacgggtttctaagtcgtcttctcgtcgcctcagtctggacaacgcgccctccgtacgacctntctcgcggtcctccgaggtcgtgaacgggacgaggtcgtagtatttattattcgcacgtcactacgtactaaccaactactactacgttcgtttacgggttacggcgggtaaacggaccgtaaggtttcgaccgtaccgtaacggtacgaaccgcccgtaaggcccgttacccgccccgtcggtaccctacgttacccgttacccgttaccccg

SEQ ID NO: 217890 - DNA, 649 bp, Homo sapiens
  misc_feature: GYAE6OF02JY8EY.34.28.C06.1.454.CMB.1.raw
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctctcactcagggcacgagggtcctgggcccagtctcgccctgactcaggctgcctccgtgtctgggtctcgtggacaggtcgatcaccatctctgcactggtaaccggcagtcggacgttgacttggattaactactcgtgttctccgtggtaaccaacaaccnccccgganaacgcctaccccgaaacttcgtataggtactttagaggtnttcgtaactaaactaacggtcccgtaccctaggttaaggttgtttaccgtctaacgttccgtctttccgtactcgtaccctacgtgttcgtacgtggacctaccgaccggtcctcccgttagacctactcttacgtccgacttcggacgtgtacgggacgtacgagggttactagttactgtcnccgtacnctacgtataccgttacttgaccgtcgtcctacgtcctagtagtgtcggttacgtcggaacgggttacgaacccgtactaccgtacccgttcggtaccgtacgcggttaaccgtcccggtccg

SEQ ID NO: 217891 - DNA, 680 bp, Homo sapiens
  misc_feature: GYAE6OF02JAIW8.34.28.C06.1.454.CMB.1.raw
  modified_base (244)..(244): a, c, t, g, unknown or other
  misc_feature (244)..(244): n is a, c, g, or t
  modified_base (277)..(277): a, c, t, g, unknown or other
  misc_feature (277)..(277): n is a, c, g, or t
  modified_base (308)..(308): a, c, t, g, unknown or other
  misc_feature (308)..(308): n is a, c, g, or t
  modified_base (351)..(351): a, c, t, g, unknown or other
  misc_feature (351)..(351): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctcgtgtctggtctcctggacagtcgatcacatctcctgcactgtaaccgcagtgacgttgatgattanagtctgtctcctgtaccaacaaccaccccgganaaacgcctacccaaactcagtagtatttacngattgtacaaataacgtccggtaccctgtaggtttcgttcctntaacgtccgttcttctctcgtccctacagttcgtctacggaccaaccgtccggtacccttccgtacgtaccctagtccgttacgtaccgggtccttaccgacgggtcgtagggtaaccgggtacgggttaagggttacgttaattttaacgttaaccggtcgcccgttaccttaacgtaacttaaacctcgtttaacgttaccgtacgtaccgtacccttaacggtctacgtagttcggttcggttaaccgtttcggggacgggaaaccgggtaacccttaacgtccgtacccgttcgttacccgtacgaccgtacccgtaggtccccg

SEQ ID NO: 217892 - DNA, 666 bp, Homo sapiens
  misc_feature: GYAE6OF02G3YMC.34.28.C06.1.454.CMB.1.raw
  modified_base (297)..(297): a, c, t, g, unknown or other
  misc_feature (297)..(297): n is a, c, g, or t
  modified_base (513)..(513): a, c, t, g, unknown or other
  misc_feature (513)..(513): n is a, c, g, or t
  modified_base (567)..(567): a, c, t, g, unknown or other
  misc_feature (567)..(567): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcgaggctgcctcgtgtctgggtctcgtggacagtcgatcacctatcctctgctacgtacggtaaccggcaggtgtacgttgatagtattaatagtctgtcctcgtacgtaaccaacaccgacccgganaaacgcctacccaatctaatcgtatttagagtatagtacaagttacgccgtccctagtacggttcttctacgacgttccgtcttacgtctaccgtaccgttactagttccggtaccgtcggaaccctaaccgacccggttaccctcccgtagacctaacttccgtcgtacgcctacgaggtcgagggtacggagtagggttatagttacgttacgngtacctctaagtactacttacgactttaccacgttacgaccctactcgttacgngtttagtcggtttaccggtaaccgggtacgggtaaccgtacccttaaccggtccctacccggtttcgtaccgaccgaacccggacccggtacgtccccg

SEQ ID NO: 217893 - DNA, 669 bp, Homo sapiens
  misc_feature: GYAE6OF02HKJT5.34.28.C06.1.454.CMB.1.raw
  modified_base (174)..(174): a, c, t, g, unknown or other
  misc_feature (174)..(174): n is a, c, g, or t
  modified_base (267)..(267): a, c, t, g, unknown or other
  misc_feature (267)..(267): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (373)..(373): a, c, t, g, unknown or other
  misc_feature (373)..(373): n is a, c, g, or t
  modified_base (396)..(396): a, c, t, g, unknown or other
  misc_feature (396)..(396): n is a, c, g, or t
tcagtacacgtgatcacgaccggtgctcgatttagagctcacgtattgggtttgggggggggttcggtcaggaggcagcgctctcgggacggtctccaccatggccgtgggctctgctattcctcaccctcctcactcagggcacagggtccgtgggcccagtctgccctgacncaggctgcctccgtgtcgtcggtctctggacacgtcgatcaccactctcctgcactcgtaccggacagtcgtacgtgaatggtattaatagtnttgtctcctaggtaaccaaacaaccaccccggacaaagacctacccaaaactcagtagtatttanagtagtntaacaataacgtccggtcctcgtagttgttcctnacgtacgtctctcgtcaccgtcngtcgtctgacctacacgtccgttcccatacctactcgtactcgtacctccgaaggtcgaaggtacgggacgagggttcgtaattaacgttaacgcgtaccgtcctacgtaactaattaccacgttaccgtaactcgtacccgtaccttaccgtcgttacgtgttaccggtttacggtttccggggaaccggtaaacggggtaacccctaaacccggtaaccgtcccggttacccgtaggttaaccgtacggtacccgtaacccggtaacccgg

SEQ ID NO: 217894 - DNA, 747 bp, Homo sapiens
  misc_feature: GYAE6OF02FLRER.34.28.C06.1.454.CMB.1.raw
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
tcagtacacgtgatcacgaccggtgctcgatttagagctcacgtattgggtttgggggggggtcgtcaggaggcagcgctctcgggacgtctccaccatggcctgggctctgctattcctcaccctcctcactcagggcacagggtcctgggcccagtctgccctgactcaggctgccttccgtgtctgggtctcctggaccagtcgatcaccatcctcctgcactggtaaacccgnagtgacttgatgtaattanaagttctgtcctcgttacggtaccaaacgtaaccaccccggctaaaagtccctcccctaaaactcctaatgtatttaacttgaatcggttacaaagttaacgtcccggtacccttcgtaggtttcgtttcgtctacttaccgtctttctcgttcgccctccctaagttccgttcgttaccgggacaaaccgtacccggtacccctcccgttaaccgtaacccgtaacttccttaccgttcggtaacccgttccgtaacggggtacttacggtacgggaccgggttaaacggggttgaacgttttaacgtttacgttcgtacccgtacctaccttaactaaccgttactactttaccaacgttccgacctaccttccttacggtactttcggtcggtttacggtttccggggaaccggtaaccggggtaacccgtaaaccgtacccgtaccgttcccgttaccgttacgaccggtacccgtaacggtccccg

SEQ ID NO: 217895 - DNA, 837 bp, Homo sapiens
  misc_feature: GYAE6OF02F0JTW.34.28.C06.1.454.CMB.1.raw
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacgagggtcctgggcccaggtctgccctgactcaggctgcctcgtgtctggttctccgtggacagtcgatcaccatcctcctgctacgtacgtaaccggcaggtgacgttgatagtatttaagtaacgttcgtagttcctccgtacggtaacccaaacctaacccgacccccggaacaaaacgtccctaaccccgaaactcaagttagttactttaagtagtagttacgtaactaaagtaaccgtccggtaccccttaggttacgggtttctttacctacgtacgtttccgttccttttccgtccgttacccgtccccgttacgtaaggtttccggtaccgtacgggtaaccctaaacccggtcccccggttaccccttacccgtacgtaacccttacgtttcccgttacggtaccggtaacccttacccggtacgggtaaccggtacggggtaaccggggtaccgggttaaggggttaacttaacggttttacccgttaaccggtccgacccgttaccttaaacgtaccttaacgtaccgtttaaccttacccgtaacgttcccgtaacccttaccggttacgttaccggttaagttcgggttacggtttacggttccggggaaacggtaccggtaacccttaaccgttcccgtaccgtttccgttaccggacctacccggtaccgtccggttccccg

SEQ ID NO: 217896 - DNA, 681 bp, Homo sapiens
  misc_feature: GYAE6OF02FJIHG.34.28.C06.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (381)..(381): a, c, t, g, unknown or other
  misc_feature (381)..(381): n is a, c, g, or t
tcagtacacgtgatcacgaccggtgctcgatttagagctcacgtattggggtttggggggggtctcaggaggcagcgctctcgggacgtctccaccatggcctgggctctgctattcctcaccctctcactcagggcacagggtcctgggcccagtctgccctgactcaggctgcctccgtgtctgggtctcctggacngtcatcaccatcctctgctacgtcgtaaccggnagtgacgttgatgatttacgtaagtctgtacctcctaggtaacccaacaacccaccccggacaaaacgtccctaccccaaaactcgtaatggtaatttatgtatacgtacaaattacgtccggtaccctcgtagggtttcgtttacctntacgttccgtacccttcttccgtcgtacccttctagttcgtcgttaccggacctaacctcccggtccctacccgtagaccctacgtcctacgtcggtacctcggagtaccgtggacggacggtaggtatacttactcgcgtcctacgtactattactactcttaaccgacgttacgacctacgtacccgtgtagttacgttaggttaccggtttacgggaaccggtaaccggtaaacctaacgtcccgttaccccggttacgtttacccgaccgtaacccggtacccggagttaccccgg

SEQ ID NO: 217897 - DNA, 1018 bp, Homo sapiens
  misc_feature: GYAE6OF02IMB4A.34.28.C06.1.454.CMB.1.raw
  modified_base (192)..(192): a, c, t, g, unknown or other
  misc_feature (192)..(192): n is a, c, g, or t
  modified_base (261)..(261): a, c, t, g, unknown or other
  misc_feature (261)..(261): n is a, c, g, or t
  modified_base (771)..(771): a, c, t, g, unknown or other
  misc_feature (771)..(771): n is a, c, g, or t
tcagtacacgtgatcacgaccggtgctcgatttagagctcacgtattggggtttggggggggtctcaggaggcagcgctctcgggacgtctccaccatggcctgggctctgctattccctcaccctcctcactcagggcacgagggtcctcgggcccagtctggtgcctaggaccgcaacgcccgccctacngttgtccgtcggggccccaggggaccaggtacgggtccaccgtaattcctccgcgtccgaacgtggganaccgacggacctacccgaaaccgacggtaccgggaccttagggttaattcgtaacgttaccggtaacctaacggttaccggttaaacaaccgtacgtaaccggttacccttaacccggaaacgggaaacccacccccggtaaaacccccctaaaaccccgttacccgttacccttacttaaccgttagtaaacccgtaacccgttaaaaaccccgtaaccgtaaacccggttcccccgggacccgtttaacccggggtaaccccggggtttccctaaaccgggtacccttttacctttcccggtaccgtacccctaaccgttaacggtccgtaacgtcctaacctacgtacccggtccccgttaccgtaaccggtttataaccggttttacgttacccggtaccccttaccgggacccgtttaacccgggtaaggtaacgggttacctagggggtaaccttacgttaaccgtttaaacgtttttaccttaccggttcgtaaaacccgttnttaaacccgttacgtaaccgtaaccggtaacccccttaaaccgggttaccggggggttaccgggttcccggggttaaaccggggtacccgggggtaaccggtaaaccggtaaccgggttcccggttaacccggccggtaaacccccggttttccggaacggtaccctacccgggttaaacccgaccggtttaacccgggcccccgtaccccgggttttaacccccgttagggtcccctttaacccgg

SEQ ID NO: 217898 - DNA, 731 bp, Homo sapiens
  misc_feature: GYAE6OF02JYOPG.34.28.C06.1.454.CMB.1.raw
  modified_base (311)..(311): a, c, t, g, unknown or other
  misc_feature (311)..(311): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (389)..(389): a, c, t, g, unknown or other
  misc_feature (389)..(389): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccaggtctcgcccgtgactcaggctggcctcggtgtctgggtctccgtaggacaggttcactccacctattcctcctgactacgtaggtaaacccggcaggtacgcggttgaatgtattaactagtctgtctcacggtaaccaaacaccgacccganaaacgtcctaaccaaacncgtagtagtaatttacngtagtctacaaattaccgtccggacctgtaacgttgtttaccntactctacttccgtctaccgtctacgtgttcgtcgtaacgacccgtaccggacccgtcccttccgtactaccgtacttccggtcgtccggtaccgtccgacggtcgtaacgggtacggtacgggacggttagttacttaacggttaccgacggtacccgttcgttaaccaacgtttacctaaaccgtttctaccgaacgttccgtaaccctacttaccgtaggttaccgttagttacgggtttacgggtacccgggtaaacgtaaaccgggtaacccttaaacggttacccctacggtttcccgtaaccgtccggtaaccccggtacccgtcggttaccccg

SEQ ID NO: 217899 - DNA, 765 bp, Homo sapiens
  misc_feature: GYAE6OF02HAIT0.34.28.C06.1.454.CMB.1.raw
  modified_base (247)..(247): a, c, t, g, unknown or other
  misc_feature (247)..(247): n is a, c, g, or t
  modified_base (321)..(321): a, c, t, g, unknown or other
  misc_feature (321)..(321): n is a, c, g, or t
  modified_base (414)..(414): a, c, t, g, unknown or other
  misc_feature (414)..(414): n is a, c, g, or t
  modified_base (488)..(488): a, c, t, g, unknown or other
  misc_feature (488)..(488): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcgagggcacgtagggtcctgggcccagtcctgccctgactcaggctgcctcgtgtcgtgggtcctccgtggacaggtcatccaccgtattctacctgcctacgtcggtaaccgnagtcgtacttgatagtaacttataacgttcttcgtccttaccgtacgtaaccaaacctacccggaccccggaanaaacgccctaaccccaaatctaagttagttaacttttagacggtattaacgtaactaactaacgtcccgaccttagtacgggttttcttaccncgtacgtcttccttctcgtaacgtccctagttacgtccgttcgaaccggtaaccctaccggcccggtttacccncccggtaataccgtcttaccgcgtccgtaaccgcggttacgggacgtacgggaagggtacggttagggtaacttacgtttacgtacccgtcggacccttacgactttaacgtaaccttacttaccttcgaaccgttcctacccgtaacgttcgtcgttagtttccggtagttacccgggttaccggggaaccggtaacccgtaaacccgttaacccttccggggttaaccccttccgtaccggtaacccggtcccgtaccgtacccgggtcccccgg

SEQ ID NO: 217900 - DNA, 752 bp, Homo sapiens
  misc_feature: GYAE6OF02FLJI0.34.28.C06.1.454.CMB.1.raw
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcaggctgcctcgtgtctgggtctcgtggacagtcgatcaccatctcctgacactcggtaaccgntacggtntacggttgatgaattagtaagttctcgtcctacgtacggtaaccaaacaaccgaccccggacaaacgtcctaacccaaactctagtacgttaatttaggtagtacttaggtaacctaaaacgtacggttcccggtacccttacggttacgggttttctttcctacgtacgtttccggttccccttttcgtccccgttacggtacccctttacccgtaagttttaccgggtccgttaacggggaaaccctaaaccccgggtccccggtcccctttacccgtaccgaaccttacgtccccgttaacgtcggtaacccgttaccggaggtacccgggtaggaaccggggtaaccggttagggttacttaacgtttaaccgttccggtcggtacctaccctattaactacgtacttacgttacctcgtactaccgtctgtactgttcgttacgtacggtcgggacgaacggtaccacgtcctacgttccgtacgaccgtaccgtaccgattcccgg

SEQ ID NO: 217901 - DNA, 913 bp, Homo sapiens
  misc_feature: GYAE6OF02IQI9G.34.28.C06.1.454.CMB.1.raw
  modified_base (255)..(255): a, c, t, g, unknown or other
  misc_feature (255)..(255): n is a, c, g, or t
  modified_base (332)..(332): a, c, t, g, unknown or other
  misc_feature (332)..(332): n is a, c, g, or t
tcagtacacgtgatcacgaccggtgctcgatttagagctcacgtattggggtttggggggggggtctcaggaggcagcgctctcgggacgtctccaccatggcctgggctctgctattcctcaccctcctcactcaggcacagggtcctgggcccagtctgccctgactcaggctgcctcgtgtcgtgggtctccgtgacagtcgatccaccatcctcctgacctacgtacgtaaccggctaggtcgtacggttnagtgtaattacgtaagttccttggtcccttaccgtacgggtaaaccccaaaaccgtaaaccccgaaccccccggtanaaaacccgcccttaaacccccaaaccgtttacaacgttagttaaacgtttttaagcggtaacttacgtaacgttaaaacgtaccgttccccggtacccccttaggttaacggggttttcctttaccaaccgtacgtttcccgttactttacttccgtccggtccctttaccgtaggtttcttacgtacccggaactaaaccccggtcccggtaccccctttaccggtacctaaccggtccttaaccgtccgtaccggtacccgtacggtacggtacgtaacgggacgggtacgggtaaggttacgttactttaccggttacgtccgtccctaacttacgtaacttaactaaccgtttacttacccgtaacgttaccccgacctttaaacccgtccgttaacgtttaccgttacggggtttaaccgggttttaccggggtttaacccgggggtaaaccccggggtaaaccgggttaaaaaccccccgttaaccgggtttccccgtttaaccccgggttttccccgttaacggtaaacccccgggtaacccggttaacccggtccccgggttaacccccccgg

SEQ ID NO: 217902 - DNA, 725 bp, Homo sapiens
  misc_feature: GYAE6OF02FP69Y.34.28.C06.1.454.CMB.1.raw
  modified_base (211)..(211): a, c, t, g, unknown or other
  misc_feature (211)..(211): n is a, c, g, or t
  modified_base (255)..(255): a, c, t, g, unknown or other
  misc_feature (255)..(255): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccntctcctgcactgtaaccggcagtgacgttgattgattataagtntcgtctcctggtaccaacaccaccccggcaaagcctacccaaactcatgtattatgatgtacaataactccggtcccttgtaggttctttctctacttcgtcttctctccgtccctccgtatcgttacgtacggacctaaccgtacccggtcccctcccgtacgtaccctactcccttcgtcggtacccgtaccgacggtccttacggggacggtacggggtaagggttacgttaattaacgtttacgtcgtccgtccttacctacttaacgtacctactttaccgtaccgttaccgtacccgttaccttaccgttacgttacggttacggtttacgttaccgggtttttacggggaacccgggttaaccgggttaaaccccgttaaacccgttacccccggtttaccccgttccccggtttaacccggtacccgtaaccccggtaccccggtaaccggttaccccccgg

SEQ ID NO: 217903 - DNA, 735 bp, Homo sapiens
  misc_feature: GYAE6OF02FKUY8.34.28.C06.1.454.CMB.1.raw
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgctacgtgtaaccggcaggtacgtacgttagatggtaatttataagttcgtcgtaccttccgtaggtaacccaacaaccgaccccggacaaaacgcctaccccaaactccattagtatttaactgattgactaaagtaacgcggtccctgaaggtttcgtttcnctagtccgtcttcnctccgtctcccattcgtacgtacggaccaacgtaccgggtcccctaccgtaccgtacctacgtccttacggtaccgtaacccgttcgaacgggtccgtaggggtacggtaacgggtaacgggttacgttaacgttttaaccgttcgttcgtacccgtacctaacgttactaagttaaccctagtttacctaacgttccgtaccctaaccgttccgttaacccgtgtttaccggtcgttttaaccgggtttaaccggggaccgggtaaacccggtaaacccgtaaccgttaccgttacccggtaccgtttaccgtaccggaccgtacccggaacgtccccgg

SEQ ID NO: 217904 - DNA, 629 bp, Homo sapiens
  misc_feature: GYAE6OF02GRE6Y.34.28.C06.1.454.CMB.1.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
  modified_base (467)..(467): a, c, t, g, unknown or other
  misc_feature (467)..(467): n is a, c, g, or t
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
  modified_base (555)..(555): a, c, t, g, unknown or other
  misc_feature (555)..(555): n is a, c, g, or t
  modified_base (593)..(593): a, c, t, g, unknown or other
  misc_feature (593)..(593): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcaggctgcctcgtgtctggtctctggacngtcatcaccatctctgcactagtaaccgcagtgtacgttgatgtattaatagtctgtcctcgtcgtaccaacaacgaccccganaacgtcctaccaactnatgtaatttancgatagacaacgttacgtccgacccttgtacggttntttacctcgacttccgtacttcctcgtccgtccctaccgtattcgtaccgtacggtacctaaaccggtccccggttccctacccgttacgacccttacttcctaacggtccgtactaccgngggtaaccgtggaacgggaacggtgggtaattattacgttacgcgtcctcctagtactaatctctaccnccttcgcctctntacgttntcgtacgttcggttcgggaacgtaccgaaccttaccgngtcccttcgtacctaccggccgtaccgcgttccccg

SEQ ID NO: 217905 - DNA, 695 bp, Homo sapiens
  misc_feature: GYAE6OF02FNQMX.34.28.C06.1.454.CMB.1.raw
  modified_base (233)..(233): a, c, t, g, unknown or other
  misc_feature (233)..(233): n is a, c, g, or t
  modified_base (290)..(290): a, c, t, g, unknown or other
  misc_feature (290)..(290): n is a, c, g, or t
  modified_base (598)..(598): a, c, t, g, unknown or other
  misc_feature (598)..(598): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctggcctccgtgtctgggtctcctggacagtcgatcaccatcgtcctgcactgtaaccggnagtgacgttgatgattagtaagtctgtctcctaggtaccaactaaccaccccggtanaaaacggtcctaccccaaactccaattggtaattttacgagtattgttaacaaagttaaacgtccgggtccctactagggttcgttttcctacgtatccgtctttacctcttacggtcccttacacgttgtcctacgggacctaaacgccgggtccccttaccgtcgaacccgtaactcctaccgtacggtaacctcccggagggtccctaggagggtaccggtagggttagtaaccgtttaattacgcgtccgtaccgtctaaattactacttacgttacctactcggtaccctaacgttcttacgngttacggttaagttaccggtttcgggaaccggaacgggtaaccttaacccgtcctaccggttccctaggttacccaccggtaccctacggtaccccg

SEQ ID NO: 217906 - DNA, 687 bp, Homo sapiens
  misc_feature: GYAE6OF02G4Q9O.34.28.C06.1.454.CMB.1.raw
  modified_base (141)..(141): a, c, t, g, unknown or other
  misc_feature (141)..(141): n is a, c, g, or t
  modified_base (182)..(182): a, c, t, g, unknown or other
  misc_feature (182)..(182): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (333)..(333): a, c, t, g, unknown or other
  misc_feature (333)..(333): n is a, c, g, or t
  modified_base (595)..(595): a, c, t, g, unknown or other
  misc_feature (595)..(595): n is a, c, g, or t
  modified_base (621)..(621): a, c, t, g, unknown or other
  misc_feature (621)..(621): n is a, c, g, or t
tcagtacacgtgatcacgaccggtgctcgatttagagctcacgtattggggtttgggggggtctcgaggaggctagcgctcgtcgggacgtctccaccatggcctgggctctgctattcctcacctctcactgaggccacngggtcctgggccagtctgcctggactcaggctgccgtcgtntcgtggtctccgtggactagtcgatcacgtntctcctgcactggtaccgnaggtgcttgcttagatttagtacgtcgtgtcctacgtcggtaaccaacgaaccgaccccggtataaacgccgttaaccaaactctacgttacgtagttacngttactcggtaactaagtacggtccgtacccttagtaacgggtttctttacgtcgtacgttcgttaacttccgtgttaccgacccttacgtactttacggtccgtaacggtaacctaaccggtacccggttccccttttaacccggacgtacccgttaacgttcccgttaccggtacgggttaccctacccggtaacgtgtaccggtaacggtacggtacggttactacgtttacgtacgtcgtacctccgactgttaaccncttacgtcacctacgtctcgtagcgntccgttagtaccggttcgaggttacgacctacgtaccgtcgttaccgctaccgacgtcgactccgg

SEQ ID NO: 217907 - DNA, 817 bp, Homo sapiens
  misc_feature: GYAE6OF02GC6SK.34.28.C06.1.454.CMB.1.raw
  modified_base (400)..(400): a, c, t, g, unknown or other
  misc_feature (400)..(400): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggccacgagggtcctcgggcccagtcctgccctgactcgaggctcgtccctcgttgtcgttgggtcctccgtggactacgtcgataccaaccactcctccgtcgacctaccgtacggtaaccgcgtagtacgtacgttgtagtagtaatttaagtaacgttcgttagttcccgttaccgttaacggaacccgaaaaccgtaaccccgaacccccggaactaaaccgacccttaacccaaacgttcaaacgttagttaacttttancgtaatacgtaaactaaacgtacgtcccgtcctacggtggtttcctttcgctacgtaccgttccgttctcggtccctaccgttctaacggttccgttacgtaccgaacccttaaacccgggacccggttccccctaaccgtactacccgttactccgttacgtaccggtaccctaccggtcggtacgtacgggaaacgggaggttaacgggttacttaacgtttaccgtaccgttccgtacctaccgtactaaacgttaacgtacttacgttaccacgttaccgtacctccttacgtacgtagtttacggtaggttaccggtttacggggaaccggtaacccggtaaaccccttacccggttacccgttcccggttaccgttaaccgcccgtacccgtaccggtaccctaccccggg

SEQ ID NO: 217908 - DNA, 691 bp, Homo sapiens
  misc_feature: GYAE6OF02HVY07.34.28.C06.1.454.CMB.1.raw
  modified_base (296)..(296): a, c, t, g, unknown or other
  misc_feature (296)..(296): n is a, c, g, or t
  modified_base (323)..(323): a, c, t, g, unknown or other
  misc_feature (323)..(323): n is a, c, g, or t
tcagtacacgtgatcacgaccggtgctcgatttagagctcacgtattggggtttgggggggggtctcaggaggcagcgctctcgggacgtctccaccatggcctgggctctgctattcctccaccctcctcactcagggcacgagggtcctgggcccagtctgccctgactcaggctgcctccgtgtcgtgggtctccgtggacagtcgatcaccatcctcctgctacgtacgtaaccggcaggtcgacgttgatgtaattataagtctcgtctcctggaccaacaccgacccganaacgcctacccaaatcatgtatttagngtattgtaactaatacgtccggtcccttaggtacggtttcgtttacctctacttccgtaccttcctcgtaccgtccctacgtagttcgtccgtaggaccctaaccggcccggtaccccttcccgtacgaccgtactccttccgtacgtacccgtccgtagggtctagggtaacgggtaacggtagggttacgtactttacgtaccgtcgccgtacctataattaacgttactacttacgtaccgttccgacctaccgttacgtaccgttagttcggttagttacggttcgggaccgggtaacgtaacccgtaaccgttcccgttaccgttccgttaccgtaccggaacgtacccggaacgttccccgg

SEQ ID NO: 217909 - DNA, 777 bp, Homo sapiens
  misc_feature: GYAE6OF02G2RJ3.34.28.C06.1.454.CMB.1.raw
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcgaggcacagggtcctgggcccagtctgccctgacctcgaggctgccctcgtgtctggtctccgtggacagtcgatcacctatctcctgcncgtcgtaaccgcagtcgacgttgagtgattatagtcttntcctcgtggtaaccacgtaacccgaccccggtacaaacgtccctaaccccaaacttcaacgtggttaacttttagacggtacttacgttaaacaacgttaaaccgtcccgggtacccttacgttacgggtttttcctttaccgttacgaccgttccgttctttccgtcttccggtacccttacgtacgttccgtacggtacgtaacccgtaaaccgccccggttcccttacccggacgtaaccctaacgtttcccgttacggttaaccccggtaaccgttcccggtaacggttaccggtacggggtaaccggggacgggttaacgggttaccgtttaaacgttttaaccgttaacgtccgtaccgtcccgtataaccgttactactaccttaccgtacgttccgtaccctacttccgtagttacgttgtcgtttacgggtttccgggaacggtacggtaaaccctaccgttaccgtacccgttcgttacccgacgtcccgtacggtacctccccgg

SEQ ID NO: 217910 - DNA, 715 bp, Homo sapiens
  misc_feature: GYAE6OF02IO3BB.34.28.C06.1.454.CMB.1.raw
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (370)..(370): a, c, t, g, unknown or other
  misc_feature (370)..(370): n is a, c, g, or t
  modified_base (411)..(411): a, c, t, g, unknown or other
  misc_feature (411)..(411): n is a, c, g, or t
  modified_base (439)..(439): a, c, t, g, unknown or other
  misc_feature (439)..(439): n is a, c, g, or t
  modified_base (485)..(485): a, c, t, g, unknown or other
  misc_feature (485)..(485): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacgagggtcctgggcccagtctcgccctgactcaggctgcctcgtgtcgtgggtcctcctggacagtcgatcaccattctcctgctacgtcgtaaccggcaggtgacgttgatgtattagtaagtctgtctccgtgtaaccaacaaccaccccgganaaacgcctacccaaaatcgatagtatttacngtaactgtaactaataacgtccgtaccctaggtggtttctttacnccgtatccgttctttatccgtactccctatgttcgttccgnggaacccaaccggtccgtccctccgtanaaccctctactcggtacgtacctaccgtggtacgtcggaaccgggngggtacgggttacgtttaatttacgttccgtctcccggtcctaagttaacttactaccgttacttaccgtaccgtaccgtccctaacttccgtaaccggttttgttcggtttacggtttacgggtttccggggaaccggggttaacccggtaaaccgttaacccgttacccgttaccgtttacccggttacccggtaccgggtaacccgtacccggtacccggttccccg

SEQ ID NO: 217911 - DNA, 633 bp, Homo sapiens
  misc_feature: GYAE6OF02IRZQV.34.28.C06.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
  modified_base (433)..(433): a, c, t, g, unknown or other
  misc_feature (433)..(433): n is a, c, g, or t
tcagtacacgtgatcacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacngtcgatcacatctcctgcactgtaaccggnagtgacgttgatgattataagtctgtctctggtaccaacaacaccccgganaaacgctacccaaactcatcgtatttanggatgtacaataacgtcggacccttcacggttgtttcncactcgtcttactctcgccctcagtgttcgngtacaaccgtaccggtccctcccgtacgaccctattcctcgttcggacctaccncgggtacagggtacggacggtaggtagtatttacgttactcggacgtcctactagtaattaccgattaccgacgttacgtcccaccgttccgtacgtacgttcggtgtttacggtttaccggggacgggtaaccggtaaccctaacccgttaccgacccgtttcccgttccgaacgacccggtacccgacggttcccccg

SEQ ID NO: 217912 - DNA, 703 bp, Homo sapiens
  misc_feature: GYAE6OF02H55W8.34.28.C06.1.454.CMB.1.raw
  modified_base (230)..(230): a, c, t, g, unknown or other
  misc_feature (230)..(230): n is a, c, g, or t
  modified_base (312)..(312): a, c, t, g, unknown or other
  misc_feature (312)..(312): n is a, c, g, or t
  modified_base (500)..(500): a, c, t, g, unknown or other
  misc_feature (500)..(500): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcaggctgcctcgtgtctgggtctcctggacagtcgatcaccatctcctgcacgtgtaccggnagtgacgttgatgattatagtctcgtctccgtgtaccaacaaccaccccggacaacgcctacccaaactcagtgtatttagngtatgtacaacgtacgtccgccctagtaggttcttactctactccgttccttctcctcgtacccttctacgttctcggtacgaacccaacccggtacccggtcccttaccccgtcgtaccctactcccgttcgtaccggtacccgttcccgtagggtacgtacgggaacgggtacgggtaacgggttnttaacggtttacttacgtcggtacctcccgtaatacgttaactacttacgtacctacctacgtaccctacttaccgtcgttacgttggttaccgtttacggggtttccgggaacccggggtaacggtaaaccccgttaaccgtcccggttacccgtttcccgttaccggttcccgaaccgggttccctaacggttccccccgg

SEQ ID NO: 217913 - DNA, 790 bp, Homo sapiens
  misc_feature: GYAE6OF02HIW4V.34.28.C06.1.454.CMB.1.raw
  modified_base (248)..(248): a, c, t, g, unknown or other
  misc_feature (248)..(248): n is a, c, g, or t
tcagtacacgtgatcacgaccggtgctcgatttagagctcacgtattggggttgggggggggtctcaggaggcagcgctctcgggacgtctccaccatggcctgggctctgctattcctcaccctcctcactcagggcacgagggtcctggggcccagtctgtccctgactcacggctgcctccgtgtctgggtcctccgtggacacggtcgactccacctactcctcctgacctactcggtaaccgntaggtcgacgttagatcgtaattataacgtctcgtcctccgtacggtaaccaaaccaaccggaccccgactaaacgcctacccaaactcgtatagttattagacgtatcggtaactaacgtaacgtcccggtaccctacggttacggtttacggtttacctactaccgtccggttcctttccgttccgttacccggtcccttactacgtttcgtccgtaccggtacctaaaccgtccccggtaccctacccgtaccgtacctacctccgttacgtaaccggtcctacccgggtagtaccggttcggggaacggggtaccgggtaaggttacgttaacgttacgttacccggtgccctacgttactacttacggttaacctacgttacctccgttaccgtacctaccggttacctagggttacgtacgtttaccgggtttacgggtaacccggggaaccgggtaaccgtaacccgttaacctaccccgggtttccgtttaccgttcccggtaaccggtacccggtacgtaccggttcccccgg

SEQ ID NO: 217914 - DNA, 704 bp, Homo sapiens
  misc_feature: GYAE6OF02GJ4LR.34.28.C06.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
tcagtacacgtgatcacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcaggctgcctccgtgtcgtgggtcctcctggacagtcgatcacatcctccngctatcgaaccggnagtgacgttgatgtattatagtctgtctccgtaggtacccaacaaccgaccccgacaaagcctacccaaactcatgtatttangtatgtactaaatacgtccgccctaggtaggttctttccnctacgttcctaccgttctctcgccctnttacgtcgttcgtcggaaccaaccgacccgtcccttacccgtcgaccctacgtttccgtccgtacccgggtaccttacccggagggtaccgtagggtaacgggacggtggggttaacttaacgtttacgttacgcgtaccgtacccgtactattaccgtacgtactttccgaacgttccgacctacttaccgttacgcgtttaggttaccgtttacgggttaccggggtaccgggaacccgggtaaccttaaacccgttcccggttacccggtttacccgtttaccgaccgtaacccgtacccggtaccggttaccccccgg

SEQ ID NO: 217915 - DNA, 724 bp, Homo sapiens
  misc_feature: GYAE6OF02GIL13.34.28.C06.1.454.CMB.1.raw
  modified_base (309)..(309): a, c, t, g, unknown or other
  misc_feature (309)..(309): n is a, c, g, or t
tcagtacacgtgatcacgaccggtgctcgatttagagctcacgtattggggtttgggggggggtctcaggaggcagcgctctcgggacgtctccaccatggcctgggctctgctattcctcacccctcctcactcagggcacagggtcctgggccagtctgccctgactcaggctgcctccgtgtcgtgggtctccgtggacagtcgatcaccatcctcctgccactacggtaaacccggctaggtagtacgttagatgtaattaagtaagttctgtcctcgtaggtaaccaaacaaccgaaccccganaaacgccctaacccgaaaactcaagtacgttaatttacgtagtaagtagtaacaaattaacgcccggtcccttaggtacggtttcgtttaccacgtacttccgtaccttacgtcctacgtcccttacgtagttcggtctaacgggaacccaacccggtaccggtcccctaccgtacgtacctactccgttacgtaccgtaccgtaccggacgttcagggaacggtacggtaaggttagtaatttacgtaaccgtcgtacccgtacctagtaagttactaccgttacttaccgtacgtctctacctcgtagtacgttaggtacgttaggtttaccggggaacggtaaccgtaaaccctaaccgttacccgtaccgtttacccgttaccggaacctacccgggacctccggtacccg

SEQ ID NO: 217916 - DNA, 858 bp, Homo sapiens
  misc_feature: GYAE6OF02IQYZE.34.28.C06.1.454.CMB.1.raw
  modified_base (404)..(404): a, c, t, g, unknown or other
  misc_feature (404)..(404): n is a, c, g, or t
  modified_base (547)..(547): a, c, t, g, unknown or other
  misc_feature (547)..(547): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacgacgggttccgtcgggccccagttcctcggtccccctgaacctccgacggcctcgacccgttccggtcgtcgttcggggttcctccgtggacgtagttcggactcctacctagtccttcccgtgaccttacgttacggttaacccgggacctacggttacggtaccggtttagaagttacggtaatttaaacgtaaacggtccttcggttaccgttccccgtacgggttaaaccccaaaccgtaaaaccccgaccccccggganaaaacggtccctaaccccaaattacccagttaggtactttacacgggtaacttacgtaaccgtaagttaacccgtccgggtcccctagttacgggttcgttttccacgtactcgtacccttctacgtcgtcctacgtacgttntccgtacggtacctaaacggtacccgtcccgtacctaacgtaccgtacttacccgtacggtaccgtacgtacccggtagtacggtaccgggtacggggaccgggtacgggttaacggttaactttaacgttcccggtaaacgtcccgtccttaacgtaaccgtttaacacttaccgttacaacgttccgtaccgttacctgtaccgttacggttgtacgtttaccgggttcgggtaaccggtacgtaaacgtaacccgttcccggtaccgtttacccgtccgtacggaccgttacccggacggttaccccg

SEQ ID NO: 217917 - DNA, 667 bp, Homo sapiens
  misc_feature: GYAE6OF02HU4J3.34.28.C06.1.454.CMB.1.raw
  modified_base (190)..(190): a, c, t, g, unknown or other
  misc_feature (190)..(190): n is a, c, g, or t
  modified_base (322)..(322): a, c, t, g, unknown or other
  misc_feature (322)..(322): n is a, c, g, or t
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
  modified_base (626)..(626): a, c, t, g, unknown or other
  misc_feature (626)..(626): n is a, c, g, or t
tcagtacacgtgatcacgaccggtgctcgatttagagctcacgtattgggtttgggggggggtctcaggaggcagcgctctcgggacgtctccaccatggcctgggctctgctattcctcaccctcctcactcagggcacgagggtcctgggccagtctgcctgactcagctgcctcgtgtcgtgggtcncctggacagtcgatcaccatcctcctgctactacggtaaccgcagtagcgttgatgtattataacgtctgtcctcgtacgtaccaacaccgacccgacaacgtcctaccaactctataggtattttacagtntacgtacaagtacgtccggccctagtaggttcgttacgtcacgttcgtcttacgtctcgtccctactgtcgtntcgacactccggtcctacctgtacctnttcgtactcggtacctcggacggtacgacgggtacggaccggttaggttaacgttacttacgtttacggacgtcccgtacgactacgttaccttagtacttccgacttccgaaccgtccgtacgttgacggtttacgtcggttacccggggtttacgggtaaccggggtaaacccgtaaccgttacccgtaccgttacccggtntttacccggacccgtaaccggttcccgtaacgggtcccccg

SEQ ID NO: 217918 - DNA, 429 bp, Homo sapiens
  misc_feature: GYAE6OF01DPQ9J.43.37.D04.1.454.CMB.1.raw
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (419)..(429): a, c, t, g, unknown or other
  misc_feature (419)..(429): n is a, c, g, or t
tcagtgtgagtagtcacgaccggtgctcgatttagtagcatactgtgggtgggatggctcaacgctgacgatggtcaaacaaagtattcacagcagttccagggcatactctcccttaccagggacacttccgcgaacacaggctacatgtatttgagcagactgacatctgaagacacggctatgtactactgtgcgagaggcggattttgtcggcgtggtgactgctacagtcaaaatcgtcgattgtggttcgaccctggggccagggaaccctgctctccgtctcctcagcttccaccaaggcccatcggtctcccctgcgccctgctcagancactcgnggggcacngcggccctggctgcctggtcaaggactactccactactcacactgagcggctggcaaggcgcatagnnnnnnnnnnn

SEQ ID NO: 217919 - DNA, 432 bp, Homo sapiens
  misc_feature: GYAE6OF01EOAH4.43.37.D04.1.454.CMB.1.raw
  modified_base (329)..(329): a, c, t, g, unknown or other
  misc_feature (329)..(329): n is a, c, g, or t
  modified_base (427)..(432): a, c, t, g, unknown or other
  misc_feature (427)..(432): n is a, c, g, or t
tcagtgtgagtagtcacgaccggtgctcgatttagtagcatactgtgggtgggatggctcaacgctgacgatggtcaaacaaagtattcacagcagttccagggcatactctcccttaccagggacacttccgcgaacacaggctacatgtatttgagcagactgacatctgaagacacggctatgtactactgtgcgagaggcggattttgcggcgtggtgactgctacagtcaaaatcgtcgattgtggttcgacccctggggccagggaaccctgctctccgtctcctcagcttccaccaagggcccatcggtcttccccctggcnccctgctccaggagcacctctggggcacagcggccctgggctgcctggtcaaggactacttccactactcacactgagcggctggcaaggcgcatagnnnnnn

SEQ ID NO: 217920 - DNA, 456 bp, Homo sapiens
  misc_feature: GYAE6OF01CCEO9.43.37.D04.1.454.CMB.1.raw
  modified_base (443)..(443): a, c, t, g, unknown or other
  misc_feature (443)..(443): n is a, c, g, or t
  modified_base (449)..(456): a, c, t, g, unknown or other
  misc_feature (449)..(456): n is a, c, g, or t
tcagtgtgagtagtcacgaccggtgctcgatttagtagcatactgtgggtgggatggctcaacgctgacgatggtcaaacaaagtattcacagcagttccagggcatactctcccttaccagggacacttccgcgaacacaggctacatgtatttgagcagactgacatctgaagacacggctatgtactactgtgcgagaggcggattttgtcggcgtggtgactgctacagtcaaaatcgtcgattgtggttcgacccgtggggccagggaaccctgctctccgtctcctcacgcttccaccgaagggccccatccggtccttccccctggccgcccctgctccaggacgcacctcgtcgggggcacgaggccggccctgggctcgccgtggtcaacggtactaccttccactactcacactgacgcgggctggcaaggcncatagnnnnnnnn

SEQ ID NO: 217921 - DNA, 541 bp, Homo sapiens
  misc_feature: GYAE6OF01DFX9E.43.37.D04.1.454.CMB.1.raw
  modified_base (517)..(541): a, c, t, g, unknown or other
  misc_feature (517)..(541): n is a, c, g, or t
tcagtgtgagtagtcacgaccggtgctcgatttagtagcatactgtgggtgggatggctcaacgctgacgatggtcaaacaaagtattcacagcagttccagggcatactctcccttaccagggacacttccgcgaacacaggctacatgtatttgagcagactgacatctgaagacacggctatgtactactgtgcgagaggcggattttgtcggcgtggtgactgctacagtacaaaatcgtcgattgtggttcgacccgtgggccagggaacctgctctccgtctcctcacgcttccaccacgggcccagtccggtcctttcccccgtggccgcccctgcctccgaggacgccacctcggtcgggggccacgacggccggcccgtggggccttcggcccgttcgggtaccgaacgggtaacctttacccgttcccgtaacccttaaccttacccaacctaccgttaggaacgggtccggggcgtcgggacccgaacgggccgactacgtacggnnnnnnnnnnnnnnnnnnnnnnnnn

SEQ ID NO: 217922 - DNA, 580 bp, Homo sapiens
  misc_feature: GYAE6OF01CA9P9.43.37.D04.1.454.CMB.1.raw
  modified_base (550)..(551): a, c, t, g, unknown or other
  misc_feature (550)..(551): n is a, c, g, or t
  modified_base (553)..(554): a, c, t, g, unknown or other
  misc_feature (553)..(554): n is a, c, g, or t
  modified_base (556)..(580): a, c, t, g, unknown or other
  misc_feature (556)..(580): n is a, c, g, or t
tcagtgtgagtagtcacgaccggtgctcgatttagtagcatactgtgggtgggatggctcaacgctgacgatggtcaaacaaagtattcacagcagttccagggcatactctcccttaccagggacacttccgcgaacacaggctacatgtatttgagcagactgacatctagaagacacggctatgtactactgtgcgagaggcggtattttggcggcgtggtcgactgctacagtacaaaagtcgtcgtattggtcggttccgacccgtggggccgacgggacctgcctctccgtctcctcacgtccttccgaaccgaacggcccacgttccggtcccttcccccgtgggccccgtccccgtcgccgtccgacgggactccgtacccgtcgggtcggggaccaccggtacggcccggtcccgtggggcctcggtcccgtcgggtaacctaaacgggtacccttaccttacccgaaccttaccgtaccaaccgtacgtcggaacgggccgggtaccgtacgggaccggacgggtaccgacagtaacggnncnncnnnnnnnnnnnnnnnnnnnnnnnnn

SEQ ID NO: 217923 - DNA, 528 bp, Homo sapiens
  misc_feature: GYAE6OF01B4RBZ.43.37.D04.1.454.CMB.1.raw
  modified_base (500)..(500): a, c, t, g, unknown or other
  misc_feature (500)..(500): n is a, c, g, or t
  modified_base (505)..(528): a, c, t, g, unknown or other
  misc_feature (505)..(528): n is a, c, g, or t
tcagtgtgagtagtcacgaccggtgctcgatttagtagcatactgtgggtgggatggctcaacgctgacgatggtcaaaacaaagtattcacagcagttccagggcatactctcccttaccagggacacttccgcgaacacaggctacatgtatttgagcagactgacatctgaagacacggctatgtactactgtgcgagaggcgattttgtcggcgtggtgactgctacagtacaaaatcgtcgattgtggttccgacccgtggggaccacgggaacctgctcctccgtctcctcagccttccaacgaacggccctagtccggtccttcccccgtggcctcccgtgcctccgaaggcgcaccgtggtcggggccacgacggcggcccgtgggtccgtacggtccgtcggtaccgaaacgggtacccttaccttacccgtacctaccgtccaacgtaccgtaggaccggccgggcgtcgggaccaacgggtcgacctanaggannnnnnnnnnnnnnnnnnnnnnnn

SEQ ID NO: 217924 - DNA, 723 bp, Homo sapiens
  misc_feature: GYAE6OF01B2Q90.43.37.D04.1.454.CMB.1.raw
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (686)..(686): a, c, t, g, unknown or other
  misc_feature (686)..(686): n is a, c, g, or t
  modified_base (690)..(690): a, c, t, g, unknown or other
  misc_feature (690)..(690): n is a, c, g, or t
  modified_base (697)..(697): a, c, t, g, unknown or other
  misc_feature (697)..(697): n is a, c, g, or t
  modified_base (701)..(701): a, c, t, g, unknown or other
  misc_feature (701)..(701): n is a, c, g, or t
  modified_base (704)..(704): a, c, t, g, unknown or other
  misc_feature (704)..(704): n is a, c, g, or t
  modified_base (708)..(708): a, c, t, g, unknown or other
  misc_feature (708)..(708): n is a, c, g, or t
  modified_base (713)..(713): a, c, t, g, unknown or other
  misc_feature (713)..(713): n is a, c, g, or t
  modified_base (716)..(716): a, c, t, g, unknown or other
  misc_feature (716)..(716): n is a, c, g, or t
  modified_base (718)..(718): a, c, t, g, unknown or other
  misc_feature (718)..(718): n is a, c, g, or t
  modified_base (720)..(720): a, c, t, g, unknown or other
  misc_feature (720)..(720): n is a, c, g, or t
tcagtgtgagtagtcacgaccggtgctcgatttagtagcatactgtgggtgggatggctcaacgctgacgatggtacaaaacaaagtattcacagcagttccagggcatactctccttaccaggacacttcgcgaacacaggctacatgtattgagcagactgacatctagaagacacggctatgtactactgtgcgagnggcgtatttggtcggcgtggngtactgactacagtaactaaaacgtcgtacgtagttcggtcggtttaccgacccggtacggggcccgaacgggtaacccgtcgtaccgttccgttcccgtaccttcctacgtacgtaccttacccgaaccgaaccggggtaccctaacggtttcccggttaccccgtttcccccgtgggtaccccgtccccgttaccggacccgttacccggaacgggtacgacccgtaccggttcgggtacgggggtaaccaaaccggaccggcccgggtccccggtcggggtcccgttacggtacccggttacgggtaaccggtaaaccggttaaccctttaacccttaacccgtaacctttaaccgtaccgtaaaccgtaacggtacgggaaccggggtccgggtaccgtacggggaaaccgtaacgggacccgtacgaaacggttacgcgacgtacgacatcgcgngncgnacgnacacagngcgncgngcgncgtcncancngngcg

SEQ ID NO: 217925 - DNA, 437 bp, Homo sapiens
  misc_feature: GYAE6OF02JC52X.43.37.D04.1.454.CMB.1.raw
  modified_base (431)..(437): a, c, t, g, unknown or other
  misc_feature (431)..(437): n is a, c, g, or t
tcagtgtgagtagtcacgaccggtgctcgatttagtagcatactgtgggtgggatggctcaacgctgacgatggtcaaacaaagtattcacagcagttccagggcatactctcccttaccagggacacttccgcgaacacaggctacatgtatttgagcagactgacatctgaagacacggctatgtactactgtgcgagaggcggattttgtcggcgtggtgactgctacagtcaaaatcgtcgattgtggttcgacccctggggccaggggaacccctgctctccgtctcctcagcttccaccaagggcccatcggtcttccccctggcgccctgctccaggagcacctctgggggcacagcggccctgggctgcctggtcaaggctacttccactactcacactgagcgggctggcaaggcgcatagnnnnnnn

SEQ ID NO: 217926 - DNA, 457 bp, Homo sapiens
  misc_feature: GYAE6OF02G2VPB.43.37.D04.1.454.CMB.1.raw
  modified_base (342)..(342): a, c, t, g, unknown or other
  misc_feature (342)..(342): n is a, c, g, or t
  modified_base (440)..(457): a, c, t, g, unknown or other
  misc_feature (440)..(457): n is a, c, g, or t
tcagtgtgagtagtcacgaccggtgctcgatttagtagcatactgtgggtgggatggctcaacgctgacgatggtcaaacaaagtattcacagcagttccaggacatactctcccttaccagggacacttccgcgaacacaggctacatgtatttgagcagactgacatctgaagacacggctatgtactactgtgcgagaggcggattttgtcggcgtggtgactgctacagtcaaaatcgtcgattgtggttcgacccctggggccagggaacccctgctctccgtctcctcagcttccaccaagggcccatcggtctcccctgcgccctgcctcaggancacctcgtgggggcacgacgccggcccctgggctgccctgggtcaaggacctacttcccactactcacactgacgcgggctggcgaaggcgacatagnnnnnnnnnnnnnnnnnn

SEQ ID NO: 217927 - DNA, 490 bp, Homo sapiens
  misc_feature: GYAE6OF02HBR21.43.37.D04.1.454.CMB.1.raw
  modified_base (473)..(473): a, c, t, g, unknown or other
  misc_feature (473)..(473): n is a, c, g, or t
  modified_base (475)..(490): a, c, t, g, unknown or other
  misc_feature (475)..(490): n is a, c, g, or t
tcagtgtgagtagtcacgaccggtgctcgatttagtagcatactgtgggtgggatggctcaacgctgacgatggtcaaacaaagtattcacagcagttccagggcatactctcccttaccagggacacttccgcgaacacaggctacatgtatttgagcagactgacatctgaagacacggctatgtactactgtgcgagaggcggattttgtcggcgtggtgactgctacagtcaaaatcgtcgattgtggttcgacccctggggccagggaacccctgctctccgtctcctcagcttccaccaagggcccatcggtcttccccctggccgcccctgcctccaggacgcaccctcgtcggggggcacgacggccgggcccctggggctcggcccgtcgggtccgaaggactaccttcccaccgttacctcaccacgtagacggcgggcgtggccaagggccgcaagtacggngnnnnnnnnnnnnnnnn

SEQ ID NO: 217928 - DNA, 448 bp, Homo sapiens
  misc_feature: GYAE6OF02I7MUI.43.37.D04.1.454.CMB.1.raw
  modified_base (437)..(448): a, c, t, g, unknown or other
  misc_feature (437)..(448): n is a, c, g, or t
tcagtgtgagtagtcacgaccggtgctcgatttagtagcatactgtgggtgggatggctcaacgctgacgatggtcaaacaaagtattcacagcagttccagggcatactctcccttaccagggacacttccgcgaacacaggctacatgtatttgagcagactgacatctgaagacacggctatgtactactgtgcgagaggcggattttgtcggcgtggtgactgctacagtcaaaatcgtcgattgtggttcgacccctggggccagggaacccctgctctccgtctcctcagcttccaccaagggcccatcggtcttcccctggcgccctgctccaggacgcacctcgtcgggggcacgacgcggccctggggctggcctggtcaaggactacttccactactcacactgagcgggctggcaaggcgcatagnnnnnnnnnnnn

SEQ ID NO: 217929 - DNA, 500 bp, Homo sapiens
  misc_feature: GYAE6OF02IL31T.43.37.D04.1.454.CMB.1.raw
  modified_base (476)..(500): a, c, t, g, unknown or other
  misc_feature (476)..(500): n is a, c, g, or t
tcagtgtgagtagtcacgaccggtgctcgatttagtagcatactgtgggtgggatggctcaacgctgacgatggtcaaacaaagtattcacagcagttccagggcatactctcccttaccagggacacttccgcgaacacaggctacatgtatttgagcagactgacatctgaagacacggctatgtactactgtgcgagaggcggattttgtcggcgtggtgactgctacagtcaaaatcgtcgattgtggttccgacccgtggggccagggaacccctgctctccgtctcctcagcttccaccaagggcccatccggtcttccccctggccgccctgcctccaggacgcacctcgtgggggccacgacggccggcccgtgggcctcggcccctgggtccaacgggtacttaccttcccgaccttacctccaccactcggacggccgggtcgtgggcaagggccgacaagtacgnnnnnnnnnnnnnnnnnnnnnnnnn

SEQ ID NO: 217930 - DNA, 483 bp, Homo sapiens
  misc_feature: GYAE6OF02IB8ES.43.37.D04.1.454.CMB.1.raw
  modified_base (345)..(345): a, c, t, g, unknown or other
  misc_feature (345)..(345): n is a, c, g, or t
  modified_base (383)..(383): a, c, t, g, unknown or other
  misc_feature (383)..(383): n is a, c, g, or t
  modified_base (461)..(483): a, c, t, g, unknown or other
  misc_feature (461)..(483): n is a, c, g, or t
tcagtgtgagtagtcacgaccggtgctcgatttagtagcatactgtgggtgggatggctcaacgctgacgatggtcaaaacaaagtattcacagcagttccagggcatactctcccttaccagggacacttccgcgaacacaggctacatgtatttgagcagactgacatctgaagacacggctatgtactactgtgcgagaggcggattttgtcggcgtggtgactgctacagtacaaaatcgtcgattgtggttcgacccctcggggccacggaacctgctctccgtctcctcagcttccaccacggccactcgtccttcccctggccgccctgctccagganccacctcgtcggggccacacgccggtcccgtgggcgtncccgtggtccaaacggaccgtaacctttcccaacctactaccacacgtcgacgccgggctggcaacggcgcaatagcnnnnnnnnnnnnnnnnnnnnnnn

SEQ ID NO: 217931 - DNA, 474 bp, Homo sapiens
  misc_feature: GYAE6OF02H40RQ.43.37.D04.1.454.CMB.1.raw
  modified_base (231)..(231): a, c, t, g, unknown or other
  misc_feature (231)..(231): n is a, c, g, or t
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (407)..(407): a, c, t, g, unknown or other
  misc_feature (407)..(407): n is a, c, g, or t
  modified_base (447)..(447): a, c, t, g, unknown or other
  misc_feature (447)..(447): n is a, c, g, or t
  modified_base (449)..(474): a, c, t, g, unknown or other
  misc_feature (449)..(474): n is a, c, g, or t
tcagtgtgagtagtcacgaccggtgctcgatttagtagcatactgtgggtgggatggctcaacgctgacgatggtcaaacaaagtattcacagcagttccagggcatactctcccttaccagggacacttccgcgaacacaggctacatgtatttgagcagactgacatctgaagacacggctatgtactactgtgcgagaggcggatttggtcggcgtggtgactgctanagtacaaaatcgtcgattgtggttccgaccccgtggggccagggaccctgtctcgttcgtctccncagccttccaccaggcccatccggtccttcccctggctcctgctccaggnccacctcgtggggcacgngccggcctgggcctgccgtggtacacggactacctcacttacncactacgtgacggtcgggactggacaagggccgcagtagnannnnnnnnnnnnnnnnnnnnnnnnnn

SEQ ID NO: 217932 - DNA, 189 bp, Homo sapiens
  misc_feature: GYAE6OF02JS0YV.43.37.D04.1.454.CMB.1.raw
  modified_base (186)..(189): a, c, t, g, unknown or other
  misc_feature (186)..(189): n is a, c, g, or t
tcagtgtgagtagtcacgaccggtgctcgatttagtagcatactgttgggtttgggcacgaccggtgctcgatttagtagcatactgttgggtttggggaggtgtgtcacaagatttgggccctgggctgcctggtcaaggactacttccactactcacactgagcgggctggcaaggcgcatagnnnn

SEQ ID NO: 217933 - DNA, 652 bp, Homo sapiens
  misc_feature: GYAE6OF02IJFAH.43.37.D04.1.454.CMB.1.raw
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (618)..(619): a, c, t, g, unknown or other
  misc_feature (618)..(619): n is a, c, g, or t
  modified_base (621)..(621): a, c, t, g, unknown or other
  misc_feature (621)..(621): n is a, c, g, or t
  modified_base (633)..(633): a, c, t, g, unknown or other
  misc_feature (633)..(633): n is a, c, g, or t
  modified_base (651)..(651): a, c, t, g, unknown or other
  misc_feature (651)..(651): n is a, c, g, or t
tcagtgtgagtagtcacgaccggtgctcgatttagtagcatactgtgggtgggatggctcaacgctgacgatggtcaaaacaaagtattcacagcagttccagggcagactctcccttaccagggacacttccgcgaacacaggctacatgtattttgagcagactgacatctgaagacacggctatgtactactgtgcgagaggcggtattttggtcggcgtggtcgactgctacagtacaaaatcgtacgatttgtcggttccgaccccgtggggccgacggaaccctgcctctccgtctcctcacgccttccgaccgaacgggtcccacgttccggttccctttccccccgtcggtccgtccccgtcgtacccgttcccgacgggacgtaccctacccgttccgggtcggggggactaaccggacgacccgggtccccggtggggccgtcgggtcccgttacgggtaccgaaacgggtaccttacccgtttaccctacccgttacctaccaccgtaaccgtcggacgggtaccgggtccgtacgggacggtaaaccgggccggtaccgtaacgtaacggcgtacgtacgctcgaacgctacgncncgtcgtgcgnncnacgacgacgagngcgtcgcgtgacgcgtgng

SEQ ID NO: 217934 - DNA, 428 bp, Homo sapiens
  misc_feature: GYAE6OF01CU1N0.29.42.D09.1.454.CMB.1.raw
  modified_base (420)..(428): a, c, t, g, unknown or other
  misc_feature (420)..(428): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattattgggccagggaaccctggtcaccgtctcctcagcctccaccaggcccatcggtcttccccctggcaccctcctccaagagcacctctgggggcacagcggccctggggctgcctggtcaaggactacttccagtactctatctgagcggctggcaaggcgcatagnnnnnnnnn

SEQ ID NO: 217935 - DNA, 426 bp, Homo sapiens
  misc_feature: GYAE6OF01CR6FS.29.42.D09.1.454.CMB.1.raw
  modified_base (421)..(426): a, c, t, g, unknown or other
  misc_feature (421)..(426): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattatgggccagggaaccctggtcaccgtctcctcagcctccaccaagggcccatcggtcttccccctggcaccctcctccaagagcacctctgggggcacagcagccctgggctgcctggtcaaggctacttccagtactctatctgagcgggctgggcaaggcgcatagnnnnnn

SEQ ID NO: 217936 - DNA, 422 bp, Homo sapiens
  misc_feature: GYAE6OF01EM48Q.29.42.D09.1.454.CMB.1.raw
  modified_base (418)..(422): a, c, t, g, unknown or other
  misc_feature (418)..(422): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctaaacctgacctctgtgaccgccgctgacacggccgtgtattactgtgcgagagacatatttcactatgatactagtgggctccactcctggggccagggaaccctggtcaccgtctcctcagcctccaccaagggcccatcggtcttcccctggcaccctcctccaagagcacctctgggggcacagcggccctgggctgcctggtcaaggactactcctatgtatactctgagcgggctggcaaggcgcatagnnnnn

SEQ ID NO: 217937 - DNA, 512 bp, Homo sapiens
  misc_feature: GYAE6OF01EL4IH.29.42.D09.1.454.CMB.1.raw
  modified_base (477)..(512): a, c, t, g, unknown or other
  misc_feature (477)..(512): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctaaacctgacctctgtgaccgccgctgacacggccgtgtattactgtgcgagagacattatttcactatgatactagtgggctccactccgtggggccacgggaaccctggtccaccgtctcctcacgcctccaccaacgggcccacgtccggtccttccccgtcggccacccctcctaccgaagacgccacctcgtcgggggcacgacggcccggccgtgggctcggccgttcggtccaaggtacttacctccttatgttactacttcgtagacggcgggtcgtagggacgaacgggtcgacgtagtacgagcnnnnnnnnnnnnnnnnnnnnnnnnnnnnnnnnnnnn

SEQ ID NO: 217938 - DNA, 506 bp, Homo sapiens
  misc_feature: GYAE6OF01DD3AZ.29.42.D09.1.454.CMB.1.raw
  modified_base (484)..(506): a, c, t, g, unknown or other
  misc_feature (484)..(506): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctaaacctgacctctgtgaccgccgctgacacggccgtgtattactgtgcgagagacatatttcactatgatactagtgggctccactccgtgggccagggaaccctggtcaccgtctcctcacgcctccaccaacgggcccagtccggtccttcccccgtggcccaccccgtccctaccgaacgacgtccacctccgtcgggggccacgacggcccggccccgtcggggctcggccgtggtaccgaacggtaccttaccgtttcctaattggtaactccgtcgtggtacggcggggtcgtggacgaaggccgacaagtaggnnnnnnnnnnnnnnnnnnnnnnn

SEQ ID NO: 217939 - DNA, 470 bp, Homo sapiens
  misc_feature: GYAE6OF01A19OC.29.42.D09.1.454.CMB.1.raw
  modified_base (443)..(470): a, c, t, g, unknown or other
  misc_feature (443)..(470): n is a, c, g, or t
tcagatagagtactcacgaccggtgctcgatttagacacatacgcaggggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattagttgggccagggaaccctggtcacgtctcctcagcctccaccagggcccatccggtcttccccctggccaccctcctccaagcgcacctctgggggccacaggccacgcccgtggggctcgccgtggttcgaaggacctacttccgagtactactatctgacgtcgggcgtcggcacggcgcagtagcnnnnnnnnnnnnnnnnnnnnnnnnnnnn

SEQ ID NO: 217940 - DNA, 434 bp, Homo sapiens
  misc_feature: GYAE6OF01EXUMX.29.42.D09.1.454.CMB.1.raw
  modified_base (418)..(418): a, c, t, g, unknown or other
  misc_feature (418)..(418): n is a, c, g, or t
  modified_base (423)..(434): a, c, t, g, unknown or other
  misc_feature (423)..(434): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattagtgggccagggaaccctggtcaccgtctcctcagcctccaccaagggcccatcggtcttccccctggccaccctcctccaagagcacctcgtgggggcacgagcggccctgggctcgcctggtcaaggactactccagtactctatctgagcgggctggcaggcnatagnnnnnnnnnnnn

SEQ ID NO: 217941 - DNA, 715 bp, Homo sapiens
  misc_feature: GYAE6OF01CNW64.29.42.D09.1.454.CMB.1.raw
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
tcagatagagtactcacgaccggtgctcgatttagacacatacgctaggggaaagggcctggagtggattggctacatctatcatactgggagcacctactacaacccgtccctcaacagtccgagtcaccatctcactagacaagtccaactacagttctccctgaagctgacgtctgtgaccgccgcggacacgggccgtgtaattactgtcgccagaagaagtggacggtactggacctaattaactaaactactacgtttgatttagtgggaccagggtaacctggtcaccgtctacctcagcctaccaccgaagggccccaagtccggtccttccccnggccaaccctccttacaagacncaacctcggtacggggaactcggaccggtcccgtgggtacctcggtaccccgttagggtaccgtaaacgggtacccttaacgtttacccgaaggaaccgtacgggtaccgtttaacccgaggggtaaccgggacccggggttacgttaaccgggggtaccgaaaaccgggggtcccttaaccgaaacgggttaaagggctaacgggccaggttaccgaagtttaacctacgtacgtacgtacgtacgtacgtaacgtacgtacgtacgtacgtacgacgtacgtacgtacgtacgtacgtacgtacgtacgtacgtacgacgacgacgtacgacgtacgacgtcgtgacg

SEQ ID NO: 217942 - DNA, 466 bp, Homo sapiens
  misc_feature: GYAE6OF01BIA15.29.42.D09.1.454.CMB.1.raw
  modified_base (449)..(466): a, c, t, g, unknown or other
  misc_feature (449)..(466): n is a, c, g, or t
tcagatagagtactcacgaccggtgctcgatttagacacatacgcagggaaagggcctggagtggattggctacatctatcatactgggagcacctactacaaacccgtccctcaacagtcgagtcaccatctcactagacaagtccaaactaccagttctccctgaagctgacgtctgtgaccgccgcggacacggccgtgtattactgtgccagagaagtgcggactggccattaataaatacgtactttgaatttagttggggccagggaaccctggtcaccgtctcctcagcctccaccaaacgggcccatccggtccttcccccgtcggccaccctcctccaacgagccacctcgtcgggggcacgacgcggccctggggctgcctggtacaagactactccagtacctctatctgagcggcgtggacgtaaggcgacactagnnnnnnnnnnnnnnnnnn

SEQ ID NO: 217943 - DNA, 484 bp, Homo sapiens
  misc_feature: GYAE6OF01B01YV.29.42.D09.1.454.CMB.1.raw
  modified_base (461)..(484): a, c, t, g, unknown or other
  misc_feature (461)..(484): n is a, c, g, or t
tcagatagagtactcacgaccggtgctcgatttagacacatacgcaggggaaagggcctggagtggattggctacatctatcatactgggagcacctactacaacccgtccctcaacagtcgagtcaccatctcactagacaagtccaactaccagttcctccctaaacctgacctctgtgaccgccgctgacacggccgtgtattactggtgcgagagactatatttcactatgatactaggtgggcctccactccgtggggccacgggaaccctggtccaccgtctcctcacgccctccaccgaacggcccatccggtccttcccccgtggccacccctcctaccaagcgcctaccgtcggtcgggggcacgcggccggccgtcgggctcgccgtggcaacgtctaccttctatcgtacttactcgtggacggtcgggcgtggacgaggcgactagtgnnnnnnnnnnnnnnnnnnnnnnnn

SEQ ID NO: 217944 - DNA, 817 bp, Homo sapiens
  misc_feature: GYAE6OF01CKW1O.29.42.D09.1.454.CMB.1.raw
  modified_base (110)..(110): a, c, t, g, unknown or other
  misc_feature (110)..(110): n is a, c, g, or t
  modified_base (157)..(157): a, c, t, g, unknown or other
  misc_feature (157)..(157): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (337)..(337): a, c, t, g, unknown or other
  misc_feature (337)..(337): n is a, c, g, or t
tcagatagagtactcacgaccggtgctcgatttagacacatacgcagggaagggcctggagtggattggctacatctatcatactgggagcacctactacaacccgtccncaacagtcgagtcaccatctcactagacaagtccaactaccagttcnccctgaagtctgacgttctgtgaccgccgcgggacacggccgtntaattactggtanccaggagtaagtgcggaacttggccaattaataaaacactttaaccgtttgaacgtttacgttggggtaccgaacggggtaaaccccttgggttaccaaccggttaacgtcccttaccgtaanaccccgttacccaaccaaacggggggttaccccgaactaccgggttaacctttccccccggtaacggccgtaaccccctaccggttaccaaacggtaaccggacaaccccgttccgtaccgggggggtaccaacgttaacgggtccgggaaccccgtacgggggtaccgttcggcccccgggtttaaggtaaccgggtaaaacggggaacccgttaaaacccttttcccgtaaaccggttaacccggttaacccttaaacgtccggtttaaaccggaacggttaccgggggccgtttaacggggaccgaaaacggggtcccggtaacgtaaacgaacggtttacgggacgtagtacgacgacgtacacgacgacgagacgtacgtacgtacgtacgtactacgtacgtaacgtagtagtacgtacgtacgtacgtaagacgacgagtacgaacgtacgtacgttagtactcgtacgtacg

SEQ ID NO: 217945 - DNA, 422 bp, Homo sapiens
  misc_feature: GYAE6OF02FFDUK.29.42.D09.1.454.CMB.1.raw
  modified_base (419)..(422): a, c, t, g, unknown or other
  misc_feature (419)..(422): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctaaacctgacctctgtgaccgccgctgacacggccgtgtattactgtgcgagagacatatttcactatgatactagtgggctccatcctggggccagggaaccctggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagnnnn

SEQ ID NO: 217946 - DNA, 426 bp, Homo sapiens
  misc_feature: GYAE6OF02GC42K.29.42.D09.1.454.CMB.1.raw
  modified_base (423)..(426): a, c, t, g, unknown or other
  misc_feature (423)..(426): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattattggggccagggaaccctggtcaccgtctcctcagcctccaccaagggcccatcggtcttccccctggcaccctcctccaagagcacctctgggggcacagcggccctgggctgcctggtcaaggactacttccagtactctatctgagcgggctggcaaggcgcatagnnnn

SEQ ID NO: 217947 - DNA, 423 bp, Homo sapiens
  misc_feature: GYAE6OF02FYDRN.29.42.D09.1.454.CMB.1.raw
  modified_base (419)..(423): a, c, t, g, unknown or other
  misc_feature (419)..(423): n is a, c, g, or t
tcagatagagtactcacgaccggtgctcgatttagacacatacgcaggggaaagggcctggagtggattggctacatctatcatactgggagcacctactacaacccgtccctcaacagtcgagtcaccatctcactagacaagtccaactaccagttctccctgaagctgacgtctgtgaccgccgcggacacgggccgtgtattactggtgccagagaagtgcggactggccattataaatactactttgattattgggccaggaaccctggtcacgctctcagctcaccaaggcccatcggtcttccccctggcaccctcctccaagagcacctctgggggcacagcggccctgggctgcctggtcaaggactacttccagtacgtctatctgagcgggctggcaaggcgcatagnnnnn

SEQ ID NO: 217948 - DNA, 437 bp, Homo sapiens
  misc_feature: GYAE6OF02H17CK.29.42.D09.1.454.CMB.1.raw
  modified_base (421)..(437): a, c, t, g, unknown or other
  misc_feature (421)..(437): n is a, c, g, or t
tcagatagagtactcacgaccggtgctcgatttagacacatacgcagggaaagggccggtggagtggattggctacatctagtcatactgggagcacctactacaacccgtccctcaacagtcgagtcaccatctcactagacaagtccaactaccagttctcgctaaacctgacctctgtgaccgccgctgacacggccgtgtattactgtgcgagagacatatttcactatgatactagtgggctccactctggggccagggaaccctggtcaccgtctcctcagcctccaccaaggcccatcggtcttcccctggcacctcctccaagagcacctctcgggggtcacagcggccctgggctgcctggtcaaggactacttcctatgtatactctgagcgggctggcaaggcgcatagnnnnnnnnnnnnnnnnn

SEQ ID NO: 217949 - DNA, 423 bp, Homo sapiens
  misc_feature: GYAE6OF02HLBP7.29.42.D09.1.454.CMB.1.raw
  modified_base (419)..(423): a, c, t, g, unknown or other
  misc_feature (419)..(423): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctaaacctgacctctgtgaccgccgctgacacggccgtgtattactgtgcgagagacatatttcactatgatactagtgggctccactcctggggccagggaaccctggtcaccgtctcctcagcctccaccaagggcccatcggtcttccccctggcaccctcctccaagagcacctctgggggcacagcggccctgggctgcctggtcaaggctacttcctatgtatactctgagcgggctggcaaggcgcatagnnnnn

SEQ ID NO: 217950 - DNA, 427 bp, Homo sapiens
  misc_feature: GYAE6OF02G41W0.29.42.D09.1.454.CMB.1.raw
  modified_base (423)..(427): a, c, t, g, unknown or other
  misc_feature (423)..(427): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattattggggccagggaaccctggtcaccgtctcctcagcctccaccaagggcccatcggtcttccccctggcaccctcctccaagagcacctctgggggcacagcggccctgggctgcctggtcaaggactacttccagtactctatctgagcgggctggcaaggcgcatagnnnnn

SEQ ID NO: 217951 - DNA, 537 bp, Homo sapiens
  misc_feature: GYAE6OF02JZY66.29.42.D09.1.454.CMB.1.raw
  modified_base (506)..(506): a, c, t, g, unknown or other
  misc_feature (506)..(506): n is a, c, g, or t
  modified_base (509)..(511): a, c, t, g, unknown or other
  misc_feature (509)..(511): n is a, c, g, or t
  modified_base (513)..(537): a, c, t, g, unknown or other
  misc_feature (513)..(537): n is a, c, g, or t
tcagatagagtactcacgaccggtgctcgatttagacacatacgcagggaaagggcctggagtggattggctacatctatcatactgggagcacctactacaacccgtccctcaaccagtcgagtcaccatctcactagacaagtccaactaccagttctccctaaacctgacctctgtgaccgccgctgacacggcctgtattactgtgcgagagacatatttcactatgatactagtgggctccactcctggggccagggaaccctggtcaccgtctcctcgagcctcccacctaacgggcccagtccggtccttccccccgtggccaccccgtccctccaacgcgccaccctccgtcgggggacctacgacgtccggcccctcggggcctcggccctgggtaccaacgggaccttaccttcccgttaacgtcggttaactaccgttcctacggtaacggtccggggacgttcgggacgaaccggggtcgccgtaagtacggcngcnnngnnnnnnnnnnnnnnnnnnnnnnnnn

SEQ ID NO: 217952 - DNA, 493 bp, Homo sapiens
  misc_feature: GYAE6OF02FGG5T.29.42.D09.1.454.CMB.1.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (289)..(289): a, c, t, g, unknown or other
  misc_feature (289)..(289): n is a, c, g, or t
  modified_base (487)..(493): a, c, t, g, unknown or other
  misc_feature (487)..(493): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttcctaccctaaacctgacctctgtgacccgccgctgacacggccgtgtatacngtgcgaganacattattcactatgatacgtgtcggcctccgactccgtggggccacggaaccctggtccaccgtcttccncacgccctaccgaccgacggccctagtccggtcctccccgtgccaccctcctaccgaacgacgccgtacccgtcggtcgggggaccacggaccggtcccggcccgttggggccttcggtccgtacggtacctaacggtaccttaccgtttacctagtcgtaactcgtcgtaggcggcggtgacggacgacgcgacagnnnnnnn

SEQ ID NO: 217953 - DNA, 426 bp, Homo sapiens
  misc_feature: GYAE6OF02GM1M2.29.42.D09.1.454.CMB.1.raw
  modified_base (420)..(426): a, c, t, g, unknown or other
  misc_feature (420)..(426): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctaaacctgacctctgtgaccgccgctgacacggccgtgtattactgtgctagagacatatttcactatgatactagtgggctccactcctggggccagggaaccctggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagnnnnnnn

SEQ ID NO: 217954 - DNA, 430 bp, Homo sapiens
  misc_feature: GYAE6OF02H5HA6.29.42.D09.1.454.CMB.1.raw
  modified_base (422)..(430): a, c, t, g, unknown or other
  misc_feature (422)..(430): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctaaacctgacctctgtgaccgccgctgacacggccgtgtattactgtgcgagagacatatttcactatgatactagtgggctccactcctggggccaggggaaccctggtcaccgtctcctcagcctccaccaagggcccatcggtcttccccctggccaccctcctccaagagcacctctggggacacagcggccctgggctgcctggtcaaggactacttcctatgtatactctgagcgggctggcaaggcgcatagnnnnnnnnn

SEQ ID NO: 217955 - DNA, 492 bp, Homo sapiens
  misc_feature: GYAE6OF02I5060.29.42.D09.1.454.CMB.1.raw
  modified_base (216)..(216): a, c, t, g, unknown or other
  misc_feature (216)..(216): n is a, c, g, or t
  modified_base (442)..(442): a, c, t, g, unknown or other
  misc_feature (442)..(442): n is a, c, g, or t
  modified_base (450)..(451): a, c, t, g, unknown or other
  misc_feature (450)..(451): n is a, c, g, or t
  modified_base (455)..(455): a, c, t, g, unknown or other
  misc_feature (455)..(455): n is a, c, g, or t
  modified_base (458)..(459): a, c, t, g, unknown or other
  misc_feature (458)..(459): n is a, c, g, or t
  modified_base (461)..(492): a, c, t, g, unknown or other
  misc_feature (461)..(492): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctaaaacctgacctctgtgaccgccgctgacacggccgtgtattactgtgcgagngacatatttcactatgatactagtgggctccactcctgggggcacgggaaccctggtcaccgtctcctcagcctccacacgggcccagtcggtcctccccgtgccaccctcctccaagacgccacctccgtggggcacgacgcggccctggggcctcgcccgtgggtacaacggtactaccgttccgtatcgttactaactcgtagacgcgggctggcaagggtcncgatacgnngtcngcnncnnnnnnnnnnnnnnnnnnnnnnnnnnnnnnnn

SEQ ID NO: 217956 - DNA, 437 bp, Homo sapiens
  misc_feature: GYAE6OF02GHD42.29.42.D09.1.454.CMB.1.raw
  modified_base (425)..(437): a, c, t, g, unknown or other
  misc_feature (425)..(437): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattagttggggccagggaaccctggtcaccgtctcctcagcctccaccaagggcccatcggcttccccctggccaccctcctccaagacgcacctctgggggcacgacgcggccctgggctgcctggtcaggactacttccagtactctatctgagcggctggcaaggcgcatagnnnnnnnnnnnnn

SEQ ID NO: 217957 - DNA, 451 bp, Homo sapiens
  misc_feature: GYAE6OF02IUNDY.29.42.D09.1.454.CMB.1.raw
  modified_base (436)..(451): a, c, t, g, unknown or other
  misc_feature (436)..(451): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaaagtccaactaccagttctccctgaagctgacgtctgtgaccgccgcggacacggccgtgtattactgtgccagagaagtgcggactggccattataaatactactttgattattgggccaggaacctggtcaccgtctctcagcctccaccaaggcccatcggtccttccccctggccaccctcctccaagacgaccacctcgtcggggggcaccgaggccggccctggggcctgcctggtcaaggctacttccagtactctatctgagcgggtctgggcaaggcgacagtagnnnnnnnnnnnnnnnn

SEQ ID NO: 217958 - DNA, 503 bp, Homo sapiens
  misc_feature: GYAE6OF02IXW4L.29.42.D09.1.454.CMB.1.raw
  modified_base (167)..(167): a, c, t, g, unknown or other
  misc_feature (167)..(167): n is a, c, g, or t
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (452)..(453): a, c, t, g, unknown or other
  misc_feature (452)..(453): n is a, c, g, or t
  modified_base (460)..(462): a, c, t, g, unknown or other
  misc_feature (460)..(462): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagatagagtactcacgaccggtgctcgatttagacacatacgcagggaaagggcctggagtggattggctacatctatcatactgggagcacctactacaacccgtccctcaaccagtcgagtcaccatctccactagacaagtccaactcagttctccctgaanctgacgtctgtgaccgccgcggacacggcccgtggttaattacctggtgccagacgaagtgcggactggcccattataaatctattgattagtgggccagggaccctggtcaccgtctcctcagcctcaccagggccagtcgtctcccctggcncctctcangcactcngggcacngcgcctagggcctgccctggtacgaggactacgtcacgtactcctatctagacgccgggntagggcctaaggctacgatacggnatnagacntcngcancgancgtncnngactcgnnntcagagngtacngtacgtcgacgtctacgacanctactgng

SEQ ID NO: 217959 - DNA, 510 bp, Homo sapiens
  misc_feature: GYAE6OF02HD7FI.29.42.D09.1.454.CMB.1.raw
  modified_base (479)..(510): a, c, t, g, unknown or other
  misc_feature (479)..(510): n is a, c, g, or t
tcagatagagtactcacgaccggtgctcgatttagacacatacgcagggaaagggcctggagtggattggctacatctatcatactgggagcacctactacaacccgtccctcaacagtcgagtcaccatctcactagacaagtccaactaccagttcctccctgaagctgacgtctgtgaccgccgcggacacggccgttgtattacgtgtgccagagaagtgcgtactggccattataaatctactttgattagttggggccagggtaacctggtcaccgtctcctcgacgcctccgaacaacgggccctacgtccggttacctttccccccgtggccctacccctccctaccgaacgtacgccctaccgtccggtcggggaccacgacgcccggccgtggctgccgtgtacaggtacctaccttcgagtactcgtactacgtgacggcggtctggccgaaggtccgcgaacgtagnnnnnnnnnnnnnnnnnnnnnnnnnnnnnnnn

SEQ ID NO: 217960 - DNA, 493 bp, Homo sapiens
  misc_feature: GYAE6OF02G0JSD.29.42.D09.1.454.CMB.1.raw
  modified_base (468)..(468): a, c, t, g, unknown or other
  misc_feature (468)..(468): n is a, c, g, or t
  modified_base (470)..(493): a, c, t, g, unknown or other
  misc_feature (470)..(493): n is a, c, g, or t
tcagatagagtactcacgaccggtgctcgatttagacacatacgcaggggaaagggcctggagtggattggctacatctatcatactgggagcacctactacaacccgtccctcaacagtcgagtcaccatctcactagacaagtccaactaccagttctccctaaacctgacctctgtgaccgccgctgacacggccgtgtattactgtgcgagagacattatttcactatgatactaggtggctccactccgtggggccacgggaaccctggtcaccgtctcctcacgcctccaccaagggcccagtccggtcctttccccccgtggcccacccctcctacccaacgacgccaccctcgtcgggggccacacggccggccccgtggggctcgccgttggtccgaacggacttaccgttccctctcctccgactctgacgccgggcgtggccgaaggccgcgatagntnnnnnnnnnnnnnnnnnnnnnnnn

SEQ ID NO: 217961 - DNA, 487 bp, Homo sapiens
  misc_feature: GYAE6OF01DL7BS.5.9.A09.1.454.CMB.1.raw
  modified_base (302)..(302): a, c, t, g, unknown or other
  misc_feature (302)..(302): n is a, c, g, or t
  modified_base (476)..(487): a, c, t, g, unknown or other
  misc_feature (476)..(487): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctcctggccatcactgggctccgggntgaggatgaggctgatttatactgtcaggcccttgacaactggtttgggtgtttgggtgttcgggcggagggaccaagctgaccgtctaagtcagccaaggctcgccccctcgtcactctcgttcccgccctcctccgtcgtctactctgacgcgggctggcaaggcgcatagnnnnnnnnnnnn

SEQ ID NO: 217962 - DNA, 519 bp, Homo sapiens
  misc_feature: GYAE6OF01CYW2U.5.9.A09.1.454.CMB.1.raw
  modified_base (329)..(329): a, c, t, g, unknown or other
  misc_feature (329)..(329): n is a, c, g, or t
  modified_base (367)..(367): a, c, t, g, unknown or other
  misc_feature (367)..(367): n is a, c, g, or t
  modified_base (502)..(505): a, c, t, g, unknown or other
  misc_feature (502)..(505): n is a, c, g, or t
  modified_base (507)..(519): a, c, t, g, unknown or other
  misc_feature (507)..(519): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcgacggggtccctgaccgattctctggctccaggtctggcaccgcagcctcctggccatcactgggctccgggctgaggatggaggctgatttattacngccaggcccttgacaactaggttttgggtgtttggggngttcgggcggagggaccaaggctgaccgtctaagtcagcccaaggctcgccccctggtcactctcgtccccgtccctccgtccgtcgtctcgtactcgtgacggccgggctcgggccgaacgggcgcgagtacgnnnngnnnnnnnnnnnnn

SEQ ID NO: 217963 - DNA, 509 bp, Homo sapiens
  misc_feature: GYAE6OF01CMCFK.5.9.A09.1.454.CMB.1.raw
  modified_base (252)..(252): a, c, t, g, unknown or other
  misc_feature (252)..(252): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
  modified_base (500)..(509): a, c, t, g, unknown or other
  misc_feature (500)..(509): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatcggccctcaggggtccctgaccgattcnctggctccaggtctggccaccgcacgccctccctggccatcacgtgggcctccggggctggaggatggaggctgatttattactgccaggcccttgactaacgtaggttttggggtgttttggggtgttcgggcggtaagggaccaaggctagacccgtcctaagtcagcccaaggctcgccccctgtcactctcgttcccnccctcctccgtntctgactctgagccgggctcgggcaggcgcatgnnnnnnnnnn

SEQ ID NO: 217964 - DNA, 547 bp, Homo sapiens
  misc_feature: GYAE6OF01CBU3M.5.9.A09.1.454.CMB.1.raw
  modified_base (530)..(532): a, c, t, g, unknown or other
  misc_feature (530)..(532): n is a, c, g, or t
  modified_base (534)..(535): a, c, t, g, unknown or other
  misc_feature (534)..(535): n is a, c, g, or t
  modified_base (537)..(547): a, c, t, g, unknown or other
  misc_feature (537)..(547): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagccccaaactcctcatctacgacaacaccaatcggccctcacggggtccctgaccgattctctggctccaggtctggcaccgcacgccctccctggccactcacgtcgggcctccgggctggaggatgaggctgattattactgccgagcccttagacaacgtagtttggggtgtttggggtgttcgggcggagggaccaaggtctagacccgtacgtaagtcagccaaggctcgccccctcggtctacctctccgttccctaccctcccgtccgtcgttcgtcgtacttcgtaggtacggccgggtcgtacgggccgaaacgggccgacgacgtaggcnnngnncnnnnnnnnnnn

SEQ ID NO: 217965 - DNA, 486 bp, Homo sapiens
  misc_feature: GYAE6OF01CP7XA.5.9.A09.1.454.CMB.1.raw
  modified_base (251)..(251): a, c, t, g, unknown or other
  misc_feature (251)..(251): n is a, c, g, or t
  modified_base (474)..(486): a, c, t, g, unknown or other
  misc_feature (474)..(486): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattcnctggctcaggtctggcaccgcagccctccctggccatcacgtgggcctccgggctgaggatgaggctgattatactgccaggcccttgacaacgtaggtttgggtgtttgggtgttcggcggagggaccaagctgaccgtctagcacgccaaggctcgcccctgtcactctcgtcccaccctcctccgtgtctgactcgtgacgcgggctggcaggcgcatgnnnnnnnnnnnnn

SEQ ID NO: 217966 - DNA, 509 bp, Homo sapiens
  misc_feature: GYAE6OF01CNVDK.5.9.A09.1.454.CMB.1.raw
  modified_base (331)..(331): a, c, t, g, unknown or other
  misc_feature (331)..(331): n is a, c, g, or t
  modified_base (493)..(509): a, c, t, g, unknown or other
  misc_feature (493)..(509): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaatcctcatctacgacaacaccaatccggccctcaggggtccctgaccgattctctggctccaggtctggccaccgcagccctccctggccatcactgggcctccgggctgaggatggaggctgatttattacngccaggcccttgactaacgtggttttggggtgtttggggtgttcgggcggtagggacctaagcgtgacccgtctaagtcacgcccaaggctcgccccctggtcactctcgtcccaccctcctccgtgtctgactctgacggcggcgtggcgagcgacagtgnnnnnnnnnnnnnnnnn

SEQ ID NO: 217967 - DNA, 522 bp, Homo sapiens
  misc_feature: GYAE6OF01EER6G.5.9.A09.1.454.CMB.1.raw
  modified_base (506)..(522): a, c, t, g, unknown or other
  misc_feature (506)..(522): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatccggccctcaggggtccctgaccgattctctggctccaggtctggccaccgcacgccctcctggccatccacgtgggcctccggggctggaggatggaggctgtatttattactgccaggtcccttagaactaacgtggtttgggtgtttgggtgttcgggcggagggaccagtcgtgaccgtctaagtcacgcccaagctcgcccctcggtctactctcgttcccacccttcctccgtcgtctgtactcgtggacgtcgggcgtcggacgaggcgcatagnnnnnnnnnnnnnnnnn

SEQ ID NO: 217968 - DNA, 499 bp, Homo sapiens
  misc_feature: GYAE6OF01CA4AR.5.9.A09.1.454.CMB.1.raw
  modified_base (478)..(478): a, c, t, g, unknown or other
  misc_feature (478)..(478): n is a, c, g, or t
  modified_base (484)..(499): a, c, t, g, unknown or other
  misc_feature (484)..(499): n is a, c, g, or t
tcagatcagacacgccacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagccctcctggccatcactgggctccgggctgaggatgaggctgattatactgccaggcccttgacaacgtaggttttgggtgtttggggtgttcgggcggagggaccaagctgaccgtctaagtcagcccaaggctcgcccctgtcactctcgtccccacctcctccgtgtctgactcgtgagcgggtctgggcaagggccgnagtagnnnnnnnnnnnnnnnn

SEQ ID NO: 217969 - DNA, 510 bp, Homo sapiens
  misc_feature: GYAE6OF01D2R5N.5.9.A09.1.454.CMB.1.raw
  modified_base (445)..(445): a, c, t, g, unknown or other
  misc_feature (445)..(445): n is a, c, g, or t
  modified_base (495)..(510): a, c, t, g, unknown or other
  misc_feature (495)..(510): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgagtcaggttatgatgtacattggtaccagcaacttccaggaacacgcccccaaaactcctcatctacgacaacaccaatcggccctcaggggtcccctgaccgattctctggctccaggtctggcaccgcagcctccctggccatcacgtggggcctccggggctggaggatggaggctgatttatactgccaggcccttgaactaacgtggtttgggtgttttgggtgttcggcggagggaccaagctgaccgtctaagtcacgccgaggctcgcccctcggtcactctcgttccccnccctcctccgtgtctgctcgtgacggcgggtctcgggacaggcacatagnnnnnnnnnnnnnnnn

SEQ ID NO: 217970 - DNA, 570 bp, Homo sapiens
  misc_feature: GYAE6OF01BXKAS.5.9.A09.1.454.CMB.1.raw
  modified_base (316)..(316): a, c, t, g, unknown or other
  misc_feature (316)..(316): n is a, c, g, or t
  modified_base (555)..(570): a, c, t, g, unknown or other
  misc_feature (555)..(570): n is a, c, g, or t
tcagatcagacacgcacgaccggtgctcgatttagcgagacgcgcagggtcctgggcccagtctgtggtgacgcagccgccctccgtttctggggcccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctcgtggctccaggtctggccaccgcacgccctcctggcccatccactcgggctccgggctgaggntggagctgattatactgccaggccttgactaacgtaggttgggtgtttgggcgttcgggacggtagggaccaaggtctacggtacccgtacgttaacgtccgacgaccccgtaaggtcccgtaccggcccccccgttcgggtaccctaccgtttccgttccgtttccccctaccccttccccgttccgtcgttcgtcgtactcgtgcggtcgggtcgtacggcgtaaggccgcagtagnnnnnnnnnnnnnnnn

SEQ ID NO: 217971 - DNA, 515 bp, Homo sapiens
  misc_feature: GYAE6OF01BXK1Z.5.9.A09.1.454.CMB.1.raw
  modified_base (317)..(317): a, c, t, g, unknown or other
  misc_feature (317)..(317): n is a, c, g, or t
  modified_base (438)..(438): a, c, t, g, unknown or other
  misc_feature (438)..(438): n is a, c, g, or t
  modified_base (493)..(493): a, c, t, g, unknown or other
  misc_feature (493)..(493): n is a, c, g, or t
  modified_base (499)..(515): a, c, t, g, unknown or other
  misc_feature (499)..(515): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaatcctcatctacgacaacaccaatcggccctcaggggtccctgaccgattctctggctccaggtctggcaccgcacgcctccctggcccatccacgtcggggcctccggggctggaggntggaggctgatttattactgccaggtcccttaggacctaacgtggtttggggtgttttggggtgttcgggcggagggaccaagcgtgaccgtctaagtcacgcccaggctcgcccctgtcnctctcgttccccgccctcctccgtgtctgactctggacgcggcgtggacgaggcncagtgnnnnnnnnnnnnnnnnn

SEQ ID NO: 217972 - DNA, 510 bp, Homo sapiens
  misc_feature: GYAE6OF01BSNIY.5.9.A09.1.454.CMB.1.raw
  modified_base (490)..(490): a, c, t, g, unknown or other
  misc_feature (490)..(490): n is a, c, g, or t
  modified_base (495)..(510): a, c, t, g, unknown or other
  misc_feature (495)..(510): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagccctcctggccatcacgtgggcctccgggctggaggatggaggctgatttatactgccaggcccttagacaacgtggtttggggtgtttggggtgttccgggcggaagggacccaaaggctacgacccgtctaagtcacgcccaaggcctcgccccctggtccactctcgttccccgccctcctccgtgtctgatcgtgcgcggctggacaggcncatgnnnnnnnnnnnnnnnn

SEQ ID NO: 217973 - DNA, 485 bp, Homo sapiens
  misc_feature: GYAE6OF01CTNDS.5.9.A09.1.454.CMB.1.raw
  modified_base (443)..(443): a, c, t, g, unknown or other
  misc_feature (443)..(443): n is a, c, g, or t
  modified_base (474)..(485): a, c, t, g, unknown or other
  misc_feature (474)..(485): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcgaggggtccctgaccgattctctggctccaggtctggcaccgcagccctcctggccatcactgggctccgggctggaggatggaggctgattattactgccaggcccttgacaactaggttttgggtgtttgggtgttcggcggagggaccaagctgaccgtctagtcacgccaggctcgcccctgtcactctcgtcccaccctcctccgtntctgatctgacgcgggctggcaggcgcatgnnnnnnnnnnnn

SEQ ID NO: 217974 - DNA, 614 bp, Homo sapiens
  misc_feature: GYAE6OF01BZEOU.5.9.A09.1.454.CMB.1.raw
  modified_base (308)..(308): a, c, t, g, unknown or other
  misc_feature (308)..(308): n is a, c, g, or t
  modified_base (592)..(592): a, c, t, g, unknown or other
  misc_feature (592)..(592): n is a, c, g, or t
  modified_base (599)..(599): a, c, t, g, unknown or other
  misc_feature (599)..(599): n is a, c, g, or t
  modified_base (606)..(606): a, c, t, g, unknown or other
  misc_feature (606)..(606): n is a, c, g, or t
  modified_base (609)..(609): a, c, t, g, unknown or other
  misc_feature (609)..(609): n is a, c, g, or t
  modified_base (612)..(612): a, c, t, g, unknown or other
  misc_feature (612)..(612): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaaccacgccccaaactcctcatctacgacaacacaatccggccctcgaggggtccctgaccgattctctggctccaggtctggcaccgcagcctcctgccatcacgtgggctcgggctgagntggagctgtattatactgccaggtcccttgaacaacgtggttttcgggtgtttgggtcgttcgggacgggtaacgggaccaaggtctacggacccgttcctaagtccgacgacccgaagggtcctacggccccccgttcgggtcctaaccgttccgttccgttaccccctaccccgttccccgtttccggttcgttcccgttacgacgtttccgtaggtaccgggtccgggtcgttacgggaccgaacggggtccgtacgtaacgttacggcacgtcgctcgcncgtcgcncgcgtcncanctngc

SEQ ID NO: 217975 - DNA, 642 bp, Homo sapiens
  misc_feature: GYAE6OF01EQ8XP.5.9.A09.1.454.CMB.1.raw
  modified_base (625)..(625): a, c, t, g, unknown or other
  misc_feature (625)..(625): n is a, c, g, or t
  modified_base (628)..(629): a, c, t, g, unknown or other
  misc_feature (628)..(629): n is a, c, g, or t
  modified_base (631)..(633): a, c, t, g, unknown or other
  misc_feature (631)..(633): n is a, c, g, or t
  modified_base (637)..(642): a, c, t, g, unknown or other
  misc_feature (637)..(642): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatccggccctcacggggtccctgaccgattctctggctccaggtctggccaccgcacgccctccgtgccatccacgtcgggccgtccggggctggaggatggaggtctagtatttacttacgtcgacccacggtccccttagaacctaacgttaggttttggggttgttttggggtcgtttcgggcgggaagggtaacccaaggtccgtacggtacccgttacgtaacgtcgacgacccgaacggtccgtcccgtcccccgtcggtcctaccgttcccgttcccgtttaccccctacccccgttcccgttcccgttcgttcccgttacggtacttccggtggaccggtccggggtccgtccggggaccgtaaccgggccgtaccgtaaggtacgcgagcgacnctnncnnncgcnnnnnn

SEQ ID NO: 217976 - DNA, 538 bp, Homo sapiens
  misc_feature: GYAE6OF01C8ZMK.5.9.A09.1.454.CMB.1.raw
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (519)..(519): a, c, t, g, unknown or other
  misc_feature (519)..(519): n is a, c, g, or t
  modified_base (522)..(523): a, c, t, g, unknown or other
  misc_feature (522)..(523): n is a, c, g, or t
  modified_base (525)..(538): a, c, t, g, unknown or other
  misc_feature (525)..(538): n is a, c, g, or t
tcagatcagacacgcacgaccggtgctcgatttagcgagacgcgcagggtcctgggcccagtctgtggtgacgcagccgccctccgtttctggggcccccagggcagacggtcaccatctcctgcactggaagcagctccgacatcgggtcaggttatgatgtacattggtaccagcaacttccaggaacacgcccccaaactcctcatctacgacaacaccaatcggccctcgacggggtccctgaccgattctctggctccaggtctggcaccgcagccctcctggccatcactgggccgtccgggctgaggatggaggctgatttatacncgccncggtccttagacaacgtggtttgggtgtttgggtgttcgggcggagggaccagcgtcgaccgtcgtaagtcacgacccaaggcctccgtccccctcggtcctacgtccgttccgttccccgcccttcccgtccgtcgtctcgtctcgtcgaggtccgggtctcggacgacggcgcagtagnagnngnnnnnnnnnnnnnn

SEQ ID NO: 217977 - DNA, 641 bp, Homo sapiens
  misc_feature: GYAE6OF01AI0EW.5.9.A09.1.454.CMB.1.raw
  modified_base (316)..(316): a, c, t, g, unknown or other
  misc_feature (316)..(316): n is a, c, g, or t
  modified_base (619)..(619): a, c, t, g, unknown or other
  misc_feature (619)..(619): n is a, c, g, or t
  modified_base (628)..(628): a, c, t, g, unknown or other
  misc_feature (628)..(628): n is a, c, g, or t
  modified_base (630)..(631): a, c, t, g, unknown or other
  misc_feature (630)..(631): n is a, c, g, or t
  modified_base (635)..(638): a, c, t, g, unknown or other
  misc_feature (635)..(638): n is a, c, g, or t
  modified_base (640)..(641): a, c, t, g, unknown or other
  misc_feature (640)..(641): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcgacggggtcccctgaccgattcctctggcctccaggtctggccaccgcagcctcctggccatcacgtgggcctccgggctgaggntgaggctgattattacgcgccgaggcccttgaactaacgtaggttttggggtgttttgggtcggtttcgggcgggtaaggggaccctaaaggtccgttacggtacccgttacccgtaaagttccgaacggccccgtaaagggtccgttcggccccttcccggttcgggtaccctaccgttccgttccggtttccccccgtccccgtttcccgttcccggttcgtttccgtcggttacttcccggttggaccgggcggggtcccgttgggacccgtaacggggcccgacgtaacggtacgtcgngtgcgtgcngnnctcnnnngnn

SEQ ID NO: 217978 - DNA, 585 bp, Homo sapiens
  misc_feature: GYAE6OF01DL3LL.5.9.A09.1.454.CMB.1.raw
  modified_base (309)..(309): a, c, t, g, unknown or other
  misc_feature (309)..(309): n is a, c, g, or t
  modified_base (334)..(334): a, c, t, g, unknown or other
  misc_feature (334)..(334): n is a, c, g, or t
  modified_base (568)..(571): a, c, t, g, unknown or other
  misc_feature (568)..(571): n is a, c, g, or t
  modified_base (573)..(585): a, c, t, g, unknown or other
  misc_feature (573)..(585): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcacggggtccctgaccgattctctggctccaggtctggccaccgcacgcctccctggcccatcactggggcctccgggntgaggatggaggctgatttattacngaccaggtcccttagacctaacgtggttttggggtgttttggggtgttcgggcgggaacggggacccaaaggccgtaggtaacccgttacgtaacggtccaacgccccgaaacgggtccgtacccgccccccgttcgggtcctaccttccgttccgtttcccccgtccccttcccgtcccgttggtcctcgtactcgtggacggtccgggtctcgggcctaggccgcagtacgnnnngnnnnnnnnnnnnn

SEQ ID NO: 217979 - DNA, 487 bp, Homo sapiens
  misc_feature: GYAE6OF01C209M.5.9.A09.1.454.CMB.1.raw
  modified_base (253)..(253): a, c, t, g, unknown or other
  misc_feature (253)..(253): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (466)..(466): a, c, t, g, unknown or other
  misc_feature (466)..(466): n is a, c, g, or t
  modified_base (470)..(473): a, c, t, g, unknown or other
  misc_feature (470)..(473): n is a, c, g, or t
  modified_base (475)..(487): a, c, t, g, unknown or other
  misc_feature (475)..(487): n is a, c, g, or t
tcagatcagacacgcacgaccggtgctcgatttagcgagacgcgcagggtcctgggcccagtctgtggtgacgcagccgccctccgtttctggggcccccagggcagacggtcaccatctcctgcactggaagcagctccgacatcgggtcaggttatgatgtacattggtaccagcaacttccaggaacacgcccccaaactcctcatctacgacaacaccaatcggccctcaggggtccctgaccgattcnctggctcaggtctggcaccgcagcctcctgccatcactgggctccgggntgagntgaggctgatttatactgccaggcccttgactaactggtttgggtgtttgggtgttcgggcggtaggaccaagctgaccgtctagtcacgccaagctcgcccctgtctactctcgtcccgccctctccgtgtctgctcgtgacgcggctggcgaggcgnatgnnnngnnnnnnnnnnnnn

SEQ ID NO: 217980 - DNA, 691 bp, Homo sapiens
  misc_feature: GYAE6OF01DBK2P.5.9.A09.1.454.CMB.1.raw
  modified_base (127)..(127): a, c, t, g, unknown or other
  misc_feature (127)..(127): n is a, c, g, or t
  modified_base (285)..(285): a, c, t, g, unknown or other
  misc_feature (285)..(285): n is a, c, g, or t
  modified_base (646)..(646): a, c, t, g, unknown or other
  misc_feature (646)..(646): n is a, c, g, or t
  modified_base (673)..(677): a, c, t, g, unknown or other
  misc_feature (673)..(677): n is a, c, g, or t
  modified_base (679)..(691): a, c, t, g, unknown or other
  misc_feature (679)..(691): n is a, c, g, or t
tcagatcagacacgcacgaccggtgctcgatttagcgagacgcgcagggtcctgggcccagtctgtggtgacgcagccgcccttccgtttctggggccccagggcagacggtcaccatcctcctgcnctggaagcagctccgaacatcgggtcaggttatgatgtacattggtaccagcaacttccaggaacacgccccaaactcctcatctacgacacacactccggcctcgacgggtccctgaccgtattctctcggcctccgaggtcgtcgcctacccgacncgtccctccctcggcctctaccgacggtccgggtcggtcccgggtcgttaggacgggtagtggtacgtcggtatttacgttacgtacgccgtaccgtccggttacctacggtaaactacggtttcggggtttaggggtttggggtttacggtttacgggtaccggggaacgggtacccggtaaacgaccggttcgtaccggtacccgtttaccggtaactaccgacccgtaaccggcgtttccgtccccccgttaccccggttacgcccttaccgttttacccgtcccccgttaccccgtttccccttccggtacgtttgtaccgttacgttccgcgggttaagggccggggttcccccgngttaaccgggaacgcggtcacgtaggnnnnngnnnnnnnnnnnnn

SEQ ID NO: 217981 - DNA, 571 bp, Homo sapiens
  misc_feature: GYAE6OF01CQHHL.5.9.A09.1.454.CMB.1.raw
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (334)..(334): a, c, t, g, unknown or other
  misc_feature (334)..(334): n is a, c, g, or t
  modified_base (556)..(571): a, c, t, g, unknown or other
  misc_feature (556)..(571): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatccggccctcgaggggtccctgaccgattcnctggctccaggtctggcaccgcagccctcctggccatccacgtgggcctccgggntggaggatggaggctgatttatacngccaggcccttgacaacgtggttttggggtgtttggggtgttcgggcggtaaggggacctaaggccgttaggaacccgttacctaagtccgaacgaccccgaaggtcctccgtcccccgttcggtactaccttccgttccgttcccctaccccttccctccgttcgtcgtgtacttcgtcggacggtcgggtcgtcgggacgtacgggccgacgtagtagcnnnnnnnnnnnnnnnn

SEQ ID NO: 217982 - DNA, 719 bp, Homo sapiens
  misc_feature: GYAE6OF01CXSL1.5.9.A09.1.454.CMB.1.raw
  modified_base (355)..(355): a, c, t, g, unknown or other
  misc_feature (355)..(355): n is a, c, g, or t
  modified_base (688)..(688): a, c, t, g, unknown or other
  misc_feature (688)..(688): n is a, c, g, or t
  modified_base (704)..(704): a, c, t, g, unknown or other
  misc_feature (704)..(704): n is a, c, g, or t
  modified_base (712)..(713): a, c, t, g, unknown or other
  misc_feature (712)..(713): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatccggccctcgagggtccctgaccgtattctctggcctccgaggttctggccaccgcacgccctcccgtggcccatccgacgtcgggccgtccgggcttggaggatggaggtcttagtaattttacgttacncggacccgtacggtcccttagactaaacgttgggtttttggggtaggttttggggtacggtttccggggaacggtaacggggtaaccctaaacgggtccgttacgggtaaccccgtttccgtaaacgtccgtaaccggtaccccggtaaacgggtcccgtccccggttacccccccgttacgggttaccccgtaccgtttcccgtttacccggttccccccgtcccccgtttcccgttcccggttcgttccgttcgtaaccgttcggttacgggtacggtccgggtccgttacgggaccgtaacggggaccgtacgtaacggtacgtcgacgngcgtcgtagcacgcgngcgtcacnncngngc

SEQ ID NO: 217983 - DNA, 657 bp, Homo sapiens
  misc_feature: GYAE6OF01B4QOF.5.9.A09.1.454.CMB.1.raw
  modified_base (630)..(630): a, c, t, g, unknown or other
  misc_feature (630)..(630): n is a, c, g, or t
  modified_base (635)..(635): a, c, t, g, unknown or other
  misc_feature (635)..(635): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
  modified_base (645)..(645): a, c, t, g, unknown or other
  misc_feature (645)..(645): n is a, c, g, or t
  modified_base (650)..(653): a, c, t, g, unknown or other
  misc_feature (650)..(653): n is a, c, g, or t
  modified_base (655)..(655): a, c, t, g, unknown or other
  misc_feature (655)..(655): n is a, c, g, or t
tcagatcagacacgcacgaccggtgctcgatttagcgagacgcgcgagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcgaggggtccctgaccgattctctggctccaggtctggcaccgcacgccctccgtggccatccacgtgggcctccggggctggaggatggaggctgtatttatactgaccacggtcccttagaactaacgtaggttttggggtaggttttggggtcggttcgggacgggtacgggacccaaaggtccgttacgggaaccccgttcctaaaggttcccgacggaccccgtaagggtcccttacccggcccccccgttcgggttaccaaccgtttcccgttacccggtttccccctaaccccgttccctttccccggtcgttccgttcggtactttcggtacggacgggtcccggggtaccgttcggggaccgtaacgggcccgtactaaacggttcgcgngcgtncgngncgcgngctcnnnngngc

SEQ ID NO: 217984 - DNA, 610 bp, Homo sapiens
  misc_feature: GYAE6OF01D12MF.5.9.A09.1.454.CMB.1.raw
  modified_base (593)..(593): a, c, t, g, unknown or other
  misc_feature (593)..(593): n is a, c, g, or t
  modified_base (595)..(610): a, c, t, g, unknown or other
  misc_feature (595)..(610): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaaactcctcatctacgacaacaccaatcggccctcacggggtccctgaccgattctctggctccaggtctggccaccgcacgcctcctgccatcacgtgggcctccgggctggaggatggacggtctagtatttattaccgtcgccgacggtccccttagacctaaacgttgggttttggggttggttttggggtggtttcgggcgggaacggggaccaaggtccgtacggtaacccgttaccttaaggtccacggaccccgtaacgggtcctacccggtcccccccgttacgggtaccctaccgttcccgttcccggtttcccccgtccccttcccgttccgttcgttctcgtactcgtggtacggccggtcgtcggacgacgggcgacagtagncnnnnnnnnnnnnnnnn

SEQ ID NO: 217985 - DNA, 582 bp, Homo sapiens
  misc_feature: GYAE6OF01B3QYK.5.9.A09.1.454.CMB.1.raw
  modified_base (565)..(565): a, c, t, g, unknown or other
  misc_feature (565)..(565): n is a, c, g, or t
  modified_base (567)..(569): a, c, t, g, unknown or other
  misc_feature (567)..(569): n is a, c, g, or t
  modified_base (571)..(574): a, c, t, g, unknown or other
  misc_feature (571)..(574): n is a, c, g, or t
  modified_base (576)..(582): a, c, t, g, unknown or other
  misc_feature (576)..(582): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatccgccctcacgggtccctgaccgattctctggctccgaggtctggcaccgcacgccctccctggccatcacgtcgggctccgggctggaggtatggaggctgtatttatactgccagcccttgacaatggttgggttgttgggtgttcggcggaggaccagtccgtacgacccgtctaagtcacgcccgaaggcctaccggtcccccgttcgtcctaccgttccgttcccgttccccctaccccgttcccgttacccggtcgttacccttcggtacttccgtcggtacgggccggggtaccgtcgggaccgaacgggtccgaccgtagtaacggtcagcgngnnngnnnngnnnnnnn

SEQ ID NO: 217986 - DNA, 623 bp, Homo sapiens
  misc_feature: GYAE6OF01DGJ1N.5.9.A09.1.454.CMB.1.raw
  modified_base (605)..(605): a, c, t, g, unknown or other
  misc_feature (605)..(605): n is a, c, g, or t
  modified_base (607)..(608): a, c, t, g, unknown or other
  misc_feature (607)..(608): n is a, c, g, or t
  modified_base (610)..(623): a, c, t, g, unknown or other
  misc_feature (610)..(623): n is a, c, g, or t
tcagatcagacacgcacgaccggtgctcgatttagcgagacgcgcagggtcctgggcccagtctgtggtgacgcagccgccctccgtttctggggcccccagggcagacggtcaccatctcctgcactggaagcagctccgacatcgggtcaggttatgatgtacattggtaccagcaacttccaggaacagcccccaaactcctcatctacgacaacaccaatccggccctcgacggggtccctgaccgtattctctggctcaggtctggccaccgcagccctcctggccatccgacgtgggccgtccgggctggaggatggaggtctgtaatttatactgacccacggtcccttagaactaaacgttgggttttcggggttggttttcggggtgtttccggggcgggtaacggggaccctaaaggccgttacggaacccggttcctaagtcgaaccggacccgaacggtcctaccggtccccccgttcggtacctacgttcccttccgttccccctaccccttcccgttcccgttcgttcgtacgtacttcgtacggacggtcgggtccgtacgggtaccgaacgggccgacgtaagtacgangnngnnnnnnnnnnnnnn

SEQ ID NO: 217987 - DNA, 614 bp, Homo sapiens
  misc_feature: GYAE6OF01BARYF.5.9.A09.1.454.CMB.1.raw
  modified_base (593)..(593): a, c, t, g, unknown or other
  misc_feature (593)..(593): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (602)..(614): a, c, t, g, unknown or other
  misc_feature (602)..(614): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaaggaacacgcccccaaactcctcatctaacgacaacaccaatccggccctcgacggggtcccctagacccgtatttcctctcggcctccgacggtctggccaaccgcacgccctcctggccatcacgtcgggcctccggggctggaggatggaggcttagatttatacctgcctaggccccttagaaactaagtggtttgggtgtttggggcgttcgggacgggaacggtaaccaaggtccgtacggacccgtttacctaaagtcgacggtacccgaagggtccgtccgtccccccgttcggtacctaccgttccgttccgttccccctaccccttcccgtacccgttcgtcgtacgtcttcgtggacgggtcgggtccgtacgggaccgtaacggccgactaacgtgngtcngngcnnnnnnnnnnnnn

SEQ ID NO: 217988 - DNA, 630 bp, Homo sapiens
  misc_feature: GYAE6OF01DFN61.5.9.A09.1.454.CMB.1.raw
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (608)..(608): a, c, t, g, unknown or other
  misc_feature (608)..(608): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (617)..(621): a, c, t, g, unknown or other
  misc_feature (617)..(621): n is a, c, g, or t
  modified_base (623)..(623): a, c, t, g, unknown or other
  misc_feature (623)..(623): n is a, c, g, or t
  modified_base (625)..(626): a, c, t, g, unknown or other
  misc_feature (625)..(626): n is a, c, g, or t
  modified_base (628)..(630): a, c, t, g, unknown or other
  misc_feature (628)..(630): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggacagcaacttccaaggaacacgcccccaaactcctcatctacgaacaacaccaatccggccctcgacggggtcccngaccgtattcnctggctcgaggtctggccacgcacgtcctccgtggccctatcgacgtgggcctccgggctggacggagtggacggtctgtaatttacgtactcgccgtacggtccctttagaactaacgttagggttttggggttgttttgggggtacgttcgggacgggtaagggacctaaggcgttacggacccgttactaacgtccgtacggaccccgaaggtccgtcccgtccccccggttcgtaccgtactacccggtttccgttccccctaccccgttcccgtcccgttcgttacgtacgtacgttcgtcggtacgggtccgggtcggtcggaccggtacggcgtacgtagtacgntcgangngnnnnncnanncnnn

SEQ ID NO: 217989 - DNA, 760 bp, Homo sapiens
  misc_feature: GYAE6OF01CI3XV.5.9.A09.1.454.CMB.1.raw
  modified_base (742)..(742): a, c, t, g, unknown or other
  misc_feature (742)..(742): n is a, c, g, or t
  modified_base (744)..(745): a, c, t, g, unknown or other
  misc_feature (744)..(745): n is a, c, g, or t
  modified_base (747)..(747): a, c, t, g, unknown or other
  misc_feature (747)..(747): n is a, c, g, or t
  modified_base (750)..(751): a, c, t, g, unknown or other
  misc_feature (750)..(751): n is a, c, g, or t
  modified_base (753)..(753): a, c, t, g, unknown or other
  misc_feature (753)..(753): n is a, c, g, or t
  modified_base (755)..(760): a, c, t, g, unknown or other
  misc_feature (755)..(760): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctcgacagtcgggtcaggttatgatgtacattggtaccagcaacttccaaggaaccacgcccccaaaactcctcactctacgaacaacaccaatccggcctcgacggggtccctgaccgtattctcgtcggccttccgacggtctcggaccacccgcacgtccctccgtggccatccgacgtcggggcctccgggctggacggagtcggacggtcttaggtacttttaacgttaccgtcggtaccgtaccgggttccctttacggaaacccttaaacggttggggttttttcgggggttggtttttcgggggtttcggttcccgggggaacgggtaaaccggggtacccgtaaacggtccggtttaaccggtaccccggtttaccgttaaacggttccgaaccggttaccccggtaacgggtccccgttaccccggtcccccccggtttacgggttacccctacccgttttcccggttaccccgtttaccccccgttaaccccgtttccccgtttccgggtttaccgttccgttacggtaccttacggtcgggaaccgggtccgggtacgttcgggacccgtaacggccgtactagtacgctacgcngnncncgnncncnnnnnn

SEQ ID NO: 217990 - DNA, 734 bp, Homo sapiens
  misc_feature: GYAE6OF01D2831.5.9.A09.1.454.CMB.1.raw
  modified_base (329)..(329): a, c, t, g, unknown or other
  misc_feature (329)..(329): n is a, c, g, or t
  modified_base (690)..(690): a, c, t, g, unknown or other
  misc_feature (690)..(690): n is a, c, g, or t
  modified_base (708)..(708): a, c, t, g, unknown or other
  misc_feature (708)..(708): n is a, c, g, or t
  modified_base (731)..(731): a, c, t, g, unknown or other
  misc_feature (731)..(731): n is a, c, g, or t
tcagatcagacacgcacgaccggtgctcgatttagcgagacgcgcagggtcctgggcccagtctgtggtgacgcagccgccctccgtttctcggggccccaggcagacggtcaccatctcctgcactggaagcagctccgacagtcgggtcaggttatgatgtacattggtaccagcaacttcaaggaaccacgaccccaaactcctcatctaacacaacaaccaatccggccctcgacggggtccctagaccgtattctacgtcggcctccgaggtctcggaccaccgcacgtccctccgcgaccactcgacggtcggccgtccgggntacggagtagtcggaggtcttagtaacttttacgttaccgtacgacccgtaccggtcccgttaagaaaccgttaaacgtttagggttttggggtttggtttacgggggttcggttaccggggacgggtaacgggtaaaccgtaacggtccgttacggaaccctttacggtaaacgtccgaaccggtacccgaagggtcccctaccccggtcccccgttacggttacccgtacccttccggtttacccgttccccccgtcccgttacccgtttccgtcgtttacgtacggtaaccgttccgtacggaccgggtccgggtacggttacgggaaccggtaaccgggtacgaccgaagttaccgngtacgtcagtcgtagacngacgagtacgtactacgatctgngtg

SEQ ID NO: 217991 - DNA, 639 bp, Homo sapiens
  misc_feature: GYAE6OF01BGIUS.5.9.A09.1.454.CMB.1.raw
  modified_base (331)..(331): a, c, t, g, unknown or other
  misc_feature (331)..(331): n is a, c, g, or t
  modified_base (609)..(609): a, c, t, g, unknown or other
  misc_feature (609)..(609): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(636): a, c, t, g, unknown or other
  misc_feature (635)..(636): n is a, c, g, or t
  modified_base (638)..(638): a, c, t, g, unknown or other
  misc_feature (638)..(638): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaaggaacacgccccaaactcctcatctacgacaacaccaatcggccctcgacggggtccctagaccgtattctcgtggctccgaggttctggcaccgcacggtccctcccgtggaccactcacggttgggccttccgggctgacggtntggaggtctggaattttatacgtcgccaaggtccccttaggaaccaacgttagggttttggggtcggttttaggggtacggttacggcgggtaacggacccaaaggtccgttaggaccccgttaccgtaagtaccgtacggacccgtaagggccttaccgcccccgtacggttacctacttcccgttccgtcccctaaccccgtccgttccgtaccgttctacgtacttacgtcggacggtcccgggcttcgggaccgacgggtccgactacgtaggngtcngngcntacgngnangnanancnngng

SEQ ID NO: 217992 - DNA, 637 bp, Homo sapiens
  misc_feature: GYAE6OF01DC4YJ.5.9.A09.1.454.CMB.1.raw
  modified_base (624)..(637): a, c, t, g, unknown or other
  misc_feature (624)..(637): n is a, c, g, or t
tcagatcagacacgcacgaccggtgctcgatttagcgagacgcgcagggtcctgggcccagtctgtggtgacgcagcccgccctccgtttctggggccccagggcagacggtcaccatctcctgcactggaagcagctccgacatcgggtcaggttatgatgtacattggtaccagcaacttccaggaacacgccccccaaaactcctcatctaaccgaacaacaccaatccggcccctcgaggggtcccctgactgtacttctcgtcggctccgaggtctcgggcacccgcacgccctcccgtggccaatccgacgtcgggccgtccgggactggacggatgggacgtccgtagtaactttattaccgcggaccgtcggtaccctttagaacctaggttagggttttgggttggtttggggtcgttcgggacggggaggtaaccagtccgtacgtacccgtacgtaacgtccgaaccgtccgtaacggcccgttccccggtcccccgttcgggtaccctacccgttcccgtttacccgttccccccggttccccttcccgttccgttcgttccgtctacgtcgtcggacgggtcgggtcgtcgcggtaacggctacgatcggnnnnnnnnnnnnnn

SEQ ID NO: 217993 - DNA, 716 bp, Homo sapiens
  misc_feature: GYAE6OF01EJS64.5.9.A09.1.454.CMB.1.raw
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
  modified_base (695)..(695): a, c, t, g, unknown or other
  misc_feature (695)..(695): n is a, c, g, or t
  modified_base (697)..(698): a, c, t, g, unknown or other
  misc_feature (697)..(698): n is a, c, g, or t
  modified_base (702)..(702): a, c, t, g, unknown or other
  misc_feature (702)..(702): n is a, c, g, or t
  modified_base (706)..(706): a, c, t, g, unknown or other
  misc_feature (706)..(706): n is a, c, g, or t
  modified_base (710)..(714): a, c, t, g, unknown or other
  misc_feature (710)..(714): n is a, c, g, or t
  modified_base (716)..(716): a, c, t, g, unknown or other
  misc_feature (716)..(716): n is a, c, g, or t
tcagatcagacacgcacgaccggtgctcgatttagcgagacgcgcagggtcctgggcccagtctgtggtgacgcagcccgccctccgtttctggggccccagggcagacggtcaccatctcctgcactggaagcagctccgacatcgggtcaggttatgatgtacattggtaccagcaacttccaggaacacgcccccaaactcctcatctaacgacaacaccaatcgcctcgacggggtccctgaccgattcctctggcctccgaggtctggccaccgcacgccctcctggccatcacgtgggcctccggggctggacggatggacggcctaggtatttacgttactcggcccaaggtccccttagaacctaacgttgggttttggggttcggttttgggggtacgtttccggggacgggtaacgggggaaccctaaagggtccgttacggtaaccccggttaccgttaaaggttcccgaaccggccccgtaaacgggccccgttccccgggtaccccccccgttcgggttaccctaccgtttcccggttcccggttttacccccccggtcccccgtttcccccgtttcccggtttcggttaccctttacgggtacctttccggtacggtaccggggtcccgggtaccgttccgggacgtaaaccggggccgtacgtaacgtacggtncncgcncnngcgngcgngtcnnnnngn

SEQ ID NO: 217994 - DNA, 586 bp, Homo sapiens
  misc_feature: GYAE6OF01BMYHV.5.9.A09.1.454.CMB.1.raw
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
  modified_base (569)..(586): a, c, t, g, unknown or other
  misc_feature (569)..(586): n is a, c, g, or t
tcagatcagacacgcacgaccggtgctcgatttagcgagacgcgcagggtcctgggcccagtctgtggtgacgcagccgccctccgtttctggggcccccagggcagacggtcaccatctcctgcactggaagcagctccgacagtcgggtcaggttatgatgtactattggtaccagactaacttccgaaggaaccaccgaccccctaaactcctacactcctaacgaacaaaccaccaacgtccggccctacggacggggtcccctacggaccgtattcctcgtcggcctccgaggttcctggccaccgcacgccctccgnggaccntcacgtcgggctccgggntggaggntggagctagtatttctcncgccacggtcctagactagtgtttgggtgtttgggtcgttcggacggacggaacaggtcctagtacccgtactacgtcaccgtccgagcctccgtccccgtgtccacgttccgttacccgtccccgtcccttccgtccgtcgtcttacgcgttcgacggacggtccgggcgtacggacgacggcctacgtgtaccgnnnnnnnnnnnnnnnnnn

SEQ ID NO: 217995 - DNA, 701 bp, Homo sapiens
  misc_feature: GYAE6OF01A2EXF.5.9.A09.1.454.CMB.1.raw
  modified_base (69)..(69): a, c, t, g, unknown or other
  misc_feature (69)..(69): n is a, c, g, or t
  modified_base (684)..(684): a, c, t, g, unknown or other
  misc_feature (684)..(684): n is a, c, g, or t
  modified_base (686)..(689): a, c, t, g, unknown or other
  misc_feature (686)..(689): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (695)..(699): a, c, t, g, unknown or other
  misc_feature (695)..(699): n is a, c, g, or t
  modified_base (701)..(701): a, c, t, g, unknown or other
  misc_feature (701)..(701): n is a, c, g, or t
tcagatcagacacgcacgaccggtgctcgatttagcgagacgcgcagggtcctgggcccagtctgtggngacgcagcccgcccttccgtttctggggccccagggcagacggtcaccatctcctgcactggaagcagcctccgacatcgggtcaggttatgatgtacattggtaccagcaacttccaaggaacacgccccaaactcctcatccaacgacaacaccaatccggacctcgacgggtccctagaccgtattccgtcgtcggcctccgtaggtccgtcggccacccgtcacgtccctccgtcggaccacgtccgacggtcggggcctcccgggggtacttcgggacggtacgtcgggtaacggtcgttacgttaaacgtttaacgttaccgtccggtacccgtacgggtccccgttttaggaaaccttaaaccgggttggggttttttcggggggtttcgggttttagggggttcgggtttacggggaccggggtaacgggaacccgtaaggtcccggttacggtacccgtacgttaacggcgtaccgaaccgaccggtcgtcccggtccccgtcggtacctaccgttccgttcccggtccctcccgttccgttccgtctcgtacgcttcgcggtcggccggtcggtacgacggtaccgcgcgtaactggcagcgtcncnnnncngncnnnnngn

SEQ ID NO: 217996 - DNA, 683 bp, Homo sapiens
  misc_feature: GYAE6OF01AQMUS.5.9.A09.1.454.CMB.1.raw
  modified_base (156)..(156): a, c, t, g, unknown or other
  misc_feature (156)..(156): n is a, c, g, or t
  modified_base (644)..(644): a, c, t, g, unknown or other
  misc_feature (644)..(644): n is a, c, g, or t
  modified_base (652)..(652): a, c, t, g, unknown or other
  misc_feature (652)..(652): n is a, c, g, or t
  modified_base (656)..(656): a, c, t, g, unknown or other
  misc_feature (656)..(656): n is a, c, g, or t
  modified_base (664)..(664): a, c, t, g, unknown or other
  misc_feature (664)..(664): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (680)..(680): a, c, t, g, unknown or other
  misc_feature (680)..(680): n is a, c, g, or t
tcagatcagacacgcacgaccggtgctcgatttagcgagacgcgcagggtcctgggcccagtctgtggtgacgcagccgccctccgtttctggggccccaggcagacggtcaccatctcctgcactggaagcagctccgacatcggtcaaggttangagtgtactagttggtaccagccaacttccaaggaaccacgacccccaaactcctcatcctaaccgacaaaccacccgaatcccggccctacgacggggtcccctacggacccgtatttcgtacctggccttcccgaggttccgtacgggccaacccggcctaaggccccttccccgtagggccccaatccctaaccggtcgggaccccgttcccggggctcgggaaggatacgggcgtcgttagtaacgtttacgttacctcggacccttaagggtcccctacgaacctaagttgggttttcgggttaggtttgggtcggtcgggtccggaaggtacccgtaaagcccgtagtacccgtaccgtaagtcgacgacccgtaacgtcgacccgtccccgtacgtctcctaccgtcctccccgtcctccgttccgtgtcgtagcttcgcgacgggtccggtagtcggaccgtacgaccggactacggtancgctacgngcgngcgtcgcncgcgtcacgancngtntcg

SEQ ID NO: 217997 - DNA, 667 bp, Homo sapiens
  misc_feature: GYAE6OF01BBUPD.5.9.A09.1.454.CMB.1.raw
  modified_base (639)..(639): a, c, t, g, unknown or other
  misc_feature (639)..(639): n is a, c, g, or t
  modified_base (644)..(644): a, c, t, g, unknown or other
  misc_feature (644)..(644): n is a, c, g, or t
  modified_base (649)..(650): a, c, t, g, unknown or other
  misc_feature (649)..(650): n is a, c, g, or t
  modified_base (653)..(653): a, c, t, g, unknown or other
  misc_feature (653)..(653): n is a, c, g, or t
  modified_base (655)..(657): a, c, t, g, unknown or other
  misc_feature (655)..(657): n is a, c, g, or t
  modified_base (659)..(659): a, c, t, g, unknown or other
  misc_feature (659)..(659): n is a, c, g, or t
  modified_base (661)..(662): a, c, t, g, unknown or other
  misc_feature (661)..(662): n is a, c, g, or t
  modified_base (664)..(665): a, c, t, g, unknown or other
  misc_feature (664)..(665): n is a, c, g, or t
  modified_base (667)..(667): a, c, t, g, unknown or other
  misc_feature (667)..(667): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaaactcctcatctacgacaacaccaatccggccctcgacggggtccctgaccgtattctctggcctccaggtctggcaccgcacgccctccctggccatccacgtcggggccgtccggggcttggaggtatggacggcttagtatttacttactcgacccgtacgggtcccctttaggaacctaacgttagggttttggggttcggttttacggggtcgggtttccgggacggggtaacggggtaaccctaaacggtccgttacgggtaaccccgttcctaaacggtccgtaaccggaccccgaacgggtcccgttcccggtccccccgttcggtcctaccgttccgttcccgttaccccctaccccgtcccgttccgttcgttcctgtacttccgtggaccggtcgggtccgtgggtaccgaacggtccgacgtaagtgncgtgngtcgnngcncnnncncnncnngn

SEQ ID NO: 217998 - DNA, 741 bp, Homo sapiens
  misc_feature: GYAE6OF01DC2VI.5.9.A09.1.454.CMB.1.raw
  modified_base (274)..(274): a, c, t, g, unknown or other
  misc_feature (274)..(274): n is a, c, g, or t
  modified_base (728)..(741): a, c, t, g, unknown or other
  misc_feature (728)..(741): n is a, c, g, or t
tcagatcagacacgcacgaccggtgctcgatttagcgagacgcgcagggtcctgggcccagtctgtggtgatgcagccgccctccgtttctcggggcccccagggcagacggtcaccatctcctgcactggaagcagctccgacagtcgggtcaggttatgatgtactagttcggtaccagacaacttccgaacggaaaccaccgaccccccaaaactcctacactcctaacgaaccaaaccaaccaacgtccggccctcggaacggggtcccncgaccgtattcgtcgtcgcctccgtaggtcgcggaccaaccgcgaccgcccttacccgtcggccctaactccgaccggtcgggccgtcccgggtctaggaggtacgtaggacggtacttagttaatttacgttaccgtacggacccgtacggtcccttaacgaaacgtaaacggtttaggggtttggggttgggttttcgggttcgggttccggggaacggggaaccggggtaaaccaaacggtccgttaccggaacccggtttaccgtaaacggttccgaaccggtaccccggaacggtccccgtccccggttacccccggtcggttaccctaccctcccgtttaccccgttaccccctacccccgttcccgttaccggttcgtcgtacgtatccgtacgggacgggtccgggacgtaccgggtacgaacgggtccgaacgtaagtcgcatgnnnnnnnnnnnnnn

SEQ ID NO: 217999 - DNA, 722 bp, Homo sapiens
  misc_feature: GYAE6OF01C0KN8.5.9.A09.1.454.CMB.1.raw
  modified_base (699)..(699): a, c, t, g, unknown or other
  misc_feature (699)..(699): n is a, c, g, or t
  modified_base (705)..(705): a, c, t, g, unknown or other
  misc_feature (705)..(705): n is a, c, g, or t
  modified_base (708)..(708): a, c, t, g, unknown or other
  misc_feature (708)..(708): n is a, c, g, or t
  modified_base (710)..(713): a, c, t, g, unknown or other
  misc_feature (710)..(713): n is a, c, g, or t
  modified_base (715)..(715): a, c, t, g, unknown or other
  misc_feature (715)..(715): n is a, c, g, or t
  modified_base (717)..(722): a, c, t, g, unknown or other
  misc_feature (717)..(722): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagcctccgacagtcgggtcaggttatgatgtacattggaccagcaacttccaaggaaccacgacccccaaactcctacatacctaccgaaccaaaccaccaaacgtccggccccgttacgacggggtcccctacggaccgtactttccgtcgtcgggcctaccgtagggttccgtacgggcccaccggtccacgtccccgttcccgtcggacctactcccgaaccggttcgggggtcccgtttcccggggacgttcgggaacggttaacggttcggagggttcttacggtaacttttacgttacgtcggaccgtaccggtcccttagaactaacgttgggttttcggggttaggtttggggtcggttaccgggacgggaacggaccaaggtccgtacggtacccgtacgtacgtacgacgaccgacgtccgtcccggtccccgtcgtaccgtaccgtccgttcccgttcgtccccccccccccccccgttcgtcccgttcgttccgtcgtacgtcgtcggacggtccggtcggtacggtacgaacgggccgtacgtacgtacgtgngatcgngcncnnnncncnnnnnn

SEQ ID NO: 218000 - DNA, 514 bp, Homo sapiens
  misc_feature: GYAE6OF01E0J0W.5.9.A09.1.454.CMB.1.raw
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
  modified_base (450)..(450): a, c, t, g, unknown or other
  misc_feature (450)..(450): n is a, c, g, or t
  modified_base (482)..(482): a, c, t, g, unknown or other
  misc_feature (482)..(482): n is a, c, g, or t
  modified_base (499)..(501): a, c, t, g, unknown or other
  misc_feature (499)..(501): n is a, c, g, or t
  modified_base (503)..(505): a, c, t, g, unknown or other
  misc_feature (503)..(505): n is a, c, g, or t
  modified_base (507)..(514): a, c, t, g, unknown or other
  misc_feature (507)..(514): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctaacgacaacaccaatcgccctcacggggtccctgaccgattctcgtcggctccgaggtctggccaccgcacgccctcctggccatccacgtgggcctccgggntggaggatggaggctagatttattactgccaggtccctgactaacgtggtttgggtgttttgggngttcgggcggacggaccagtctcgaccgtctaagcacgccaggctcgccctcgtcgtcaccgtctcgttcccnccctctcctgtctgctcgtcgacggcggtcgngacgacggcgacagtgnnncnnncnnnnnnnn

SEQ ID NO: 218001 - DNA, 645 bp, Homo sapiens
  misc_feature: GYAE6OF01ADM9J.5.9.A09.1.454.CMB.1.raw
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (517)..(517): a, c, t, g, unknown or other
  misc_feature (517)..(517): n is a, c, g, or t
  modified_base (566)..(566): a, c, t, g, unknown or other
  misc_feature (566)..(566): n is a, c, g, or t
  modified_base (598)..(598): a, c, t, g, unknown or other
  misc_feature (598)..(598): n is a, c, g, or t
  modified_base (609)..(609): a, c, t, g, unknown or other
  misc_feature (609)..(609): n is a, c, g, or t
  modified_base (615)..(615): a, c, t, g, unknown or other
  misc_feature (615)..(615): n is a, c, g, or t
  modified_base (623)..(623): a, c, t, g, unknown or other
  misc_feature (623)..(623): n is a, c, g, or t
  modified_base (627)..(627): a, c, t, g, unknown or other
  misc_feature (627)..(627): n is a, c, g, or t
  modified_base (632)..(632): a, c, t, g, unknown or other
  misc_feature (632)..(632): n is a, c, g, or t
  modified_base (636)..(636): a, c, t, g, unknown or other
  misc_feature (636)..(636): n is a, c, g, or t
tcagatcagacacgcacgaccggtgctcgatttagcgagacgcgcagggtcctgggcccagtctgtggtgacgcagccgccctccatttctggggccccagggcagacggtcaccatctcctgcactggaagcagctccgacatcgggtcaggttatgatgtactaagttggtaccaagccaaccttaccgaaggaaaccaccgacccccaaactcctctatactacgacaacaccaactccgacccncgacggggtccctacgtaccgtnttcctcgtcgcctccgtaggtccgtcgccaccgcacggccctccgttcggacctctaccgtacggtcgggccggttccgggcttcgggagtacggtgacggtaccttaggttacttacgtttaccgcgtacccgacgtccttagaccgtaacgtggtttacggtgtttcgggtcggttccgggacggggctacgtcgtgacccgttgtacggtcacggtccgaacgtcgtccctcccgtacgttcncgttccgtccgttcccgtcctccgtcgttacggtcctaggacttacggngtcccgggcggacgtttcgaccgttacgccanacgtgcaaagngtctgngttaaacncgtncgaanctancgcagtcag

SEQ ID NO: 218002 - DNA, 668 bp, Homo sapiens
  misc_feature: GYAE6OF01C7E8K.5.9.A09.1.454.CMB.1.raw
  modified_base (151)..(151): a, c, t, g, unknown or other
  misc_feature (151)..(151): n is a, c, g, or t
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
  modified_base (651)..(651): a, c, t, g, unknown or other
  misc_feature (651)..(651): n is a, c, g, or t
  modified_base (653)..(668): a, c, t, g, unknown or other
  misc_feature (653)..(668): n is a, c, g, or t
tcagatcagacacgcacgaccggtgctcgatttagcgagacgcgcagggtcctgggcccagtctgtggtgacgcagcccgccctccgtttctggggcccccagggcagacggtcaccatctcctgcactggagcagctccgacatcgggtnaggttatgatgtacattggtaccagctaacttccaaggaaccacgacccccaaactcctcatcaccgacaacaccaatccgccctcgacggggtcccagaccgtattcctcgtcggccttccgaggttcgnggccacgccacgccctccgnggccatccgacgtcgggccgtccggntaggaggtagtggaggcttagtaatttacgttacgcgtaccgacgtcccgttagaaaccgttaacgtttagggttttggggttcggttttggggtacggttcggggcgggaacgggacctaaggtccgtacggttaacccgtacgttacgtaccgaccggacccgtaagtccccgtccccggtcccccgttggtacccttaccttcccgtttacccgttaccccccgtacccctttccgtccggtttcgtacccgttagttaccgtcggttacgggaccgggtaccgggtggtacgggaacggtaacggccgtacgtagtagncnnnnnnnnnnnnnnnn

SEQ ID NO: 218003 - DNA, 744 bp, Homo sapiens
  misc_feature: GYAE6OF01CS316.5.9.A09.1.454.CMB.1.raw
  modified_base (663)..(663): a, c, t, g, unknown or other
  misc_feature (663)..(663): n is a, c, g, or t
  modified_base (720)..(720): a, c, t, g, unknown or other
  misc_feature (720)..(720): n is a, c, g, or t
  modified_base (725)..(725): a, c, t, g, unknown or other
  misc_feature (725)..(725): n is a, c, g, or t
  modified_base (730)..(735): a, c, t, g, unknown or other
  misc_feature (730)..(735): n is a, c, g, or t
  modified_base (738)..(741): a, c, t, g, unknown or other
  misc_feature (738)..(741): n is a, c, g, or t
  modified_base (743)..(744): a, c, t, g, unknown or other
  misc_feature (743)..(744): n is a, c, g, or t
tcagatcagacacgcacgaccggtgctcgatttagcgagacgcgcgagggtcctgggcccagtctgtggtgacgcagccgccctccgtttctggggccccagggcagacggtcaccatctcctgcactggaagcagcctccgacagtcgggtcaggttatgatgtacattggtaccagcaacttccgaaggacacgccccaaactcctacatctacgacaacaccaatccgccctcgacggggtcccctagacccgtatttccgtcgtcggtacctccgtacggttccgttgggcccaacccggccaacggtcccccttcccgtcgggacccctaagttcccgacggttccggggcccgttcccgggggtcttcgggaagggagttacgggaacgggtcgttcggttaaagttttaactttacccggtcgaccccggttagggtcccctttaaggaccgtaaaccgtttggggtttttgggggttggtttttcgggggtcggtttaccggggaaccggggtaacgggtacccgtaaaggtccggtaccggttacccggttaccgtaagtccgaaccggaccaacgggtccgtacccgtcccccggttcggtacctacgttccgttccgtcccccgtccccgttcccgttacccgtcgtttccncgtacttcgtcgggacggtcccggggcttacgggccgaacgggcttaccggagtcgntagcngcgtnnnnnntcnnnngnn

SEQ ID NO: 218004 - DNA, 622 bp, Homo sapiens
  misc_feature: GYAE6OF01DI2OF.5.9.A09.1.454.CMB.1.raw
  modified_base (266)..(266): a, c, t, g, unknown or other
  misc_feature (266)..(266): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (601)..(601): a, c, t, g, unknown or other
  misc_feature (601)..(601): n is a, c, g, or t
  modified_base (605)..(607): a, c, t, g, unknown or other
  misc_feature (605)..(607): n is a, c, g, or t
  modified_base (609)..(622): a, c, t, g, unknown or other
  misc_feature (609)..(622): n is a, c, g, or t
tcagatcagacacgcacgaccggtgctcgatttagcgagacgcgcagggtcctgggcccagtctgtggtgacgcagcccgcccttccgtttcgtcggggcccccagggcagacggtcaccatcctcctgcatggaagcagctccgacagtcgggtcaggttatgatgtacattgtaccagcaacttccaaggaaccacgacccccaaactcctacactcaaccgaacaacaaccaacgtccgcctcgacggtacctgacctattcnctggctacgtagtctggaccaccgctacgccctccgacgcctactcgacgtgggtccctccggctagagtagtcggacggtntaggtaatttattacgngtacccaggttacctacgaactaacgttaggggtttgggttcggtttggggtacggttcggggacggaacgggtacccgtaaagtcgtacggtaccctaacgtacgtacgaccgacccgacgcgtacccgtccccggtcgtaacctcgtaccgttccccgttcccctccgtacccgtttcgtcgttcgtacgtattcgtagggcgggtcggaccggtaggaccgttaagcgacgancgannngnnnnnnnnnnnnnn

SEQ ID NO: 218005 - DNA, 788 bp, Homo sapiens
  misc_feature: GYAE6OF01ATI6L.5.9.A09.1.454.CMB.1.raw
  modified_base (349)..(349): a, c, t, g, unknown or other
  misc_feature (349)..(349): n is a, c, g, or t
  modified_base (764)..(764): a, c, t, g, unknown or other
  misc_feature (764)..(764): n is a, c, g, or t
  modified_base (772)..(772): a, c, t, g, unknown or other
  misc_feature (772)..(772): n is a, c, g, or t
  modified_base (777)..(778): a, c, t, g, unknown or other
  misc_feature (777)..(778): n is a, c, g, or t
  modified_base (781)..(783): a, c, t, g, unknown or other
  misc_feature (781)..(783): n is a, c, g, or t
  modified_base (785)..(785): a, c, t, g, unknown or other
  misc_feature (785)..(785): n is a, c, g, or t
  modified_base (787)..(788): a, c, t, g, unknown or other
  misc_feature (787)..(788): n is a, c, g, or t
tcagatcagacacgcacgaccggtgctcgatttagcgagacgcgcagggtcctgggcccagtctgtggtgacgcagccgccctccgtttctcggggccccagggcagacggtcaccatctcctgcactggaagcagctccgacagtcgggtcaggttatgagtgtactgttcgtacagctaactcgaaggacaccgaccccaactcctcactctacgaacaaccaccacgtccgcctcgaccggggtcctcgaccgtacttccgtcgtacggccgtcctacggttcgccggaccaccgcgtaccgtcccttaccggtcgacctacgccgtacggtcggccggtccgggngttcggagtacggtcggtacggtactcgttaacgtttactacccgtcggtacccgtaccggttccctaacggtaaaccgttaacgggtttcggggtttttcggggttacggggttttacggggttcgggttaccgggggtaacgggaacggggtttaaacccgaaacgggtccgtaaccccgggtttaacccgttaaccgggttaacggaacccggttaacccggtaaccccggtaacgggttccccgttaacccccggttcccccggttacccggttaacgttccccgttttacccgttaccccgttcccccggttacccgtttcccggttccggtttccgtaactcggttaccgtcggtcggtacggtacccgggtcgtacgggtaccgacggtccgtacgattcggactgcncgtgagtncggtnngcnnncngnn

SEQ ID NO: 218006 - DNA, 627 bp, Homo sapiens
  misc_feature: GYAE6OF01CCWRM.5.9.A09.1.454.CMB.1.raw
  modified_base (605)..(605): a, c, t, g, unknown or other
  misc_feature (605)..(605): n is a, c, g, or t
  modified_base (608)..(609): a, c, t, g, unknown or other
  misc_feature (608)..(609): n is a, c, g, or t
  modified_base (612)..(627): a, c, t, g, unknown or other
  misc_feature (612)..(627): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaaacttccaggaacacgacccccaaaactcctcatctaacgaacaacaaccaatccggccctcgaggggtccctggaccgtattctcgtggctccaggtctggcaccgcagccctcccgtggccatccgacgtcgggctccgggctggagatggaggctgtaatttactacgtgcccgtacggcccctttagaaccgaaacgttaggttttgggggttggttttgggggtacggtttccgggggacgggtaaacgggggtaacccaaaggtcccgttacgggaacccgttacccgtaaagtaccgaacgtacccgaacggccgtacccggccccccgttcggtacctaccttccttccgttaccccctccccttccctcccgtgtccgtcgtatcgtggacggcggtcgtaggacgacggccgactaanagnngtnnnnnnnnnnnnnnnn

SEQ ID NO: 218007 - DNA, 692 bp, Homo sapiens
  misc_feature: GYAE6OF01CLWS6.5.9.A09.1.454.CMB.1.raw
  modified_base (160)..(160): a, c, t, g, unknown or other
  misc_feature (160)..(160): n is a, c, g, or t
  modified_base (179)..(179): a, c, t, g, unknown or other
  misc_feature (179)..(179): n is a, c, g, or t
  modified_base (658)..(658): a, c, t, g, unknown or other
  misc_feature (658)..(658): n is a, c, g, or t
  modified_base (663)..(663): a, c, t, g, unknown or other
  misc_feature (663)..(663): n is a, c, g, or t
  modified_base (670)..(670): a, c, t, g, unknown or other
  misc_feature (670)..(670): n is a, c, g, or t
  modified_base (675)..(675): a, c, t, g, unknown or other
  misc_feature (675)..(675): n is a, c, g, or t
  modified_base (686)..(687): a, c, t, g, unknown or other
  misc_feature (686)..(687): n is a, c, g, or t
  modified_base (689)..(690): a, c, t, g, unknown or other
  misc_feature (689)..(690): n is a, c, g, or t
  modified_base (692)..(692): a, c, t, g, unknown or other
  misc_feature (692)..(692): n is a, c, g, or t
tcagatcagacacgcacgaccggtgctcgatttagcgagacgcgcagggtcctgggcccagtctgtggtgacgcagcccgccctccgtttctcggggccccaggcagacggtcaccatctcctgcacgtggaagcagctccgacagtcgggtcaggttangatgtactagttcggaccngactaacttccgaaggaaccacgaccccaaactcctcaactccgtaaccgaacaaaccaccgaaacgtccggaccctacggaccggggttaccctacggaaccgttacttcctcggtcggtcctccggtaggttccgtacggaccaccgtccgacgtccccttaccgtacggacctaactccgacggtcgggtaccgtccgggatcggaaggacgtggcggtactagttactttacgttacgcgaccgtcggtcctagtactacggttgtttcggggtgttcgggtacgtcgggacggtacgacctaagtcgtacgtacccgttagtacgaccggactaccggacggtcctacccggtccccgtacggtcctaccggttcccgttccgtccccgtaccctttccgtccggttcgtcgttacggtacctggccggtacggtccgggtaacgtcggaccggtacggacccgagttacgcgngttcngtagcgngtacngtacgcctcanncnngn

SEQ ID NO: 218008 - DNA, 485 bp, Homo sapiens
  misc_feature: GYAE6OF02HQSDG.5.9.A09.1.454.CMB.1.raw
  modified_base (475)..(485): a, c, t, g, unknown or other
  misc_feature (475)..(485): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctcctggccatcactgggctccgggctgaggatgaggctgattattactgccaggcccttgacaactagtttgggtgtttgggtgttcggcggagggaccaagctgaccgtcctaagtcacgcccaaggctcgcccctggtcactctcgttcccaccctcctccgtgtctgatctgacgcgggctggcaaggcgcatgnnnnnnnnnnn

SEQ ID NO: 218009 - DNA, 508 bp, Homo sapiens
  misc_feature: GYAE6OF02G69XA.5.9.A09.1.454.CMB.1.raw
  modified_base (492)..(508): a, c, t, g, unknown or other
  misc_feature (492)..(508): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctggaggatgaggctgattattactgccaggcccttgacaacgtggttttgggtgtttggggtgttcgggcgggtagggaccaagctgacccgtctaagtcagcccaaggctcgcccctggtcactctcgttcccgccctccctccgtcgtctgactcgtgacgccgggcgtggccgaaggccgcatagnnnnnnnnnnnnnnnnn

SEQ ID NO: 218010 - DNA, 487 bp, Homo sapiens
  misc_feature: GYAE6OF02IDX83.5.9.A09.1.454.CMB.1.raw
  modified_base (476)..(487): a, c, t, g, unknown or other
  misc_feature (476)..(487): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacatttggtaccagcaacttccaggaacagcccccaaactcctcatctacgacaacaccaatccggccctcaggggtccctgaccgattctctggctccaggtctggcaccgcagcctcctggccatcactgggcctccggggctggaggatgagctgattattactgccaggcccttgacaactggtttgggtgtttgggtgttcggcggagggaccaagctgaccgtctaagtcagcccaaggctcgcccctcgtcactctcgttcccacccttcctcgtctctgactctgagcgggctggcagcgcatagnnnnnnnnnnnn

SEQ ID NO: 218011 - DNA, 489 bp, Homo sapiens
  misc_feature: GYAE6OF02IGYMG.5.9.A09.1.454.CMB.1.raw
  modified_base (468)..(468): a, c, t, g, unknown or other
  misc_feature (468)..(468): n is a, c, g, or t
  modified_base (474)..(489): a, c, t, g, unknown or other
  misc_feature (474)..(489): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggcctccaggtctggccaccgcagcctccctggccatcactgggctccgggctgaggatgaggctgattatactgccaggcccttgacaactgttttgggtgtttgggtgttcggcggagggaccaagctgaccgtctaagtcagcccaagctcgcccctggcactctcgttcccaccctcctccgtgtctgactcgtgagcggctggcaaggcncatagnnnnnnnnnnnnnnnn

SEQ ID NO: 218012 - DNA, 503 bp, Homo sapiens
  misc_feature: GYAE6OF02HFKQS.5.9.A09.1.454.CMB.1.raw
  modified_base (485)..(488): a, c, t, g, unknown or other
  misc_feature (485)..(488): n is a, c, g, or t
  modified_base (490)..(503): a, c, t, g, unknown or other
  misc_feature (490)..(503): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggcccatcactgggctccgggctgaggatgaggctgattattactgccaggcccttgacaactaggttttgggtgttttgggtgttcgggcggagggacccaagctgaccgtcctaagtcagcccaaggcctcgcccctcggtcactctcgttcccaccctcctccgtgtctgatctgacgcgggctggcaaggcgacatagnnnngnnnnnnnnnnnnnn

SEQ ID NO: 218013 - DNA, 515 bp, Homo sapiens
  misc_feature: GYAE6OF02FTCJ8.5.9.A09.1.454.CMB.1.raw
  modified_base (501)..(515): a, c, t, g, unknown or other
  misc_feature (501)..(515): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctggaggatggaggctgattattactgccaggcccttgacaacgtggttttgggtgttttggggtgtttcgggcgggtaaggggacccaaggtcctaggacccgttctaagtcacgcccaaggcctcgccccctcggtccactctcgttcccaccctcctccgtgtctgactcgtgacgcgggctggcaaggcgcatgnnnnnnnnnnnnnnn

SEQ ID NO: 218014 - DNA, 492 bp, Homo sapiens
  misc_feature: GYAE6OF02HKBBO.5.9.A09.1.454.CMB.1.raw
  modified_base (448)..(448): a, c, t, g, unknown or other
  misc_feature (448)..(448): n is a, c, g, or t
  modified_base (482)..(492): a, c, t, g, unknown or other
  misc_feature (482)..(492): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatccggccctcaggggtccctgaccgattctctggctccaggtctggcaccgcagccctccctggccatccactgggctccgggctgaggatgaggctgattatactgccaggcccttgacaagtggtttgggtgtttgggtgttcgggcggagggaccaaggctggaccgtctaagtcagccgaaggctcgcccctcggtcactctcgtcccacccttcctccgtntctgtctcgtgacgcgggctggcaggcgcatagnnnnnnnnnnn

SEQ ID NO: 218015 - DNA, 509 bp, Homo sapiens
  misc_feature: GYAE6OF02IA8BW.5.9.A09.1.454.CMB.1.raw
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (492)..(493): a, c, t, g, unknown or other
  misc_feature (492)..(493): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (502)..(503): a, c, t, g, unknown or other
  misc_feature (502)..(503): n is a, c, g, or t
  modified_base (505)..(509): a, c, t, g, unknown or other
  misc_feature (505)..(509): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctcctggccatcactgggctccgggctgaggatgagctgattatactgccaggccttgacactagtttggtgtttggtgttcggcggtagggaccaagctgaccgtcctgagtcacgccgaaggcctgccccctcggtcactctcgttccccgccctccgtccgtgtctgacttctagacgcgggctcggactacggcgaccagtacgntcgngcnngntacgncnngnnnnn

SEQ ID NO: 218016 - DNA, 506 bp, Homo sapiens
  misc_feature: GYAE6OF02IAU97.5.9.A09.1.454.CMB.1.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (489)..(506): a, c, t, g, unknown or other
  misc_feature (489)..(506): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaaacaccaatccggccctnaggggtccctgaccgattctntggctccaggtctggcaccgnagcctcctggccatcactgggctccggctgaggatgagctgattatactgccaggcccttgacacgtagtttgggngtttgggngttcggcggtagggaccaaggctggaccgtcctaagtcagcccaaggctcgccctcggtcactctcgttccccacccttcctcgttcgtctgactctcgagtccgggctgggacaaggccactagtacgnnnnnnnnnnnnnnnnnn

SEQ ID NO: 218017 - DNA, 501 bp, Homo sapiens
  misc_feature: GYAE6OF02I2338.5.9.A09.1.454.CMB.1.raw
  modified_base (484)..(484): a, c, t, g, unknown or other
  misc_feature (484)..(484): n is a, c, g, or t
  modified_base (486)..(501): a, c, t, g, unknown or other
  misc_feature (486)..(501): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggcctccaggtctggcaccgcacgcctccctggccatcactgggctccggggctgaggatgaggctgattatactgccaggtcccttgacaactaggttttgggtgtttggggtgttcgggcggagggaccaagctcgacccgtctaagtcacgcccaaggctcgccccctggtccactcctcgttcccacccttcctccgtgtctgatctgagcgggctggcaggcgcangnnnnnnnnnnnnnnnn

SEQ ID NO: 218018 - DNA, 545 bp, Homo sapiens
  misc_feature: GYAE6OF02I1SAX.5.9.A09.1.454.CMB.1.raw
  modified_base (333)..(333): a, c, t, g, unknown or other
  misc_feature (333)..(333): n is a, c, g, or t
  modified_base (525)..(525): a, c, t, g, unknown or other
  misc_feature (525)..(525): n is a, c, g, or t
  modified_base (528)..(529): a, c, t, g, unknown or other
  misc_feature (528)..(529): n is a, c, g, or t
  modified_base (531)..(531): a, c, t, g, unknown or other
  misc_feature (531)..(531): n is a, c, g, or t
  modified_base (533)..(545): a, c, t, g, unknown or other
  misc_feature (533)..(545): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcacggggtccctgaccgattctctggctccaggtctggcaccgcagcctccctggccatcacgtgggcctccgggctggaggatggaggctgatttattacgngccaggcccttagacaacgtggtttgggtgtttgggtgttcgggcggtagggaccaaggctaggacccgttctaagtcacgcccgaaggctcgccccgtcggtcacttcctccgttccccgcccttcccgtccgtcgtctcgtactcgtggtacggccgggtcgtcgggacgaacgggccgcgtaacgtagncgnngngnnnnnnnnnnnnn

SEQ ID NO: 218019 - DNA, 516 bp, Homo sapiens
  misc_feature: GYAE6OF02JIFZZ.5.9.A09.1.454.CMB.1.raw
  modified_base (273)..(273): a, c, t, g, unknown or other
  misc_feature (273)..(273): n is a, c, g, or t
  modified_base (326)..(326): a, c, t, g, unknown or other
  misc_feature (326)..(326): n is a, c, g, or t
  modified_base (364)..(364): a, c, t, g, unknown or other
  misc_feature (364)..(364): n is a, c, g, or t
  modified_base (492)..(494): a, c, t, g, unknown or other
  misc_feature (492)..(494): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
  modified_base (511)..(512): a, c, t, g, unknown or other
  misc_feature (511)..(512): n is a, c, g, or t
  modified_base (514)..(516): a, c, t, g, unknown or other
  misc_feature (514)..(516): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgnacgcctcctggccatcactgggctccgggctgaggatgaggctgattattacngccaggcccttgacaacgtggttttgggtgtttggggngttcggcgggaagggaccaaggctgaccgtctaagtcagcccaaggctcgcccctggtcacttctcgttcccacctcctccgtgtcctgactctggagccgggtctgggcaagggtccgctagtagcnnncgngctngcngcgcncnncnnn

SEQ ID NO: 218020 - DNA, 509 bp, Homo sapiens
  misc_feature: GYAE6OF02FOUOT.5.9.A09.1.454.CMB.1.raw
  modified_base (331)..(331): a, c, t, g, unknown or other
  misc_feature (331)..(331): n is a, c, g, or t
  modified_base (487)..(487): a, c, t, g, unknown or other
  misc_feature (487)..(487): n is a, c, g, or t
  modified_base (493)..(509): a, c, t, g, unknown or other
  misc_feature (493)..(509): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggcccatcactgggcctccggggctggaggatggaggctgattattacngccaggtccccttgacaacaggttttgggtgttttgggtgttcgggcggagggaccaagctcgaccgtctaagtcagcccaaggcctcgcccctcgtccactctcgttcccaccctccgtccgtcgtctgactctggacgcgggctggacaggccncatagnnnnnnnnnnnnnnnnn

SEQ ID NO: 218021 - DNA, 502 bp, Homo sapiens
  misc_feature: GYAE6OF02GRX9A.5.9.A09.1.454.CMB.1.raw
  modified_base (486)..(502): a, c, t, g, unknown or other
  misc_feature (486)..(502): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccaaatcactgggctccgggctgaggatggaggctgattattactgccaggccccttgacaactagtttgggtgtttgggtgttcggcggagggaccaagctgaccgtctaagtcagcccaaggctcgcccctcgcactcctcgttccccgccctcccgtccgtcgtctgtactctgacggcgggctggcaacggcgcatgnnnnnnnnnnnnnnnnn

SEQ ID NO: 218022 - DNA, 481 bp, Homo sapiens
  misc_feature: GYAE6OF02GLGV1.5.9.A09.1.454.CMB.1.raw
  modified_base (444)..(444): a, c, t, g, unknown or other
  misc_feature (444)..(444): n is a, c, g, or t
  modified_base (469)..(469): a, c, t, g, unknown or other
  misc_feature (469)..(469): n is a, c, g, or t
  modified_base (474)..(481): a, c, t, g, unknown or other
  misc_feature (474)..(481): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggcctccgggctgaggatgaggctgattattactgccaggcccttgacaacagtttgggtgtttgggtgttcggcggagggaccaagctgaccgtctaagtcacgcccaaggctcgccccctggtcactctcgttcccaccctcctccgtntctgatctgacgcggctggcaggcncatgnnnnnnnn

SEQ ID NO: 218023 - DNA, 493 bp, Homo sapiens
  misc_feature: GYAE6OF02FG85C.5.9.A09.1.454.CMB.1.raw
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (476)..(493): a, c, t, g, unknown or other
  misc_feature (476)..(493): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctaacgacaacaccaatcggccctcaggggtccctgaccgattctctggcctccaggtctggcaccgnagccctccctggccatcactggggctccgggntgaggatgagctgattntacngccaggcccttgacatgtttgggtntttgggnttcggcggtaggaccaagctgaccgtctagtcagcccaaggctcgcccctggtcacgtctcgttcccgccctcctccgtgtctgctctgacgcgggctgggcagggcacgatacgnnnnnnnnnnnnnnnnnn

SEQ ID NO: 218024 - DNA, 547 bp, Homo sapiens
  misc_feature: GYAE6OF02HBAH7.5.9.A09.1.454.CMB.1.raw
  modified_base (231)..(231): a, c, t, g, unknown or other
  misc_feature (231)..(231): n is a, c, g, or t
  modified_base (529)..(532): a, c, t, g, unknown or other
  misc_feature (529)..(532): n is a, c, g, or t
  modified_base (534)..(547): a, c, t, g, unknown or other
  misc_feature (534)..(547): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctnaggggtccctgaccgattctctggctccaggtctggcaccgcacgcctcccgtggccatcacgtgggcctccggggctggaggatggacggctgtatttattacgtgccgtacggtcccttgaaccaacgtaggttttggggttgttttggggtgttcgggcggaagggaccaaggcctgacccgtctaagtcacgacccgaaggtctccggccccgtcggtccacgtcctcgttcccgcccttccgtccgtgtctgacttcgtggacggccgggcgtcggacgacggcgacagtagnnnngnnnnnnnnnnnnnn

SEQ ID NO: 218025 - DNA, 498 bp, Homo sapiens
  misc_feature: GYAE6OF02F56R9.5.9.A09.1.454.CMB.1.raw
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
  modified_base (475)..(475): a, c, t, g, unknown or other
  misc_feature (475)..(475): n is a, c, g, or t
  modified_base (481)..(498): a, c, t, g, unknown or other
  misc_feature (481)..(498): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcacgcctcctggccatcactgggctccgggctgaggatggaggctgatttatactgccaggcccttagaccaagtggttttgggtgtttgggtgttcggcggaggaccaagctcgaccgtctaagtcacgcccaaggctcgcccctcgtcactctcgtcccnccctccgtccgtntctgactcgtgagcggtctggctaggcncatagnnnnnnnnnnnnnnnnnn

SEQ ID NO: 218026 - DNA, 665 bp, Homo sapiens
  misc_feature: GYAE6OF02ITJAS.5.9.A09.1.454.CMB.1.raw
  modified_base (644)..(645): a, c, t, g, unknown or other
  misc_feature (644)..(645): n is a, c, g, or t
  modified_base (649)..(649): a, c, t, g, unknown or other
  misc_feature (649)..(649): n is a, c, g, or t
  modified_base (653)..(653): a, c, t, g, unknown or other
  misc_feature (653)..(653): n is a, c, g, or t
  modified_base (659)..(659): a, c, t, g, unknown or other
  misc_feature (659)..(659): n is a, c, g, or t
  modified_base (661)..(662): a, c, t, g, unknown or other
  misc_feature (661)..(662): n is a, c, g, or t
  modified_base (664)..(665): a, c, t, g, unknown or other
  misc_feature (664)..(665): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatccggccctcgacggggtccctgaccgattctcgtggctccgaggtctggccaccgcacgcctcctggccatcacgtgggcctccgggctaggaggtatggaggtctgtaatttacttacgcgccacggtcccttagaacctaacgtagggttttgggttggttttggggtcggttcgggacgggtaacgggtaccaaggtcgttacggtaaccccgttacgtaaggtaccgaccggaaccccgaagggtcccgttacccggtcccccccgttcgggtacctaacccgtttccgttcccggtttacccccgtccccgtttacccgttcccggttcgttccgttcgtacgttccggtacggaccgggtccggggtaccgtacgggtaccgaaccgggtcgaccgtaagtacggctagtgacgnngcgntcgncgtctncnncnn

SEQ ID NO: 218027 - DNA, 569 bp, Homo sapiens
  misc_feature: GYAE6OF02GM20K.5.9.A09.1.454.CMB.1.raw
  modified_base (253)..(253): a, c, t, g, unknown or other
  misc_feature (253)..(253): n is a, c, g, or t
  modified_base (309)..(309): a, c, t, g, unknown or other
  misc_feature (309)..(309): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (563)..(564): a, c, t, g, unknown or other
  misc_feature (563)..(564): n is a, c, g, or t
  modified_base (567)..(569): a, c, t, g, unknown or other
  misc_feature (567)..(569): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaatcctcatctacgacaacaccaatccggccctcgaggggtcccctgaccgattcnctggcctccaggtctggcaccgcacgcctcctggccatcacgtgggcctccggggntggaggatggaggctgattattactgccaggtcccttagaacctaacgtggttttgggtgtttgggtgttcgggcggaggaccaaggtctaggaccgttactagtcgacgacccgaaggtcctcgcccctcggtctaccttcgtaccgttccccacccttccgtccgttgtccgtacgtccgtcggacggtccgggtcgtcgggtaccgaacgggtccgacgtaagtacgngcgncgcgcngcgcngngcgcgnncgnnn

SEQ ID NO: 218028 - DNA, 601 bp, Homo sapiens
  misc_feature: GYAE6OF02H8UQY.5.9.A09.1.454.CMB.1.raw
  modified_base (247)..(247): a, c, t, g, unknown or other
  misc_feature (247)..(247): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
  modified_base (568)..(568): a, c, t, g, unknown or other
  misc_feature (568)..(568): n is a, c, g, or t
  modified_base (580)..(580): a, c, t, g, unknown or other
  misc_feature (580)..(580): n is a, c, g, or t
  modified_base (588)..(588): a, c, t, g, unknown or other
  misc_feature (588)..(588): n is a, c, g, or t
  modified_base (599)..(599): a, c, t, g, unknown or other
  misc_feature (599)..(599): n is a, c, g, or t
tcagatcagacacgcacgaccggtgctcgatttagcgagacgcgcagggtcctgggcccagtctgtggtgacgcagccgccctccgtttctgggccccagggcagacggtcaccatctcctgcactggaagcagctccgacatcgggtcaggttatgatgtacattggtaccagcaacttccaggacacgaccccaaactcctcatctacgacaacacaatcggcctcacgggtcctgaccgattcntcggctccgaggtctggctaccgcacgcctccgtggaccatcaccgtggcctccgggatggaggatggacgtctagtatttactactcgcctacggtcccttagaacctacgtaggttttcgggtgtttagggtgttcgggacggtcggaacctaaggtcgtacggtaaccgttcgtaacgtcgacgacccaagggtcctcccggtcccgttcggtcaaccttcctccgttacccacccgttccgttacggtcgtacctgcgttcgtaggaccggtcgacgtgggtaccgagggttcccagtagtacgntctcgngtaacncgtagctacgtntacggtcncgactcgtcgncg

SEQ ID NO: 218029 - DNA, 521 bp, Homo sapiens
  misc_feature: GYAE6OF02FRS7W.5.9.A09.1.454.CMB.1.raw
  modified_base (503)..(506): a, c, t, g, unknown or other
  misc_feature (503)..(506): n is a, c, g, or t
  modified_base (508)..(521): a, c, t, g, unknown or other
  misc_feature (508)..(521): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcacgccctccctggccatcactgggctccgggctgaggatggaggctgatttattactgccagggcccttgaccaacgtaggttttggggtgttttggggtggttcgggcgggagggaccaaggctggacccgtctaagtcagcccaaggctcgccccctcggtcacctcctcgttccccaccctccttccgtgtctgactctggacgcgggctggacaaggccacatagnnnngnnnnnnnnnnnnnn

SEQ ID NO: 218030 - DNA, 665 bp, Homo sapiens
  misc_feature: GYAE6OF02F1KV7.5.9.A09.1.454.CMB.1.raw
  modified_base (640)..(641): a, c, t, g, unknown or other
  misc_feature (640)..(641): n is a, c, g, or t
  modified_base (653)..(653): a, c, t, g, unknown or other
  misc_feature (653)..(653): n is a, c, g, or t
  modified_base (659)..(659): a, c, t, g, unknown or other
  misc_feature (659)..(659): n is a, c, g, or t
  modified_base (661)..(665): a, c, t, g, unknown or other
  misc_feature (661)..(665): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatccggccctcgacggggtccctgaccgtattctctggcctccgaggtctggccaccgcacgccctccctggccactcacgtcgggcctccggggctggacggatggaggctagtattattacgtgaccgtacggcccttgaaccgtaacgtggggtttttggggttacggttttgggggttcggtttccggggacgggaacgggggtacccaaagggtcccgtacggtaccccggtttaccgtaacggtccgaaccggacccgtaacgggtccgtccccggtcccccgttccggttcctaccgttccgttcccggttccccctaccccgtttcccgttccccgggttgtcccgttacgtacttcggtacgggaccgggtccgggtacgtcgggtaccgacgggtccacgtagtacgnncagtgctcgctngcgtcncnnnnn

SEQ ID NO: 218031 - DNA, 608 bp, Homo sapiens
  misc_feature: GYAE6OF02GHR7D.5.9.A09.1.454.CMB.1.raw
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (595)..(599): a, c, t, g, unknown or other
  misc_feature (595)..(599): n is a, c, g, or t
  modified_base (601)..(601): a, c, t, g, unknown or other
  misc_feature (601)..(601): n is a, c, g, or t
  modified_base (603)..(608): a, c, t, g, unknown or other
  misc_feature (603)..(608): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaatcctcatctacgacaacaccaatcggccctcaggggtccctgaccgattctctggcctccaggtctggcaccgcacgcctcctggccatccacgtgggcctccgggctgaggatggaggtctgatttactacgtgccaggtcccttggaacctaacgtggttttggggtgttttggggtcgtttcgggcgggaagggaccaaggtccgtacggacccgtttacgtaagtcgacgacccgaacgggtccgtccggtcccccgttcggtacccgtaccgttccgttaccggtttccccgtccccgtttcccgttcccggttcgttccgtgtacgttcgtggacggtccggggtccgtcgggtacgaacgggtccgacgtagttacgngtangngtgcnnnnncncnnnnnn

SEQ ID NO: 218032 - DNA, 524 bp, Homo sapiens
  misc_feature: GYAE6OF02IEHH9.5.9.A09.1.454.CMB.1.raw
  modified_base (234)..(234): a, c, t, g, unknown or other
  misc_feature (234)..(234): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (507)..(509): a, c, t, g, unknown or other
  misc_feature (507)..(509): n is a, c, g, or t
  modified_base (511)..(524): a, c, t, g, unknown or other
  misc_feature (511)..(524): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaactttccaggaacagcccccaaaactcctcatctacgacaaacaccaatcggccctnaggggtccctgaccgattctctggctccaggtctggcaccgcagccctcctggccatcactgggctccgggctgaggatgagctgattattactgccaggcccttgaacacgtagttttgggtgtttgggtgttcgggcggagggaaccaagctagacccgttcctaaagtcacggacccaaggctccgcccctcggtcacttctcgttccccgcccttcctccgtnttcngactcgtgaggccggtctcgggacaacggccgacaagtagcnnngnnnnnnnnnnnnnn

SEQ ID NO: 218033 - DNA, 506 bp, Homo sapiens
  misc_feature: GYAE6OF02F7QBB.5.9.A09.1.454.CMB.1.raw
  modified_base (490)..(506): a, c, t, g, unknown or other
  misc_feature (490)..(506): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagccctccctggcccatcactgggctccggggctgaggatggaggctgatttatactgccaggtcccttgacaactggttttgggtgtttgggtgttcgggcggaagggaccaagctaggaccgtctaagcacgccaagctcgcccctgtccactctcgttcccgccctccctccgtctctgactcgtgacggcgggctcggcgaggcgcgagtagnnnnnnnnnnnnnnnnn

SEQ ID NO: 218034 - DNA, 610 bp, Homo sapiens
  misc_feature: GYAE6OF02GHWPR.5.9.A09.1.454.CMB.1.raw
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (595)..(595): a, c, t, g, unknown or other
  misc_feature (595)..(595): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (604)..(605): a, c, t, g, unknown or other
  misc_feature (604)..(605): n is a, c, g, or t
  modified_base (607)..(609): a, c, t, g, unknown or other
  misc_feature (607)..(609): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagccccaaactcctcatctacgacaacaccaatcggccctcgacggggtccctgaccgattctctggctccaggtctggcaccgcacgcctccctggccatccacgtcggggcctccggggctggacggatggacggctgattttattacgtcgccgtaggtccccttagaacctaacgttgggttttggggtgttttacggggtcggtttcgggcgggaacgggaccctaaggcctaggtacccgtcgtaagtcgacgacccgaacgggtcctaccgtcccccgttcggtcctactccgttcgttcccctaccctcccgttccgtcgtccgttcgacttcgtcggacggtccgggtccgtcgggtaccgaacggggccgacgtagtacgctnacgngngcngtcncgngngngnncnnnc

SEQ ID NO: 218035 - DNA, 628 bp, Homo sapiens
  misc_feature: GYAE6OF02HNHEE.5.9.A09.1.454.CMB.1.raw
  modified_base (610)..(611): a, c, t, g, unknown or other
  misc_feature (610)..(611): n is a, c, g, or t
  modified_base (614)..(617): a, c, t, g, unknown or other
  misc_feature (614)..(617): n is a, c, g, or t
  modified_base (619)..(628): a, c, t, g, unknown or other
  misc_feature (619)..(628): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatccggccctcgacggggtccctgaccgtattcctctggcctccaggttctggcaccgcacgccctcccgtggcccatccacgtcggggcctccggggctggaggtatggacggctagtattacttacgcgcccaggtccccttaggaacctaacgtagggtttttggggtggttttggggtacgttcggggcgggaagggaaccctaaggtccgttacggtaacccgttccgttaaaggtccgaacggaccccgaaacgggtcctccggcccccgttcggtacctaccgttccgttccgttccccgtccccttcccgttcccgttcgttcctgtacttcgtcggtacggccgggtcgtcgggacgaacgggtccgacgtaagtagcnngannnngnnnnnnnnnn

SEQ ID NO: 218036 - DNA, 585 bp, Homo sapiens
  misc_feature: GYAE6OF02GZN9P.5.9.A09.1.454.CMB.1.raw
  modified_base (550)..(550): a, c, t, g, unknown or other
  misc_feature (550)..(550): n is a, c, g, or t
  modified_base (582)..(582): a, c, t, g, unknown or other
  misc_feature (582)..(582): n is a, c, g, or t
tcagatcagacacgcacgaccggtgctcgatttagcgagacgcgcagggtcctgggcccagtctgtggtgacgcagccgccctccgtttctgggccccagggcagacggtcaccatctcctgcactggaagcagctccgacagtcgggtcaggttatgatgtacattggtaccagcaacttccaggaacagcccccaaactcctcatctacgacaacaccaatcggccctcaggggtcccctgaccgattctctggcctccgaggtcctggccaccgcacgccctccctggcccatccacgtcgggcctccggggctggacggatggaggctgtatttacttacgtgcccaggtcccttagaacctaacgtggttttgggtgtttgggtgttcgggcggaggacagctggaccgtctaagtcgacgcccgaaggctcgcccctggcacgtctcgttcccaccttcctccgttgtctgtactcgtcggacggtccgggtcgtacgggtaccgaacgggtccgtacgtaacgtacgtcgacgtagacgcgcncgtcgtacgtacgtacgtacgacgtcgcgcgngtg

SEQ ID NO: 218037 - DNA, 781 bp, Homo sapiens
  misc_feature: GYAE6OF02JAFLY.5.9.A09.1.454.CMB.1.raw
  modified_base (357)..(357): a, c, t, g, unknown or other
  misc_feature (357)..(357): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagctaacttccgaaggaaccacgcccccaaatcctcatctacgaccaacaccaatccggccctagacggggtccctaggaccgtatttctcgtggcctccgtaggttccgtggccaccgcacggtccccttaccccgtggaccctaatccgacggttcggggcccttcccggggctggaaggtntcggacggtcttaggtactttaacgttacgcgacccgtaggtccccttaagaacctaacggtgggtttttggggtgttttaggggtcgttcggggacggggaacgggtaaccaacgggtccgttacggtaaccccggtttacgttaaacggtaccgtaaccggtacccggtaaacgggtccgttcccgggtaccccccggttacggttacccgtaccgtttcccggttacccggttttccccccggtcccctttaccccggtttcccggttccggttaccgttcggttaaccgttccgtacgggtaccgggtcccggggtccgttaccggtaccggtaaccgggtccgtaaccgtaacgtacggtccagtcgaccgtcggaactcggtctaccggtgtacgtacgtcgtacgtcgtcgtcgtcg

SEQ ID NO: 218038 - DNA, 606 bp, Homo sapiens
  misc_feature: GYAE6OF02GV8LO.5.9.A09.1.454.CMB.1.raw
  modified_base (589)..(606): a, c, t, g, unknown or other
  misc_feature (589)..(606): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatccggccctcaggggtccctgaccgattctctggcctccgaggtctggcaccgcagccctcctggcccatccacgtgggccttccggggctggacggatggaggctggtatttacttactcggccacggtccccttggaacctaaacgtagggtttttcggggtggttttggggtgttcggggacgggtagggaccaaggtcgtacggacccgttacttaacggtcgacgacccgtaacggccgtccggcccccgttcggtaccgtacttcccgttccgttcccctaccccgttcccgttcccgttcgttccgtaaacgtcttcgtcggtacggtcggggtactcgggaccgaggccgacagtacgnnnnnnnnnnnnnnnnnn

SEQ ID NO: 218039 - DNA, 636 bp, Homo sapiens
  misc_feature: GYAE6OF02H6NYQ.5.9.A09.1.454.CMB.1.raw
  modified_base (614)..(614): a, c, t, g, unknown or other
  misc_feature (614)..(614): n is a, c, g, or t
  modified_base (618)..(619): a, c, t, g, unknown or other
  misc_feature (618)..(619): n is a, c, g, or t
  modified_base (624)..(624): a, c, t, g, unknown or other
  misc_feature (624)..(624): n is a, c, g, or t
  modified_base (626)..(627): a, c, t, g, unknown or other
  misc_feature (626)..(627): n is a, c, g, or t
  modified_base (629)..(629): a, c, t, g, unknown or other
  misc_feature (629)..(629): n is a, c, g, or t
  modified_base (631)..(632): a, c, t, g, unknown or other
  misc_feature (631)..(632): n is a, c, g, or t
  modified_base (634)..(636): a, c, t, g, unknown or other
  misc_feature (634)..(636): n is a, c, g, or t
tcagatcagacacgcacgaccggtgctcgatttagcgagacgcgcagggtcctgggcccagtctgtggtgacgcagcccgccctccgtttctggggccccagggcagacggtcaccatctcctgcactggaagcagctccgacagtcgggtcaggttatgatgtacattggtaccagcaacttcaggacacgaccccaactcctcatctacgacaacaccaatccgccctcgacggggtccctgaccgtattcctctcggcctccgaggtcctggccaccgctacgccctccgtggccactcacgtgggcctccggctggaggatgagtctagtattatacgtgaccgaggtcccttagaacctaacgtttgggttttgggtaggttttcggggtcggtttccggggacgggtacggggtaacctaaggtccgttaccggtaccgttacccgtaaggtaccgaccggtaccccgtaagggtccctacccggtcccccgttggtaccctaccgttcgttcccgttaccccctaccctttccgtaccgttcgttctcgaccttcgtcgggaccggtcggtaccgtcggaccgtaaggccgtacgtaagtcgatcgntcgnngtacnanncngnncnnn

SEQ ID NO: 218040 - DNA, 624 bp, Homo sapiens
  misc_feature: GYAE6OF02IHG70.5.9.A09.1.454.CMB.1.raw
  modified_base (594)..(594): a, c, t, g, unknown or other
  misc_feature (594)..(594): n is a, c, g, or t
  modified_base (603)..(603): a, c, t, g, unknown or other
  misc_feature (603)..(603): n is a, c, g, or t
  modified_base (605)..(606): a, c, t, g, unknown or other
  misc_feature (605)..(606): n is a, c, g, or t
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (622)..(624): a, c, t, g, unknown or other
  misc_feature (622)..(624): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacatttggtaccagctaacttccaggaacacgcccccaaaactcctcatctaacgacaaacaccaatccggccctgacggggtccctgaccgattctctcggctcaggtctggccaccgcacgcctcctggccaatccagtcgggctaccgggctggagactgaggtctagtattactctcggccaggtcccttagaactaacgttggttttcggggtgtttaggggtcggtttcgggacgggaacggggtaccaaggtccgtcggtaacccgtcttaagtctacgaccctaaggccttccgccccgttacgctaccttcgttaccgttcccccgtccctttcccgttccggttcgttaccgtgtaacttccggtacggtacgggtccggggtacctacgggtacggtaaacgggcccacgtacgtaggtcncgactcgcncnncacncgtcncgntgcnnn

SEQ ID NO: 218041 - DNA, 735 bp, Homo sapiens
  misc_feature: GYAE6OF02HGZO2.5.9.A09.1.454.CMB.1.raw
  modified_base (700)..(700): a, c, t, g, unknown or other
  misc_feature (700)..(700): n is a, c, g, or t
  modified_base (705)..(705): a, c, t, g, unknown or other
  misc_feature (705)..(705): n is a, c, g, or t
  modified_base (711)..(711): a, c, t, g, unknown or other
  misc_feature (711)..(711): n is a, c, g, or t
  modified_base (717)..(717): a, c, t, g, unknown or other
  misc_feature (717)..(717): n is a, c, g, or t
  modified_base (728)..(728): a, c, t, g, unknown or other
  misc_feature (728)..(728): n is a, c, g, or t
  modified_base (730)..(730): a, c, t, g, unknown or other
  misc_feature (730)..(730): n is a, c, g, or t
  modified_base (734)..(734): a, c, t, g, unknown or other
  misc_feature (734)..(734): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaaactcctcatctacgacaacaccaatccggccctcgacggggtccctgaccgtattcctctggctccgagtctgcaccgcacgccctccctggcccatccacgtgggccctccgggcttggaggactggaggtcttaggtaatttacgttacgtgtacccgtacggtcccctttagaaacctaacggttaggtttttcggggttaggtttttcgggggtacggtttacccggggacggggtaaacggggtaacccctaaagggtcccgttacgggtaaaccccgtttaccgtaaaacggtcccgtaaccgggacccccgtaaaacggggttccctacccggtccccccggttacgggttacccgtaaccgtttcccgttacccggtttccccccggtaccccctttcccggtttacccggttacgttccgttacgtaccgttcgttacggaccgggtaccggggcgttacggggtaccgaacgggtccgacctacgtacgtngacgngtacgngtacgngcgcgcacgcnanaganc

SEQ ID NO: 218042 - DNA, 528 bp, Homo sapiens
  misc_feature: GYAE6OF02FXP8E.5.9.A09.1.454.CMB.1.raw
  modified_base (282)..(282): a, c, t, g, unknown or other
  misc_feature (282)..(282): n is a, c, g, or t
  modified_base (315)..(315): a, c, t, g, unknown or other
  misc_feature (315)..(315): n is a, c, g, or t
  modified_base (509)..(509): a, c, t, g, unknown or other
  misc_feature (509)..(509): n is a, c, g, or t
  modified_base (513)..(528): a, c, t, g, unknown or other
  misc_feature (513)..(528): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaaggaacagcccccaaactcctcatctaacgacaacaccaatccgccctcgacggggtcccctgaccgattcctctggcctccgaggtctggccaccgnacgccctccctggccatcacgtgggctccgggntggaggatggagctgatttatactgaccaggtcccttgactaacgtgtttgggtgtttgggtgttcggacggaagggaccaagcgtagaccgtactaagtcacgcccgaaggcctcgcccccgtgtcacgtcctcgttccccacccttccgtcccgtgtcctgtactcgtggacggcggtcgtcggcgaagccnatgnnnnnnnnnnnnnnnn

SEQ ID NO: 218043 - DNA, 642 bp, Homo sapiens
  misc_feature: GYAE6OF02IN56J.5.9.A09.1.454.CMB.1.raw
  modified_base (312)..(312): a, c, t, g, unknown or other
  misc_feature (312)..(312): n is a, c, g, or t
  modified_base (621)..(622): a, c, t, g, unknown or other
  misc_feature (621)..(622): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (631)..(631): a, c, t, g, unknown or other
  misc_feature (631)..(631): n is a, c, g, or t
  modified_base (635)..(637): a, c, t, g, unknown or other
  misc_feature (635)..(637): n is a, c, g, or t
  modified_base (639)..(641): a, c, t, g, unknown or other
  misc_feature (639)..(641): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaatcctcatctacgacaacaccaatcggccctcgaggggtccctgaccgtattctctggcctccgaggtctggccaccgcacgccctcccgtggccatcacgtcgggctccgggntggaggatggaggtctagtattacttactcgaccgtacggcccttagacctaacgtgggtttttgggtggttttggggtgtttcggggacgggtagggtactcgaaaggtccgtacgggtacccgttacgtaacggtaccgaacggaccccgtaagggtcccgtacccggtccccccgttacgggtaccctaccgtttccgtttacccggttcccccgtaccccttcccgttcccggttcgtaccgtacgtacgttcgtacgggcggtccggggtcgtacggacgacgggccgacgtagtacggctagnncgngntcgncgcnnncnnng

SEQ ID NO: 218044 - DNA, 621 bp, Homo sapiens
  misc_feature: GYAE6OF02G7U72.5.9.A09.1.454.CMB.1.raw
  modified_base (313)..(313): a, c, t, g, unknown or other
  misc_feature (313)..(313): n is a, c, g, or t
  modified_base (608)..(608): a, c, t, g, unknown or other
  misc_feature (608)..(608): n is a, c, g, or t
  modified_base (618)..(619): a, c, t, g, unknown or other
  misc_feature (618)..(619): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggcctccaggtctcggcaccgcacgcctccctggccatcactgggctccgggctggaggntgaggctgattatactcgccaggtccttgaacacgtaggtttgggtgtttgggtcgttcgggcgggacgggaccaaggctcggtacccgtcctaagtaccacgtacccaaggcctccggccccccgttcgggtacctaccgttcccgttccggttaccccctacccccgttccccgttcccggttacgttcccgttagtaccttccgttcggacgggtccggggaccttcggggaccgaacggggtcccgaacgtaacgttaacgggcagtcgcgtcgcgtacgtcgacgtcgcncgcgtcgcgnngc

SEQ ID NO: 218045 - DNA, 664 bp, Homo sapiens
  misc_feature: GYAE6OF02HCCK8.5.9.A09.1.454.CMB.1.raw
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
  modified_base (633)..(633): a, c, t, g, unknown or other
  misc_feature (633)..(633): n is a, c, g, or t
  modified_base (637)..(637): a, c, t, g, unknown or other
  misc_feature (637)..(637): n is a, c, g, or t
  modified_base (643)..(644): a, c, t, g, unknown or other
  misc_feature (643)..(644): n is a, c, g, or t
  modified_base (655)..(655): a, c, t, g, unknown or other
  misc_feature (655)..(655): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
  modified_base (663)..(663): a, c, t, g, unknown or other
  misc_feature (663)..(663): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatccggccctcgacggggtccctgaccgtattctctggctccaggtcnggcacgcacgcctccgnggccatcacgtcgggcctccgggctggagggtatggacggtctaggtaatttacgtttacgtcgacccgtacgggtcccctttagaaacccgtaaacggttaggggtttttgggggttggtttttgggggtttacggtttccgggggacggggaaacggggtaccctaaggtccgttacggtaaccccgtttaccgtaaggtccgaacggacccgaaacgggtcccgtcccggtcccccgttcggtcctaccgttcccgttccccgtcccttcccgttccgttcgttccgtacgtctcgtcggacggccgggtcgtacgggaccgaacgggccgacgtacgtacgntagntcgcgnncgacgctagcncangncgnc

SEQ ID NO: 218046 - DNA, 727 bp, Homo sapiens
  misc_feature: GYAE6OF02JGQTJ.5.9.A09.1.454.CMB.1.raw
  modified_base (672)..(672): a, c, t, g, unknown or other
  misc_feature (672)..(672): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacagtcgggtcaggttatgatgtacatttggtaccagcaacttccaggaacacgcccccaaactcctcatctacgacaacaccaatccggccctcgacgggtccctacgaccgtacttctctcggcctccgaggttcctcggccaccgctacgcccgttccgtcggccctaatccgaacgtcgggccgtccggggtcctaggaacggaagttcggacggtcgtagtaatttaactacgtcgtaccgacggttcccgttagaacctaacgtacgggtttttgggtcggttttacggggttcgttccggggtacgggtaacggggtaaccctaagggtcccgttacggtaacccgtttacccggttaaaggtccgaaccggtaccccgaaggttcccgtcccggtacccccgtcgggtaccttaccgttcccttccgttaccccctacccgttcccgttccgtacgttcctacggtaaccgttggacggtccgggtcgtaccgaaccggtagggcccgttaagtaacgtccggntcgacgtcgtacgcgtggaacctcgtcgtcgtcgtcgtacgtcgacgcgtcgtcg

SEQ ID NO: 218047 - DNA, 800 bp, Homo sapiens
  misc_feature: GYAE6OF02HBEQE.5.9.A09.1.454.CMB.1.raw
  modified_base (359)..(359): a, c, t, g, unknown or other
  misc_feature (359)..(359): n is a, c, g, or t
  modified_base (662)..(662): a, c, t, g, unknown or other
  misc_feature (662)..(662): n is a, c, g, or t
  modified_base (772)..(772): a, c, t, g, unknown or other
  misc_feature (772)..(772): n is a, c, g, or t
  modified_base (794)..(794): a, c, t, g, unknown or other
  misc_feature (794)..(794): n is a, c, g, or t
tcagatcagacacgcacgaccggtgctcgatttagcgagacgcgcgagggtcctgggcccagtctgtggtgacgcagccgccctccgtttctggggccccagggcagacggtcaccatctcctgcactggaagcagctccgacatcgggtcaggttatgatgtacattggtaccagacaacttccaaggtaaccagacccccaaaactccgtacacttctaacgaccaaacaccaatccggccctagacggggtccctgaccgtattccgtctcggtcctccgaggttctcggcctaacccggcacgtcccttaccccgtcggaccctagttccgacggttcggggcccttcccggggntacgggaaggtagttcggaaggtcctaagttaattttacgttaccgtagaccccgtacgggttccccttagaaaccgtaacgttacggggtttttcggggttggtttttacgggggtacggtttccggggaccggggtaacgggaaccctaagggtcccttaccgggtaacccgtttacgtaaacgtccgaaacggtaccccgtaaacgggttcctaccccgggtcccccggtttaacgggtcctaacccggtttcccgttttaccggttaccccctaaccccgtttcccgtttccccgggtnttaacccggttcgtaccgtttccggtaccgggtaaccggggtcccgggttacggtaccgggaacccggtacggggtaccctaccgttaagtaccgccaggtcacggtacncgtagcgacgtgctgcgtcgcncgcgtg

SEQ ID NO: 218048 - DNA, 770 bp, Homo sapiens
  misc_feature: GYAE6OF02HEYRJ.5.9.A09.1.454.CMB.1.raw
  modified_base (731)..(731): a, c, t, g, unknown or other
  misc_feature (731)..(731): n is a, c, g, or t
  modified_base (744)..(744): a, c, t, g, unknown or other
  misc_feature (744)..(744): n is a, c, g, or t
  modified_base (758)..(758): a, c, t, g, unknown or other
  misc_feature (758)..(758): n is a, c, g, or t
  modified_base (766)..(766): a, c, t, g, unknown or other
  misc_feature (766)..(766): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcagggttatgatgtacattggtaccagcaacttccaggaacacgcccccaaactcctcactctacgacaacaccaatccggccctgacggggtccctgaccgattctctggctccgaggtctggccacccgcacgtcctccccgtggcctaactcccgaacgtcggggtacccgttccccggggccttagggaagggtaacgttcgggaacgggtccgttaggtaacttttaacgtttaaccgtcggtaccccgacgggttccccctttagaaaccgttaaacgttcggggtttttaggggttgggttttacggggttcggtttcggggaccgggtaaacggggtacccaaaggttccgtacgggtaacccgtttaccgtaaacggtccgaaccggtacccgtaaacgggtcccgttacccggtacccccggttcgggtaaccctaccgttacccgtttcccggtttacccccgtaccccgtttccccgtcccggttgttaccgttacggtaccttcgtacggaccgggtaccggggtcgtacgggtaccggaacgggtaccgacctaggttacgactcggnaccgtgacacggntcgacgacgacacncgtcgtcngtcg

SEQ ID NO: 218049 - DNA, 618 bp, Homo sapiens
  misc_feature: GYAE6OF02JLQWL.5.9.A09.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (318)..(318): a, c, t, g, unknown or other
  misc_feature (318)..(318): n is a, c, g, or t
  modified_base (530)..(530): a, c, t, g, unknown or other
  misc_feature (530)..(530): n is a, c, g, or t
  modified_base (585)..(585): a, c, t, g, unknown or other
  misc_feature (585)..(585): n is a, c, g, or t
  modified_base (590)..(591): a, c, t, g, unknown or other
  misc_feature (590)..(591): n is a, c, g, or t
  modified_base (597)..(597): a, c, t, g, unknown or other
  misc_feature (597)..(597): n is a, c, g, or t
  modified_base (605)..(605): a, c, t, g, unknown or other
  misc_feature (605)..(605): n is a, c, g, or t
tcagatcagacacgcacgaccggtgctcgatttagcgagacgcgcagggtcctgggcccagtctgtggtgacgcagccgccctccgtttctgggccccagggcagacggtcaccatctcctgcactgaagcagctccgacatcggtcaggttatgatgtacattggtaccagcaacttccaggaccacgccccaaactcctnaatctacgaacaacacctaatccggaccctcgtacgggtccctgaccgtattctcgngctccaggtctcggcaccgcacgtccctccctggcctaagtccacgttggcctccgggntaggagctggaagtctgtatttaactcgtcgctacggtcccttagaaccgttaacgtggttttcgggtacgtttgggttagtccggggacgtacgggaccttaacggcctaaggtccctagtaacgacgtacgaccgtaacggtccttaccggtcccgtacggttaccaccgtccgtccgttaacccgcccttccgtccgtcgttactacgnttccgttcggacgtccggtaccgtggaaccgtacgcgcaagttcgactcttacgngtacnncgtacnctgctcgntacgtgctctacg

SEQ ID NO: 218050 - DNA, 742 bp, Homo sapiens
  misc_feature: GYAE6OF02ISOU9.5.9.A09.1.454.CMB.1.raw
  modified_base (266)..(266): a, c, t, g, unknown or other
  misc_feature (266)..(266): n is a, c, g, or t
  modified_base (316)..(316): a, c, t, g, unknown or other
  misc_feature (316)..(316): n is a, c, g, or t
  modified_base (708)..(708): a, c, t, g, unknown or other
  misc_feature (708)..(708): n is a, c, g, or t
  modified_base (715)..(715): a, c, t, g, unknown or other
  misc_feature (715)..(715): n is a, c, g, or t
  modified_base (718)..(718): a, c, t, g, unknown or other
  misc_feature (718)..(718): n is a, c, g, or t
  modified_base (724)..(724): a, c, t, g, unknown or other
  misc_feature (724)..(724): n is a, c, g, or t
  modified_base (729)..(729): a, c, t, g, unknown or other
  misc_feature (729)..(729): n is a, c, g, or t
  modified_base (733)..(734): a, c, t, g, unknown or other
  misc_feature (733)..(734): n is a, c, g, or t
  modified_base (736)..(737): a, c, t, g, unknown or other
  misc_feature (736)..(737): n is a, c, g, or t
  modified_base (739)..(740): a, c, t, g, unknown or other
  misc_feature (739)..(740): n is a, c, g, or t
  modified_base (742)..(742): a, c, t, g, unknown or other
  misc_feature (742)..(742): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacatttggtaccagcaacttccaggaacacgcccccaaactcctcactctaccgacaaaccaccaatccggaccctcgacggggtcccctgtaaccgactttcnctcggacctccgaggttccgtggcccacccgcctacggccccttccccgnggacccatccgacgtcgggtcctccgggcttggaacgggtatcgggaagccgttggtaacttttacgtttaacccgcggaccccgtaacgggtccccctttaaggaaccctaaacggttggttttcggggttggttttcggggttaggttccgggacggggtaacggaaccctaaaggggtccgttacggtaccccgtttaaccaacggtaccgtacggtaaccccgtaagggttcccgtacccggtcccccgttaccgggtcccttacccgttaccgttcccggtcccccttaccccgttcccggttcccggtccgtttaccgtgtaacgttccgtacggtccggttacccgggcgttacgggacccgtacgggacgcctaacggttacgngtactcncgngctcgntacgngcgnngnngnntn

SEQ ID NO: 218051 - DNA, 656 bp, Homo sapiens
  misc_feature: GYAE6OF02G44K4.5.9.A09.1.454.CMB.1.raw
  modified_base (638)..(639): a, c, t, g, unknown or other
  misc_feature (638)..(639): n is a, c, g, or t
  modified_base (641)..(641): a, c, t, g, unknown or other
  misc_feature (641)..(641): n is a, c, g, or t
  modified_base (647)..(656): a, c, t, g, unknown or other
  misc_feature (647)..(656): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaaggaacacgacccccaaactcctcatctaacgaaccaacaccaaagtccggccctcgacgggggtccctacggaccgtatttcctcgtcggcctcccgaggttccgtggccaccggcacgtccctccccgtggccctatccgacgtcgggccgtccggggctgggaggagtgggacggtccgtagtactttacttacgtcggacccgtacggtccctaggaaccgtaacgttagggttttgggggttggttttgggggtcggtttcggggacgggaacgggaacccaaaggtccgtacggtacccggttaacgtaacgtccgaaccggtacccgacggtcctcccggtcccccgttcggtcctaccgttccgtcccgttccccgtcccgttcccgttccggttcgtccgtgtactcgcgggcgcgggcgtcgggacgtacggccgataacgtgnncngcagcnnnnnnnnnn

SEQ ID NO: 218052 - DNA, 625 bp, Homo sapiens
  misc_feature: GYAE6OF02H67LY.5.9.A09.1.454.CMB.1.raw
  modified_base (326)..(326): a, c, t, g, unknown or other
  misc_feature (326)..(326): n is a, c, g, or t
  modified_base (354)..(354): a, c, t, g, unknown or other
  misc_feature (354)..(354): n is a, c, g, or t
  modified_base (603)..(603): a, c, t, g, unknown or other
  misc_feature (603)..(603): n is a, c, g, or t
  modified_base (607)..(608): a, c, t, g, unknown or other
  misc_feature (607)..(608): n is a, c, g, or t
  modified_base (610)..(611): a, c, t, g, unknown or other
  misc_feature (610)..(611): n is a, c, g, or t
  modified_base (613)..(613): a, c, t, g, unknown or other
  misc_feature (613)..(613): n is a, c, g, or t
  modified_base (615)..(616): a, c, t, g, unknown or other
  misc_feature (615)..(616): n is a, c, g, or t
  modified_base (619)..(625): a, c, t, g, unknown or other
  misc_feature (619)..(625): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaaggacacgccccaaactcctcatctacgacaacaccaatccggccctcgacggggtccctgaccgtattcctctcggctccgaggttcctcggccaccgcacgccctccctggccatcacgtgggccctccgggctggaggntggaggctgtatttactacgtcgaccgnggtcccttagaactaacgttagggttttgggttgggttttggggtggtttcggggacgggacgggtaccaaggtccgtacggtacccgttacgtaagtccgacggacccgaacggtccgtcccgcccccgttcggtcctaccgttccgttccgttacccctacccctttcccgttccgttccgttcgtacgtacttcgtacgggacggccgggtacgttcgggaacggtaacgggccgacgtaagtcgngcgnngnncngnngcnnnnnnn

SEQ ID NO: 218053 - DNA, 726 bp, Homo sapiens
  misc_feature: GYAE6OF02IADMC.5.9.A09.1.454.CMB.1.raw
  modified_base (326)..(326): a, c, t, g, unknown or other
  misc_feature (326)..(326): n is a, c, g, or t
  modified_base (692)..(692): a, c, t, g, unknown or other
  misc_feature (692)..(692): n is a, c, g, or t
  modified_base (696)..(696): a, c, t, g, unknown or other
  misc_feature (696)..(696): n is a, c, g, or t
  modified_base (700)..(700): a, c, t, g, unknown or other
  misc_feature (700)..(700): n is a, c, g, or t
  modified_base (703)..(703): a, c, t, g, unknown or other
  misc_feature (703)..(703): n is a, c, g, or t
  modified_base (708)..(708): a, c, t, g, unknown or other
  misc_feature (708)..(708): n is a, c, g, or t
  modified_base (715)..(715): a, c, t, g, unknown or other
  misc_feature (715)..(715): n is a, c, g, or t
  modified_base (725)..(725): a, c, t, g, unknown or other
  misc_feature (725)..(725): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagccaacttccaaggaacacgcccccaaactcctacatctacgaacaacaaccaatccggccctcgacggggtccctcgaccgtattcctcgtcggctccaggtctaggccaccgcacgccctccgtggaccatcgacgtggccctaccgggntggaggtagtcggacgtctagtaatttacttcgtcgccacggtcccttagaaccgtaacgttagggttttcggggtggttttagggggtcggttacggggccgggtaacggggtaaccctaaacgggtccgtacgggtaacccgttttacccgttaaaggtaccgtaacggaccccggtaaacgggtcccgttaccccggtaccccccggtttacgggtaccctaaccgtttcccgtttacccggtttacccccctaaccccgttttcccgtcccggtttacgttcccgtacgtaccgttcggtacggaccgggtccgggtaccgtacgggaccgtaaacgggtccgacgtaacgttcgagtacgngcgngtcncgngacgngtcgcgngtgcgtacgnc

SEQ ID NO: 218054 - DNA, 518 bp, Homo sapiens
  misc_feature: GYAE6OF02GBC77.5.9.A09.1.454.CMB.1.raw
  modified_base (332)..(332): a, c, t, g, unknown or other
  misc_feature (332)..(332): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (505)..(510): a, c, t, g, unknown or other
  misc_feature (505)..(510): n is a, c, g, or t
  modified_base (512)..(518): a, c, t, g, unknown or other
  misc_feature (512)..(518): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaaactcctcatctacgacaacaccaatcggccctcaggggtccctgaccgattctctggctccaggtctggcaccgcagcctccctggccatcactgggcctccgggctgaggtatggacggctgattattacgngccgagcccttgacactaggtttgggtgtttgggtgttcggcgggtaggaccaagctacgaccgttcaagtcacgcccgaaggctacgccccgtcggcactcctcgttcccgccctcctcgtctctcgactctcgaggcgggctcgggcgacgggcgacgtatagntgncgtnnnnnncnnnnnnn

SEQ ID NO: 218055 - DNA, 652 bp, Homo sapiens
  misc_feature: GYAE6OF02I2FNX.5.9.A09.1.454.CMB.1.raw
  modified_base (371)..(371): a, c, t, g, unknown or other
  misc_feature (371)..(371): n is a, c, g, or t
  modified_base (611)..(611): a, c, t, g, unknown or other
  misc_feature (611)..(611): n is a, c, g, or t
  modified_base (620)..(620): a, c, t, g, unknown or other
  misc_feature (620)..(620): n is a, c, g, or t
  modified_base (642)..(642): a, c, t, g, unknown or other
  misc_feature (642)..(642): n is a, c, g, or t
  modified_base (649)..(649): a, c, t, g, unknown or other
  misc_feature (649)..(649): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacagtcgggtcaggttatgatgtactattggtaccagcaacttccaggaaccacgcccccaaactcctcatctacgacaacacaatccggccctcgacgggtccctagaccgtattctcgtggtcctccgtaggtccgtacgcctaaccgccacgtccctcccgtaggtccaacgtccgacggtcggtccgtccgggcttaggaacgtgtcgacggctgtactttaagtcncgtaccacggtccttggaacctaagtaggtttgggttgttagggtcgtcgggcggtaacgggacacgtcgtcgtacccgtactaacgcgacgtacccgaacggtccgtcccggtaccccgttacggtacctaccgtcccgttcccgtacccctacccgtccgttcccggttacgttccgtacgtacgtccgtaggtaccggtccgggtctacgggtcaaccggggtccactaaggtcgcngtacgtgcncgcgcgtacgcgcgtacgtcgngcgtcgngtg

SEQ ID NO: 218056 - DNA, 701 bp, Homo sapiens
  misc_feature: GYAE6OF02JY3W4.5.9.A09.1.454.CMB.1.raw
  modified_base (157)..(157): a, c, t, g, unknown or other
  misc_feature (157)..(157): n is a, c, g, or t
  modified_base (671)..(671): a, c, t, g, unknown or other
  misc_feature (671)..(671): n is a, c, g, or t
  modified_base (700)..(700): a, c, t, g, unknown or other
  misc_feature (700)..(700): n is a, c, g, or t
tcagatcagacacgcacgaccggtgctcgatttagcgagacgcgcgagggtcctgggcccagtctgtggtgacgcagccgccctccgtttctgggccccagggcagacggtcaccatctcctgcactggaagcagctccgacatcgggtcaggttangatgtacattggtaccagcaacttccaggacacgcccccaaactcctcatctacgacaacaccaatcgccctgagggtccctgaccgtattcgtcgtggcctccgaggtctcggccaccgcacgtccctccctaggcctagtccacgtcggggccttccggggctggacggtagtcggtaggtccgttagtaactttaagttaccgcgtacccgacggtaccccttaggaacctaaacggttgggttttggggtcggttttaggggtcggtttccggacggggtaaacgggtcccgtaaaggtcccgtacggttaacccgtcccgttaaagtccgtaaccggtcccgtaaacgggtccccttccggaccccccggttcgggttacccgtaccgtttcccgttaacccgtttccccgttccccgttacccgttccggttccgttacgtacgtactcgtacgacggtccgggccgtaggaccgtaggtccgacgtacgtacgcgagtcgcgtaggngtgtacgcgtagacgcgtgtgcgtcgtanc

SEQ ID NO: 218057 - DNA, 525 bp, Homo sapiens
  misc_feature: GYAE6OF02IY0TB.5.9.A09.1.454.CMB.1.raw
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (363)..(363): a, c, t, g, unknown or other
  misc_feature (363)..(363): n is a, c, g, or t
  modified_base (501)..(501): a, c, t, g, unknown or other
  misc_feature (501)..(501): n is a, c, g, or t
  modified_base (503)..(504): a, c, t, g, unknown or other
  misc_feature (503)..(504): n is a, c, g, or t
  modified_base (509)..(510): a, c, t, g, unknown or other
  misc_feature (509)..(510): n is a, c, g, or t
  modified_base (516)..(516): a, c, t, g, unknown or other
  misc_feature (516)..(516): n is a, c, g, or t
  modified_base (518)..(525): a, c, t, g, unknown or other
  misc_feature (518)..(525): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaaggaacacgcccccaaaatcctcatctacgacaacaccaatccggccctcacggggtccctgaccgattctcgtcggctccgaggtctggccaccgcngccctccnggccatcacgtggctccgggntgagntgagctgattntcngccgagccttgactacgtgtttggtgttgggtntcgggcggaggaccagctacgtaccgtactagcacgccgagtccgtccgccccgtcggtactaccgtccgtcgttccccgccctcccgtccgttgtcctgtattcgtggagccgggcgtcggcgacggtccacgagtncnncagcnngtcgcngnnnnnnnn

SEQ ID NO: 218058 - DNA, 632 bp, Homo sapiens
  misc_feature: GYAE6OF02GUZYW.5.9.A09.1.454.CMB.1.raw
  modified_base (326)..(326): a, c, t, g, unknown or other
  misc_feature (326)..(326): n is a, c, g, or t
  modified_base (610)..(610): a, c, t, g, unknown or other
  misc_feature (610)..(610): n is a, c, g, or t
  modified_base (617)..(618): a, c, t, g, unknown or other
  misc_feature (617)..(618): n is a, c, g, or t
  modified_base (620)..(620): a, c, t, g, unknown or other
  misc_feature (620)..(620): n is a, c, g, or t
  modified_base (623)..(623): a, c, t, g, unknown or other
  misc_feature (623)..(623): n is a, c, g, or t
  modified_base (625)..(627): a, c, t, g, unknown or other
  misc_feature (625)..(627): n is a, c, g, or t
  modified_base (629)..(631): a, c, t, g, unknown or other
  misc_feature (629)..(631): n is a, c, g, or t
tcagatcagacacgcacgaccggtgctcgatttagcgagacgcgcagggtcctgggcccagtctgtggtgacgcagccgccctccgtttctgggggccccagggcagacggtcaccatctcctgcactggaagcagctccgacatcgggtcaggttatgatgtacattggtaccagcaacttccaaggaacacgcccccaaactcctcatctacgacaacaccaatccggccctcgacggggtccctgaccgtattctcgtggcctccaggttctggcaccgcacgcctcccgtggccatccacgtgggccgtccgggctggaggntggaggtctgtattacgttacgcgaccgtacggtccttagaaccgtaacgtgggttttgggttggtttacgggtcggtttccgggcgggtaacggaaccctaaggtccgtacggtacccgttacgtaacgtcgacgacccgtaagggccctacccggtcccccgttacgggtcctaccgttcccgttcccgtttaccccctaccccgttcccgttccggttccgttctacggtacttcgtcggacggtccgggtcgtacggacgacggcgaccgtgtagctcgntgatcgnncngcncnnncnnnc

SEQ ID NO: 218059 - DNA, 683 bp, Homo sapiens
  misc_feature: GYAE6OF02IGBQ2.5.9.A09.1.454.CMB.1.raw
  modified_base (215)..(215): a, c, t, g, unknown or other
  misc_feature (215)..(215): n is a, c, g, or t
  modified_base (312)..(312): a, c, t, g, unknown or other
  misc_feature (312)..(312): n is a, c, g, or t
  modified_base (658)..(658): a, c, t, g, unknown or other
  misc_feature (658)..(658): n is a, c, g, or t
  modified_base (668)..(669): a, c, t, g, unknown or other
  misc_feature (668)..(669): n is a, c, g, or t
  modified_base (671)..(672): a, c, t, g, unknown or other
  misc_feature (671)..(672): n is a, c, g, or t
  modified_base (674)..(676): a, c, t, g, unknown or other
  misc_feature (674)..(676): n is a, c, g, or t
  modified_base (678)..(678): a, c, t, g, unknown or other
  misc_feature (678)..(678): n is a, c, g, or t
  modified_base (680)..(680): a, c, t, g, unknown or other
  misc_feature (680)..(680): n is a, c, g, or t
  modified_base (682)..(682): a, c, t, g, unknown or other
  misc_feature (682)..(682): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtactatttggaccagacaacttccgaaggaaacacgacccccaaaactccctanaacttcaacgaacaaaccaaccaaagtccggaccctcgacggggtccctagaaccgtatttcctcgtcggtcctaccgtaggtcgtggacacccganacgtccctaccgtgccaatcgacgtcggccgtccggctaggaggactggaacggctagtattaacttacgtgaccgtacggtcccttaagaacctaacggttaggttttcggggttggtttaggggtttcggttacgggacgggtaagggaacctaaaggtcgtacgtaaccggtcctaaaggtcgaccgtacccgaaggtcctcccgccccgtttaggacctaaccgtttccgttaccgttcccccaaccccgtttccgtcggttacctcgttaagacctttcggaacggtaccgggtaccggggtccaacgggggtaccgtaaagggcccgaataacgttaagncagcgaagtnngnnannngnananc

SEQ ID NO: 218060 - DNA, 789 bp, Homo sapiens
  misc_feature: GYAE6OF02JS4QZ.5.9.A09.1.454.CMB.1.raw
  modified_base (259)..(259): a, c, t, g, unknown or other
  misc_feature (259)..(259): n is a, c, g, or t
  modified_base (744)..(744): a, c, t, g, unknown or other
  misc_feature (744)..(744): n is a, c, g, or t
  modified_base (772)..(772): a, c, t, g, unknown or other
  misc_feature (772)..(772): n is a, c, g, or t
  modified_base (779)..(779): a, c, t, g, unknown or other
  misc_feature (779)..(779): n is a, c, g, or t
  modified_base (787)..(787): a, c, t, g, unknown or other
  misc_feature (787)..(787): n is a, c, g, or t
tcagatcagacacgcacgaccggtgctcgatttagcgagacgcgcagggtcctgggccagtctgtggtgacgcagccgcctccgtttctcggggcccagggcagacggtcaccatctcctgcactggaagcagctccgacatcgggtcaggttatgatgtacatttggtaccagctaaccttccgaaggaactacgacccctaaactcctacacttcaccaacaaccaccaactccgcctcgcggggtcctcgaccgtnttctcgtcggctccgtcggtcgtcggaccaccggcacgccctcccgtcgaccacttcgacggttcgggcccgtcgggtcgtaggaggtacgcgggtacgtctaggtaattacttacgcgtaccgtacggtccttacggaactaacggttgggttttcggggttacgggttttcggggtacgggttaccgggggtacggaacggggtaaacccgtacgggtccggtacccgttaacccgggtttaaccgttaacggttaaccgaaccgggtacccggtaaacggggttccccggttaacccggtcccccgggtttacggtaaccccggttcccgtttaccggtttaccccggttcccccggtttcccgtttaccccggttcccggtttaccgttcccgttaacggtttcccgttacgtaaccgggttccggccggggttacccggtacgggtaaccggtaccgggttacggaccgtacgttaacgntacgtctagacgctcggatcgcgttacncgtacgngtcgtcgncg

SEQ ID NO: 218061 - DNA, 669 bp, Homo sapiens
  misc_feature: GYAE6OF02FJYT9.5.9.A09.1.454.CMB.1.raw
  modified_base (642)..(642): a, c, t, g, unknown or other
  misc_feature (642)..(642): n is a, c, g, or t
  modified_base (652)..(669): a, c, t, g, unknown or other
  misc_feature (652)..(669): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggagcagctccgacatcggtcaggttatgatgtacattgtaccagcaacttccaggaacacgacccccaaactcctcatctacgaccaacaccaactccggccctcgacggggtccctgaccgtattcctctggcctccgaggtccgtgggaccacccggcacgccctccccgtgggccctacgttcccacgtcggggcccgtcccggggcttacgggaacggtagtcggacgggtctttagtaacttttaacgttttaccgcgaccccggaagggtcccctttaggaacctaaccgttggggtttttacgggggttgggtttttaggggggttcggtttccgggggccgggaaacgggtacccgtaacggtccgtacgtaccccgggtttactaaccggttaccgaacgacccgacgggtcccgtcccgtcccccgtccgttcctaccgttccgttcccgttcccctcccgttcccttcgttctcgtcgtactcgcggaggtcggcgtcgacgngccagagcgnnnnnnnnnnnnnnnnnn

SEQ ID NO: 218062 - DNA, 791 bp, Homo sapiens
  misc_feature: GYAE6OF02FP449.5.9.A09.1.454.CMB.1.raw
  modified_base (749)..(749): a, c, t, g, unknown or other
  misc_feature (749)..(749): n is a, c, g, or t
  modified_base (769)..(769): a, c, t, g, unknown or other
  misc_feature (769)..(769): n is a, c, g, or t
  modified_base (785)..(785): a, c, t, g, unknown or other
  misc_feature (785)..(785): n is a, c, g, or t
tcagatcagacacgcacgaccggtgctcgatttagcgagacgcgcgagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctaacgaccaacaccaatccggccctcgacggggtccctgaccgtattcctcgtggcctccgtaggtctggccaccggcagtccccgtacccccgtggccacgttccgaccttcggggcccgttccggggacgtcggtaagggagtcggacgggtcgttacggttaattttaagtttaccgtacggtaccccggtacgggtaccccgtttaggaacccgtaaacccggtttaggggtttttgggggttttaggggtttttcgggggttcgggttttacggggggacggggtaaacgggggtaacccgaaaggtccgtacgggttaaccccggtacccgtttaaacggtacccgaaccggaccccggtaaacgggtccccggttcccggtaccccccgttccgggttaccctaccggtttaccgttccccggtttacccccctaccccgttcccgtttcccggttccggttccgtagtaccttacgtcgggtacggccgggtaccgtcggggaccgtaacgggtccgaacgtagtacggtntacgctagtcatcacgtacncgtagtctagcgtcgngtcgac

SEQ ID NO: 218063 - DNA, 706 bp, Homo sapiens
  misc_feature: GYAE6OF02IB3B8.5.9.A09.1.454.CMB.1.raw
  modified_base (274)..(274): a, c, t, g, unknown or other
  misc_feature (274)..(274): n is a, c, g, or t
  modified_base (658)..(658): a, c, t, g, unknown or other
  misc_feature (658)..(658): n is a, c, g, or t
  modified_base (672)..(672): a, c, t, g, unknown or other
  misc_feature (672)..(672): n is a, c, g, or t
  modified_base (679)..(679): a, c, t, g, unknown or other
  misc_feature (679)..(679): n is a, c, g, or t
  modified_base (684)..(684): a, c, t, g, unknown or other
  misc_feature (684)..(684): n is a, c, g, or t
  modified_base (688)..(688): a, c, t, g, unknown or other
  misc_feature (688)..(688): n is a, c, g, or t
  modified_base (691)..(692): a, c, t, g, unknown or other
  misc_feature (691)..(692): n is a, c, g, or t
  modified_base (695)..(698): a, c, t, g, unknown or other
  misc_feature (695)..(698): n is a, c, g, or t
  modified_base (700)..(702): a, c, t, g, unknown or other
  misc_feature (700)..(702): n is a, c, g, or t
  modified_base (705)..(705): a, c, t, g, unknown or other
  misc_feature (705)..(705): n is a, c, g, or t
tcagatcagacacgcacgaccggtgctcgatttagcgagacgcgcagggtcctgggcccagtctgtggtgacgcagccgccctccgtttctcggggccccagggcagacggtcaccatctcctgcactggaagcagctccgacagtcgggtcaaggttatgatgtactattcggtaccagactaacgttcgaaggaaccacgaccccaaactcctactatctaaccgacaaaccgaaccagtcccggcctacggtacgggaccctagacccgtntttcctcgtggaccttccgaggttccgtgaccgaccgctaccgccctcccgtgccgtaactccgtaccggtcgggcccgttccggggtccgtaagggtacggtaagtcggtacggtacgtttacgttaacgttttacgttaaccggccgtaccggtaacccccggttaccgttacgtaaaccgtaaacggttttcggggtttttacgggggtttggggttttccggggtaacgggtttccggggaaccgggtaacggtaacgtacggtcgtaccggttaccgtacgtagtcgaaccgtccggacgtccgtccgtcccgtcgtaccgtctcgttcccgtcccgtcccttccgtcgtctcgtagtccgtcgttcggacggcgtcgngtaccggcgtacgngaacgtnagtcncgtncgnngcnnnngnnncgnc

SEQ ID NO: 218064 - DNA, 736 bp, Homo sapiens
  misc_feature: GYAE6OF02H38VS.5.9.A09.1.454.CMB.1.raw
  modified_base (223)..(223): a, c, t, g, unknown or other
  misc_feature (223)..(223): n is a, c, g, or t
  modified_base (712)..(712): a, c, t, g, unknown or other
  misc_feature (712)..(712): n is a, c, g, or t
  modified_base (714)..(714): a, c, t, g, unknown or other
  misc_feature (714)..(714): n is a, c, g, or t
  modified_base (717)..(717): a, c, t, g, unknown or other
  misc_feature (717)..(717): n is a, c, g, or t
  modified_base (722)..(722): a, c, t, g, unknown or other
  misc_feature (722)..(722): n is a, c, g, or t
  modified_base (724)..(724): a, c, t, g, unknown or other
  misc_feature (724)..(724): n is a, c, g, or t
  modified_base (726)..(729): a, c, t, g, unknown or other
  misc_feature (726)..(729): n is a, c, g, or t
  modified_base (731)..(736): a, c, t, g, unknown or other
  misc_feature (731)..(736): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgccccaaacctcctcatctacgacaacacaanccgcctcgacggggtccctagaccgtattctcgtgcctccgaggtctggcacccgcgtacgtcctccccgtggccagttccgacgttcgggccccgttccggggcttagggacggtacgttacgggacggtcttcggtaaacttttaacgttaccgttcggtaccccgtaccggttaccccgtttagaaaccctaaacggttacgggttttttaggggtttcgggttttacggggtttggtttccggggaccggggtaacgggaacccgtaacggtacccgttaccggtaccccggttaaccgttaacggtaccgaacccggcccggtaaaccgggtcccgtaccccggtccccccgttaccgggtcccgtaccttcccgtttacccgttccccctaccccgtttcccgtcccggttcgttccgtacggtacctcggttcggaccgggtcgggtaccgtcgggaccgtacgggaccgtacgacgtacgngncgntacgncncnnnngnnnnnn

SEQ ID NO: 218065 - DNA, 797 bp, Homo sapiens
  misc_feature: GYAE6OF02HM6FN.5.9.A09.1.454.CMB.1.raw
  modified_base (778)..(778): a, c, t, g, unknown or other
  misc_feature (778)..(778): n is a, c, g, or t
  modified_base (786)..(786): a, c, t, g, unknown or other
  misc_feature (786)..(786): n is a, c, g, or t
  modified_base (791)..(791): a, c, t, g, unknown or other
  misc_feature (791)..(791): n is a, c, g, or t
  modified_base (793)..(793): a, c, t, g, unknown or other
  misc_feature (793)..(793): n is a, c, g, or t
  modified_base (795)..(795): a, c, t, g, unknown or other
  misc_feature (795)..(795): n is a, c, g, or t
  modified_base (797)..(797): a, c, t, g, unknown or other
  misc_feature (797)..(797): n is a, c, g, or t
tcagatcagacacgcacgaccggtgctcgatttagcgagacgcgcgagggtcctgggcccagtctgtggtgacgcagccgccctccgtttctggggccccagggcagacggtcaccatctcctgcactggaagcagctccgacatcgggtcaggttatgatgtacattggtaccagctaacttccaaggaaccacgcccccaaatccctcatcctaacgacaacaccaatccgccctcgaacgggtccctgacctattctctggctccaggtctggccaccgcacgcctcccgtggaccactctacgtgggcctccggggtctggaggacgtggacggtcctaggtacttacgttacctcggtacccgtacgggtcccttcggaaacctaacgttacgggttttggggtttgggttttcgggggttacgggtttacggggccggggtaacggggtaaccgtaaaacgggtccggtaacggtacccgtttaccgttaaacgggtaccggtaaccggtaccccggtaaacgggtacccggtcccggtacccccccggttccgggttacccgtacccgttacccggttttcccggtttacccccggtccccccgtttcccccgttacccgggttttcccggttaccgttaccggttaaccgtttacccggtacgggttaacccggggtcccggggttcccggttaaccggggtaccggtaaaccggggttcccggaccggttaaacggttaacggcggaccttaaggcggacctggtcccncgcgcgcncgctngntntn

SEQ ID NO: 218066 - DNA, 666 bp, Homo sapiens
  misc_feature: GYAE6OF02I50H7.5.9.A09.1.454.CMB.1.raw
  modified_base (158)..(158): a, c, t, g, unknown or other
  misc_feature (158)..(158): n is a, c, g, or t
  modified_base (572)..(572): a, c, t, g, unknown or other
  misc_feature (572)..(572): n is a, c, g, or t
  modified_base (644)..(644): a, c, t, g, unknown or other
  misc_feature (644)..(644): n is a, c, g, or t
  modified_base (651)..(651): a, c, t, g, unknown or other
  misc_feature (651)..(651): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (662)..(662): a, c, t, g, unknown or other
  misc_feature (662)..(662): n is a, c, g, or t
  modified_base (665)..(665): a, c, t, g, unknown or other
  misc_feature (665)..(665): n is a, c, g, or t
tcagatcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtctaggttangatgtaacagttcggacagcaacttcgaaggaacacgacccccaaactcctcattaccgaacgacaaccacctaacgtccggtccctacgacggggtcccctacggaccgtatttcctctggcctaccgagggtctacggccaccgtcgacgtccctcccgcggcctaatccgaccgtgggtcgtaccgggacttggaaggtcgagaccggtctagtacttattacgcgaccctacgggttcctagaacaagttcggttttggggttggtttggggtcgttacgggggacgtaacggggtaacccaagtctaaccgggtaccctaccggttaagtaccgacgaccgtaacggccgtaccgtccccgttaccgggtctaacttccgttacccttccctacctcccgtcggttacncttacgacgtcgtcggtacgcgggtccgtcgggaccgtacgggccgtaacacggttacgctacgagcgtacnctagcgncgcncncatcngcnc

SEQ ID NO: 218067 - DNA, 499 bp, Homo sapiens
  misc_feature: GYAE6OF01C5P74.19.28.C06.1.454.CMB.1.raw
  modified_base (370)..(370): a, c, t, g, unknown or other
  misc_feature (370)..(370): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacacgaagggggacggatccctgatcgttttcagggtccagctcgtggggctgagcgctaccgtnaccatctccagcctccagtctgaggatgaggctgactattactgtcagtacctggggctacgtggttatggttggtttcggcggagggaccaagctggaccgtctaggtcagcccaaggctcgtccccg

SEQ ID NO: 218068 - DNA, 538 bp, Homo sapiens
  misc_feature: GYAE6OF01DI935.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggcccctcggtacttgatgaaggttaacagtgatggcagccacaccgaagggggacggatccctgatcgtttttcagggtccagctcgtgggctgagcgctacctcaccatctccagcctcagtctgagatgaggctgactattacgtgtacgagtaccgtgggctacgtggttagttggttagggttttccgggacgggtagggaccgtaaggtccgtcggacccgttccgtagggtccaacggacccgaacgggccgtccggtcccccccg

SEQ ID NO: 218069 - DNA, 507 bp, Homo sapiens
  misc_feature: GYAE6OF01BCTO4.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaagggggacggatccctgacttcgttttcagggtccagctcgtggggctgagcgctacctcaccatcctccagccctccagtctggaggatgaggctgactattactgtcagtaccgtgggctacgtggtatggttggtttcgggcggtaggaccagcgtcgaccgtcgtaggtcacgcccaggcctcgtcccccg

SEQ ID NO: 218070 - DNA, 562 bp, Homo sapiens
  misc_feature: GYAE6OF01AV57X.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagtgccctcggtacttgatgaaggttacagtgatggcagccacgaccgaaggggacggatcccgtgacttcgttttcgagggtccagtctcgtgggctgagcgctacctcaccatcctccagccctccgagtcgtgaggtatggagctagtactagttactgtactacgtaccgtggggtactacgttggttaagttggttcgggttttccggggacgggtacgggtacccgtaaggtccgttacggacccggttccgtacgggtaccgaccggtccccgaagggtcccgtaccccggg

SEQ ID NO: 218071 - DNA, 588 bp, Homo sapiens
  misc_feature: GYAE6OF01C62ID.19.28.C06.1.454.CMB.1.raw
tcagtactctcgtgcacgaccggtgctcgatttagagctcacgtattgggtttggggagagctctgggggagtctgcaccatggcttggaccccactcctcttcctcaccctcctcctccactgcacagggtctctctcccagcttgtgctgactcaatcgccctctgcctctgcctcccgtgggagcctcggtcaagctcatctgcactctgagcagtgggcacagcaactacgccatcgcatggcatcagcagcagccagagaacgggccctcggtacttgatgaaggttacagtgagtggcagccacgaccggaagggggacggactcccgtagtacgttcggttttacgacgggtccaggcgtcggtgggggctggacgccgacctacctcaccactcctcccgacgcccttcccgtcgtggacggatcggaggtctagacttattacgtgtacgacggtaccggtgggactacgttggttagtgggttcgggtttcgggcgggtacgggaccgtaacggtccgtacggtacccgtccgtacggccgtaccggacccgaagggtccctccgtccccccggtcgg

SEQ ID NO: 218072 - DNA, 624 bp, Homo sapiens
  misc_feature: GYAE6OF01BD3DT.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcacgcagaggaacggccctggtacttgatagaaggttaacagtgatggcagaccaacgaccggaagggggacggatcccgtgtacgttcgttttcgacgggtcaggtcgtcgtggggctggacgcgtacctacctccaccgtacttccgtacccgacgtccctccgtacgtctaggaggtacgtaggaggtccttagtaaccttaacgttaccgttagtaccgaacgggtacccgtggggtaccttacggttgggtttaagttcgggtttggggttttccgggacggggtaacgggaaccgtaggtccggtacggtacccggttccgtaggttccgaccgtacccggtacggcccgtcccggtacccccgg

SEQ ID NO: 218073 - DNA, 625 bp, Homo sapiens
  misc_feature: GYAE6OF01DX6CB.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcagtgggcacagcaactacgccatcgcatggcatcagcagcagccagagaacggcctcggtactgatagaaggttaacagtgagtggcagccacgacgaagggggacggactccgtgtacgttcgttttcgacgggtcagtctcgtgggctggacgcgactaccgtacaccactcctacccacgccctcgtacgtccgtaggaggtatcgggacggtctagtaacttacgtttacgtcgtaccgacggtaccgttcggggactacggttaggtttaacggttgggttcgggttttaccggggacggggtaacgggtacccgtaaggtacccggttacgggtacccggttacccggtaccgggttaccgtaaccggtacccgtaaacgggtcccgtcccggtacccccccgg

SEQ ID NO: 218074 - DNA, 803 bp, Homo sapiens
  misc_feature: GYAE6OF01EYBU5.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgccacgaggtctctcctcccagcttgtgctgactcaactccgccctctcgcctctcgccctcccgtgggacgtccgtcggtacaacgtcctcactctcgacctacctcgtagacgcgtagggtcgggaccaacgacgacctaaaccgtaccgacctaagtccgacaagtcggactaactaccgacgaccgaacgaccgaacggacccgaaggaacggggaaccgggtcccccgttacgggttaacgttaggaacgttaacgggtaaaacggttaaacgtaggttagtaagtcgggaccgaaccggacccgaaaccggaaaccggggaaacggggggaaccggtaccgttcccgtaggttacgtttacggttttacggacgggtaccgacggtccgtcgggtcgggcgtaggaccgtccgtaccgtaccctacctacctacttccctacccgaccgtcccgtaccgtacgtcgtaggaggtacgtcggacgtcgtacgtaacttacgttacgtacggtaccgacggtaccggtcgggtaccttacggttaggtttacgttcgggtttaccgggtttaccggggacgggtaaccgggtaaccgtacggttccggtaccggttacccggttaccggtacggtaccgacccggtacccggtacggtcccgtccccggtcccccgg

SEQ ID NO: 218075 - DNA, 161 bp, Homo sapiens
  misc_feature: GYAE6OF01ARF24.19.28.C06.1.454.CMB.1.raw
  modified_base (159)..(161): a, c, t, g, unknown or other
  misc_feature (159)..(161): n is a, c, g, or t
tcagtactctcgtgcacgaccggtgctcgatttagagctcacgtattgggtttgggaggggaccaggctggagatcaaaggaactgtggctgcaccatctgtcttcatcttcccgccatctgacacgagagtactgagcgggctggcaaggcgcatagnnn

SEQ ID NO: 218076 - DNA, 534 bp, Homo sapiens
  misc_feature: GYAE6OF01B8HV8.19.28.C06.1.454.CMB.1.raw
  modified_base (406)..(406): a, c, t, g, unknown or other
  misc_feature (406)..(406): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtactgatagaaggttaacagtgatggcagccacgacgaagggggacggatcccgtgacttcgttttcgagggtccagtctcgtgggctgagcgctacctcaccatcctccagctccagtctggaggatggnggctagtactattctgtcagtccgtgggactacgttggttagtggttcgggtttcgggacgggtacgggtaccaggtcgtcggacccgttcgtacggtccacgacccgaggtcccgtccgtcccccgg

SEQ ID NO: 218077 - DNA, 597 bp, Homo sapiens
  misc_feature: GYAE6OF01CJE33.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactacgccatcgcatggcatcagcagcagccagagaacgggcctggtacttgatgaaggttaacagtgatggcagccacgacgaagggggacggatccgtgattcgttttcgacgggtcagtctcgtgggctggagcgctaccgtcaccgatctccgacgtcctaccagtctggaggatggaggtctaggaacttagtttacgtagtccgaacggtccgtaggggtactacggtttgggttaacgttgggtttacggggttttaccgggacgggtaaggggtaaccctaaagggtcccgttacgggtaacccgttccggttaacgggtccgaacggaccccggtaacgggtcccgtcccggtaccccccgg

SEQ ID NO: 218078 - DNA, 545 bp, Homo sapiens
  misc_feature: GYAE6OF01BDE1C.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatgaaggttaacagtgagtggacagccacgaccgaagggggacggatccctgattcgttttcgaggtcagtctcgtgggctgagcgctacctcaccatcctccacgcctccgagtctaggaggatggagctgacttattactgtacgagtaccgtgggctacgtggttatggttcgggtttcgggacgggtacgggaccgtaaggccgttcggacccggtccgtacggtccgacgaccccgaacggtccgtccggtccccccgg

SEQ ID NO: 218079 - DNA, 539 bp, Homo sapiens
  misc_feature: GYAE6OF01EP4UF.19.28.C06.1.454.CMB.1.raw
  modified_base (294)..(294): a, c, t, g, unknown or other
  misc_feature (294)..(294): n is a, c, g, or t
  modified_base (381)..(381): a, c, t, g, unknown or other
  misc_feature (381)..(381): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtgggcacagcaactacgccatcgcatggcatcagcagcagccagagaacgggccctggtacttgatgaaggttaacngtgatggcagccacgaccgaagggggacggatcccgtgattcgttttcgagggtccagtctcgtggggctggagcgctacctcaccntcctccacgcctcagtcgtgaggatggagctagactattacgtgtcagtaccgtgggctacgtggttagtggttcggtttcgggcgggtacgggtaccgaaggcgtaggacccgttcgtacggtcaacggtacccgaacggtccgtcccggtcccccg

SEQ ID NO: 218080 - DNA, 544 bp, Homo sapiens
  misc_feature: GYAE6OF01C4CY1.19.28.C06.1.454.CMB.1.raw
  modified_base (370)..(370): a, c, t, g, unknown or other
  misc_feature (370)..(370): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagcagagaagggccctcggtactgatgaaggttaacagtgatggcagccacacgaagggggcggatcccgtgacttcgttttcgagggtccagctcgtgggctggagcgctacccncaccatctccacgcctccagtctagaggatggagctagacttattactagtcagtccgtgggactacgttggttagttggttcgggtttcgggagggtacgggaccaaggtcgttacggaccccggttcgtacggtccgaacggccccgaaaggtcccgtaccggtccccccgg

SEQ ID NO: 218081 - DNA, 540 bp, Homo sapiens
  misc_feature: GYAE6OF01BN01M.19.28.C06.1.454.CMB.1.raw
  modified_base (408)..(408): a, c, t, g, unknown or other
  misc_feature (408)..(408): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagaggaacgggccctcggtacttgatgaaggttaacagtgatggcagccacgaccgaagggggacggactcccgtgtacgttcgtttttcgagggtccagcgtcgtggggctggagcgtctacctcaccatcctccacgcctaccagtcnggaggatggagctagactattacgtgtacgagtccgtgggctacgttggttagtggttgggtttcgggacgggtacgggaccaggtcgtcgacccgtcgtaggtccacggcccgaaggccctcggtcccccg

SEQ ID NO: 218082 - DNA, 1027 bp, Homo sapiens
  misc_feature: GYAE6OF01EE46M.19.28.C06.1.454.CMB.1.raw
  modified_base (179)..(179): a, c, t, g, unknown or other
  misc_feature (179)..(179): n is a, c, g, or t
tcagtactctcgtgcacgaccggtgctcgattttagagctcacgtattgggtttgggggagagcctctggggagtcctgcaccgatggcttgggacccctactccttcttcctccaccctcctcctccactggcacaggtctctctcccacgtctttgtgcttgactcaagtcgccctntgcctgtgcctccgtgggagcctcggtcaagctcatcgtggcactacgtcggagcgaggttgggcaactacgccaaaccttacggacctaattccgacaatacggactaacgtccaagtcagccacgccgaggacggaaccgggcccgttacgggttacgttacggggaaagttacggtaaaagggtttaaaccgagggttggaacgttacgggaccaacggtaccccgtaaaccggtaaccccgggtaaaggggggggtaacccggtaacgttccccggttaggtaaccgtttttacccgggttttttacggaaacggggttacccctaacgggttccccggtttacccgggttacggggggtaacccggtttaccgggtaaaccgggtccccggttaacccctttaaccccgtttaccccgtaaaccccgttaacgtttacccccgttaaccccgtaaaccgggtacccccctttaaccggtaaaccggttacccgttaaccgggaaaccgggttaaccgtttacggggaaccgggttacccgtttaacgggtaacccgtttaacggtttacccgtacgggttaacccggaacccgggttaacccgggttacggggggacccttaaccgggttttacggggtttttaacgttttaccggggtttttaccggggtttttcccggggggaaccggggttaaaccgggggtaaaccccgtaaaccggggttacccggttaaccccgggtaacccccgggtttacccggttaaacgggtttacccggttaaccccgggtaaccccgggttaacgggttcccccggttccccgggttaaccccccccgggg

SEQ ID NO: 218083 - DNA, 756 bp, Homo sapiens
  misc_feature: GYAE6OF01D5LOH.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggcctcggtacttgatgaaggttaacagtgatggcagccacgaaccgaaggggggaccggatcccgtgtacttcggtttttcgaacgggtccaggtcgtcggtgggggcttggaacggtccggtaccttaacccgtcccaacccgtacgtttccctaccccgtaacggtccccttacccgtaacgggttaccgttagggaacgggtaacgttgggaaccgggtcgtttaacgggtaacctttaacgtttaaaccggttcggttaacccgtaacgggtaaccccgggttcgggggggtacccttaaccgggtttaggggttttaacgttcggggttttacgggggtttttccggggaccgggggttaacggggaaaccccgtaaagggtcccggttacgggtaacccccggtttccggttaaaccgggttcccgtaaacccgggtaccccccggtaaacggggtccccgttccccgggtaccccccccggg

SEQ ID NO: 218084 - DNA, 540 bp, Homo sapiens
  misc_feature: GYAE6OF01EMFOM.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttggatgaaggttaacaggtgatggcagccacgaccgaaggggggacggatcccgtgtacttcgtttttcgagggttccagtcgtcgtggggctgacgcgctacctcaccatctccagccctcagtctgaggatggaggctgtactattacgtgtcgacgtaccgtgggcacgttggttagtggttggttttcgggcgggtagggaccgtaggcgtcgacccgtccgtacggtcgacggcccgaaggtccgtccggtcccccg

SEQ ID NO: 218085 - DNA, 740 bp, Homo sapiens
  misc_feature: GYAE6OF01C6RZL.19.28.C06.1.454.CMB.1.raw
  modified_base (187)..(187): a, c, t, g, unknown or other
  misc_feature (187)..(187): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctccagcttgtgctgactcaatcgccctctgcctctcgcctcccgtgggacncctcggtcaagctcatctgcactctgagcaggtgggaccacgagaccaaacgtccgccagtcgacagtcggacaatccgaagcgaagccaacgacccgaaggaacggaaacggggtcccccgttacgggttaacgttggaagttacggtaaacggtttaacgaggtaggaagtacgggacgacggacccgaaccggaaccgggtaacggggggaaccggtacctaccgttaggtacgtttacgtttttacggacgggtcctaggtccgttcgggtcggggcttacggacggtccgtacctaaccgtccaccgtactaccgtcccaacgtccctaccgagttccgtaggacggtagtacggaaggtctacgtaacgtttacgttacgtcgtaccgtacggtaccggtgggtaccttacggttagggtttagttcgggtttaacgggttccggggaacgggtaccgggtaaccgtagggttacgtacgggtaacccgttccggtaacgggtaccgtacccggacccggtaaccggtcgtccccggttacccccgg

SEQ ID NO: 218086 - DNA, 635 bp, Homo sapiens
  misc_feature: GYAE6OF01C4W4M.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgccctctcgccctcccgtgggagccctcggtcaagctcatctgcactctgagcagtggcacagcaactacgccatcgcatggcatcagcagcagccagagaacggccctagtacttgatagaaggttaacagtgagtggacagaccgaacgaacggaagggggacggactccgtagtacgttcgttttacgacgggtcagtcgtcgtgggctgacgcgcctactcgaccactcctccacgcctacgagttctacggaggagtggacggtctaggtaacttacgttaccgtaggttccgaacggtaccggttacggggacttaacggttgggtttaagtcgggttttcggggtttaccgggacgggtaacggggtaaccgtaaggtccggttaccgggtaccccggttaccggttacgggtaccgtaaccggaccccggttaacgggcccgtacccggttaccccccgg

SEQ ID NO: 218087 - DNA, 556 bp, Homo sapiens
  misc_feature: GYAE6OF01AX3EL.19.28.C06.1.454.CMB.1.raw
  modified_base (185)..(185): a, c, t, g, unknown or other
  misc_feature (185)..(185): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggancctcggtcaagctcatctgcactctgagcagtggcacagcaactacgccatcgcatggcatcagcagcagccagagaacggccctcggtacttgatgaagttaacagtgatggcagccacgaccgaagggggacggactcccgtgtacttcgttttcgaggtccagctcgtgggctgagcgctacctcacctatcctccgacgtccctccgagtctggaggatggacgctgaaccttagttacgtgtaccagtaccgtggggctacgttggttagtcggtttcgggtttaccgggacgggtacggaccctaggtcgtacggacccgttcgtacggtccacggacccgaacggtccgtcccggtacccccgg

SEQ ID NO: 218088 - DNA, 553 bp, Homo sapiens
  misc_feature: GYAE6OF01EVBHA.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatggaaggttaacagtgatggcagccacgaccgaagggggacggatccctgtacttcgttttcgagggtccagtctcgtgggctgacgcgctacctcaccatcctccacgcctcacgtctggaggatggagctagacttattactgtcgagtaccgtgggctacgtggttagtggttcgggtttcgggacgggtacgggaccgtaaggtcgtcggtacccgttccgtacgggtccgacggaccccgtaacgggtcccgtcccggtcccccgg

SEQ ID NO: 218089 - DNA, 159 bp, Homo sapiens
  misc_feature: GYAE6OF01EUVWH.19.28.C06.1.454.CMB.1.raw
  modified_base (159)..(159): a, c, t, g, unknown or other
  misc_feature (159)..(159): n is a, c, g, or t
tcagtactctcgtgcacgaccggtgctcgatttagagctcacgtattgggtttgggaggggaccaggctggagatcaaaggaactgtggctgcaccatctgtcttcatcttcccgccatctgacacgagagtactgagcgggctggcaaggcgcatagn

SEQ ID NO: 218090 - DNA, 572 bp, Homo sapiens
  misc_feature: GYAE6OF01CCIUE.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagaggaagggccctcggtacttgatgaaggttaacagtgatggcagccacgacgaagggggacggatcccgtgtacgttcgttttcgacgggtccagtcgtcggtggggctggacgtcgacctacctccacctatcctcccgacgtccctccgagtccgtgaggatggaggtctagtacttattactgtaccaggtccgtgggctacgtggttagtggttcgggtttcgggagggtacgggtaccaaggtccgtcggacccggttccgttagggtaccgacggtacccgaacggtccgtcccggtaccccccgg

SEQ ID NO: 218091 - DNA, 549 bp, Homo sapiens
  misc_feature: GYAE6OF01CMY5L.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtgggacgcctcggtcaagctcatctgcactctgagcagtggcacagcaactacgccatcgcatggcatcagcagcacgccagacgaacggcctcggtacttgatggaagttacgagtgagtgcagccgacgaacggaagggggacggactccgtgtacttcgttttcgaggtccagtcgtcgtcgggctggacgcgtcctacctcacctatcctcacgtcctcagtcgtaggagcgtggacggtctacgtacttagttacgtgtccgacgtacgtgggactacgttggttagtcggttcgggtttcggacggtacggacgtagtcgtacgccgtacgtacggtcacgacccgacggtccgtcgtccccg

SEQ ID NO: 218092 - DNA, 560 bp, Homo sapiens
  misc_feature: GYAE6OF01DJ32I.19.28.C06.1.454.CMB.1.raw
  modified_base (188)..(188): a, c, t, g, unknown or other
  misc_feature (188)..(188): n is a, c, g, or t
  modified_base (392)..(392): a, c, t, g, unknown or other
  misc_feature (392)..(392): n is a, c, g, or t
  modified_base (444)..(444): a, c, t, g, unknown or other
  misc_feature (444)..(444): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctcccgtgggacncctcggtcaagctcatctgcactctgagcaggtggcacagcaactacgcatcgcatggcatcagcagcagccagaggaacggcctggtactgatagaaggttaacagtgatggacacgaccaacgaacggaagggggacggactcccgtagtacgtttcgtttcgacgggtcaggtctacggtgggctggacgccgtcctaccncaccgatcctaccgacgtcctcgagtctggagatggagtctagactattcgngtcgagtaccgtgggactacggttggttagttggttcgggttcgggacgggtacggacctaggccgtcggtaccgtcgtacggtccgacggacccgaggtcccgtccgtcccccgg

SEQ ID NO: 218093 - DNA, 553 bp, Homo sapiens
  misc_feature: GYAE6OF01DQEHV.19.28.C06.1.454.CMB.1.raw
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
tcagtactctcgtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagaagtgggcacagcaactacgccatcgcatggcatcagcagcagccagagaacgggccctcggtacttgatggaaggttaacagtgatggcacgcacgacgaaggggacggactcctgattcgttttcgaggtccagctcgtgggctggacgcgctacctcaccatctccacncctcagtcgngagntgagctagtactattacgtgtacaggaccgtcgggactacgttggttagttggttgggttttcgggcgggtacgggaccgtaacggtcgtcggtaccggtccgttaggtcgaaccggacccgaacgggtccgtccggtcccccgttacccggg

SEQ ID NO: 218094 - DNA, 698 bp, Homo sapiens
  misc_feature: GYAE6OF01BWNS9.19.28.C06.1.454.CMB.1.raw
tcagtactctcgtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtggcacagcaactacgccatcgcatggcatcagcagcagccaggagaacgggccctcggtacttgatagaaggttaacagtgatggcacgaccacgaccggaaggggggacgggactcccgtagtacttcggtttttcgacgggtccaggtccgtacggtggggtctggacggccgtaccttaccctaccgaccctacgtccctacccgaacggtcccttaccgacggttccgttacggtaacgggtacgtcgggtacgggtccttacgtaaccgtttaacgtttaccgttacggttaccgacgggtaacccggtcgggggtacctaccggtttagggtttaaggtttcgggtttcggggtttttaccgggaccggggtaacggggtaacccgtaagggtccgtaccgggttaacccgggttaccgttacgggtaccgacccggtaccccggaacggtcccgtccccggtacccccccgg

SEQ ID NO: 218095 - DNA, 703 bp, Homo sapiens
  misc_feature: GYAE6OF01ACP47.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgccctcccgtggggacgcctcgggtcaaagcctcatctgcactctgagcaggtggcacagcaactacgccatccgcagtggcatcagcagcacgccgaaggacggaacgggcccttcggtaactgaataggaacggttaacaggtgagtacggacacgaccgaacgaaccgggaaaggggggacggtactccgtaggtacgtttacggttttacggacgggttccacggtcgtcgggtcggggtactcggacggtccgtaccctaccgtaccaacctacgtccgtacccgacgtccctacgtacgttcgtacggaggtacgtggacgtctacgtaacttaacgttcgtacgtaccgtacggtaccggttcggggtacttacggttagggttaacgttcggggttacgggtttaccgggacgggtaacgggtaaccgtaacggttaccggtccggttaacccggttacggttaaccgggtacccgaaccgggtaaccccgtaacgggtccccgttccccggtacccccggg

SEQ ID NO: 218096 - DNA, 579 bp, Homo sapiens
  misc_feature: GYAE6OF01CKI10.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatgaaggttaacagtgatggcagccacgacgaagggggacggatcccgtgacgttcgtttttcgagggtccagtcgtcgtggggctggacgccgcctaccgtccaccactcctcccacgtccctaccgtacgtctaggaggtagtggacggctgtaaccttagttacgtgtacgacgtaccgtggggctacgttggttagttggttcgggtttaccgggacgggtacgggtaccgtaaggtccgtcggtacccgtacgtacgggtcacggacccgaacgggccgtccggtccccccgg

SEQ ID NO: 218097 - DNA, 553 bp, Homo sapiens
  misc_feature: GYAE6OF01D6YZJ.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagaggaacgggcctcggtacttgagtgaaggtaacaggtgatggcagaccaacgaccgaagggggacggactccgtgtacttcgttttcgacggtccagtctcgtggggctggacgcgctacctacacactctccacgcctcacgtctgagagtgaggctagtactattacgtgtcgacgtaccggtgggctacgttggttagtggttcggtttcgggacgggtacgggtacgtaggtccgttcggacccgtccgtacggtaccgacgacccgaacggtccgtccggtcccccgg

SEQ ID NO: 218098 - DNA, 614 bp, Homo sapiens
  misc_feature: GYAE6OF01B3P9G.19.28.C06.1.454.CMB.1.raw
  modified_base (379)..(379): a, c, t, g, unknown or other
  misc_feature (379)..(379): n is a, c, g, or t
  modified_base (470)..(470): a, c, t, g, unknown or other
  misc_feature (470)..(470): n is a, c, g, or t
tcagtactctcgtgcacgaccggtgctcgatttagagctcacgtattggggtttgggggagagctctgggggagtctgcaccatggcttggaccccactcctcttcctcaccctcctcctccactgcacagggtctctcctcccagcttgtgctgactcaatccgccctctgcctctcgccctcccgtgggacgccctcggtcaagcctcatctgcactctgagcaggtgggcaacagcaaactaccgccatccgacagtggcatcagcagcagccgaagaggaacggccctggtactagagtagaaggttaacagtgagtggacacgaccaccgaacggaagggggacggactccgtgtattcgtttacgagggtccngctcggtgggctggacgcgcctacctcaccgtatccacctacgccctacgtacgtcgtagaggagtggacggcgtacgtaacttagttacncggtacacggtaccggtgggtacctacggttaggttgttcgggttacgggtttcgggaacggggtaccggaacggtaaggccgttacggtacccggttacggtacgacccgacgacccggtaacggcccgtccgtaccccccgg

SEQ ID NO: 218099 - DNA, 603 bp, Homo sapiens
  misc_feature: GYAE6OF01D7BO6.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccaggaaggaacgggcccctcgggtacttggataggaaggttaacagtgaatggcagaccaacgaaccggaaggggggacggactcccgtgtagttcgttttcgacgggtccagtcgtcggtggggctaggacgccgtcctacctccaccactcctcccacgccctccgacgtcgtaggagtagtacggaggtctagtaaccttagttacgtaggtacgacggtaccggtggggactacggttggttagttgggttcgggtttacgggacgggtaacgggtaccgtaggtcgtcggacccgttccggtaggtccgacggacccgtaacgggccgtcccggtcccccg

SEQ ID NO: 218100 - DNA, 648 bp, Homo sapiens
  misc_feature: GYAE6OF01C5WAK.19.28.C06.1.454.CMB.1.raw
  modified_base (452)..(452): a, c, t, g, unknown or other
  misc_feature (452)..(452): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctccagcttgtgctgactcaactccgccctctcgcctctcgccctcccgtgggacgcctcggtcaagctcatctgcactcgtgacgcgagtggaccacagacaactacgcatcgacagtggcatacgagcagcaacgaccgaaggacggaaccgggtccctacggtaacttaggaagtaaggtaaacggttaacgaggtagagtacggacgaacgaccaacgaaccgggaagggggaccgactcccgtagtacgtttcgtttacgacggtcgagtcgtcggtgggtctaggacgtccgtactaccacgacctctccncgaacgtccacgtgtcgtaggagacgtggacgtctagtaacttacgtacgtagtaccggaacgtccgggtagggacttaccgggttggttacgttggggtttacggttccgggacgggacggtaaccgtacggtcgtaccggtaccgttccggtaaggcccgaacggaccggaaccgtccgtccccggtaccccgg

SEQ ID NO: 218101 - DNA, 674 bp, Homo sapiens
  misc_feature: GYAE6OF01EAEVQ.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctcctcccagcttgtgctgactcaatcgccctctgcctctgcctccctgggacgcctcggtcaagctcatctgcactctgagcagtgggcacagcaactacgccatcgcagtcggcactcacgcagcgacgaccgaaggacggaacgggccccgttacggttaccttaggagtaacggtaaaggttaacgaggtagagtcggacacgaccgaacgaaccggaaacggggggaccggacgtcccgtaggtactttcggtttttcgacgggtccacgtcgtcgtcggggtctggacgccgtacctacctaccaccgtacgtcctacccgacgtcccctacgtacgtcgtaggaggtacgtcggacggtcgtagtaaccttaacgttcgtacgtacgacgtaccggtacggggtacttacggttaggtttacgtcggggtttcgggttccgggaaccgggtacgggaccgtaaggcggttaccggtacccggttaccggtacgggtccgaaccggacccgtacggtccgtcccggtacccccgg

SEQ ID NO: 218102 - DNA, 679 bp, Homo sapiens
  misc_feature: GYAE6OF01CA9SJ.19.28.C06.1.454.CMB.1.raw
  modified_base (188)..(188): a, c, t, g, unknown or other
  misc_feature (188)..(188): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctcccgtgggacncctcggtcaagctcatctgcactctgagcaggtggcacgagacaactacgccatcgcagtcggcatcagcagcacgcagaggaacgggcctacggtacttaggagtaggaaaggttaacaggtgagtggcacgaccgaacgacggaacgggggacgtactcccgtagtacgtttcggttttacgacgggtccaggtccgtcggtggggctacggacgtccgtacctaccgtacaaccgacttcccgacccgacgtccctaccgtaggttcctagggtaacggtacgtcgggacggtctaacggtaaccttacgttaacgtcggtaccgtaacgggtccggtacgggtcttacgggttaggtttacggttcggggtttacgggtttccgggaacggggtacggaaccgtaaggtccggttaccggacccggttccgtaagggtaccccgaacggtaccccggtaacggtcccgtacccggttaccccccggg

SEQ ID NO: 218103 - DNA, 797 bp, Homo sapiens
  misc_feature: GYAE6OF01DGFYX.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctcgcctctcgccctccgtgggacgtcctcggtacaacgctcatctgcctactcgtgacgcgaggtcgggacacgacgaccaacgtaccgccagtcgactagtggacacgtcgacgacgacgacgacggaccgaaggaacgggaaccgggtaccccgttacgggttacgttaggtaagttaggtaaaacgggttaacgtaggttagacggtacggacgaaccgaaccccggaaaccggaaaccggggaaacgggggtaccggtaacgttcccgttacggttacgttttaccggttttaacggacgggttaccgtacggtcggttcgggtacggggtagtacggtacgaccgtacccgtaccctaccgacctaccgttcccgtacccgtaccgtcccgtaccggtacgtacgtaacggaggtacgtacggacgtaccgttagttaacgtttaacgtaccgttacggtaccggacggttaccgggtacgggttacctttacgggttagggtttacggttcgggttaacgggttccggggaacgggtaccggtacggtaccggttccggtccggttacccgtcggtacgtaccgtacccggtaccggtacccggtcccgtccccggtacccccgg

SEQ ID NO: 218104 - DNA, 757 bp, Homo sapiens
  misc_feature: GYAE6OF01BAET2.19.28.C06.1.454.CMB.1.raw
tcagtactctcgtgcacgaccggtgctcgatttagagctcacgtattgggtttgggggagagctctgggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtgggcacgagacaactacgccatcgcatggcatcagcagcagccagagaacggtccctcggtacttgataggtaagttaacaggtgagtggacacgccgaacgaaccggaagggggacggactcccgtagtacgttcggttttacgacgggtaccaggtccgtcgggtacggggtctacgggtaccggtccggtacccttacccgtacccgtacccctaacgttccccgttaccccgaaccgttccccgtacccgtaacggttacccggtacgggaacgggttaacggtcgggtaaccggtccgtttaacgtaaccgtttaacgtttaccggttcggttaaaccgtaccgggtaacccggggttacgggttaccctaacgggttttgggtttaacggttcgggggttttacggggttttaccgggaccgggggtaaccggtaacccggtaagggtcccggttaccggtacccggttaccggttacgggtacccgtacccggaaccccgtaccgggtccccgtaccccggtccccccgg

SEQ ID NO: 218105 - DNA, 577 bp, Homo sapiens
  misc_feature: GYAE6OF01A6AAD.19.28.C06.1.454.CMB.1.raw
  modified_base (293)..(293): a, c, t, g, unknown or other
  misc_feature (293)..(293): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtgggagcctcggtcaagctcatctgcactctgagcagtgggcacagcaactacgccatcgcatggcatcagcagcagccagagaaggccctcggtacttgatgaaggttaacnggtgatggcagccacgaccggaaggggggacggactcccgtgtacttcgttttcgagggtccagtcgtcggtggggctggacgcgctaccgtcaccatcctccacgcctcgacgtctggaggtatggaggtctagtacttagttctgtacgaggtccgtgggactacggttggttagttcgggttcgggtttcgggacgggtacgggtaaccgtaaggtcgtacggtacccgttccggtaacggtccgaacggtcccgaacgggtccgtaccccggtcccccgg

SEQ ID NO: 218106 - DNA, 570 bp, Homo sapiens
  misc_feature: GYAE6OF01ACWDE.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactacgccatcgcatggcatcagcagcagccagagaacgggccctcggtactgatagaaggttaacagtgatggcagccacgacggagggggacggactccgtgacttcgttttcgagggtccagctcgtgggctggacgccgtcctacctcacctactcctccagcctacgtccgagtcgtggaggtagtggaggtctagtaacttagttactcgtactacggtacccggtggggtacctacgttaggttagttcgggtttacgggtttcgggacgggtacgggacctaggccgtacggtacccggttcgtacggtacgaccggaccgacggtcctccccggg

SEQ ID NO: 218107 - DNA, 616 bp, Homo sapiens
  misc_feature: GYAE6OF01C6RZW.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgccctctcgccctcccgtgggacgcctcggtcaagctcatctgcactctgagtcgaggtcggacacagacaactacgcatcgcagtggcatcagcagcagccagacggacggccctcggtacttgataggaacgttacagtgatggcacgaccgaaccgaaccgggaagggggaccggtactccgtagtacgtttcgttttacgacgggtccagtctcggtggctaggacgccgctacccgtcacctactcccgtaccacgtcccgtcctagtccgtaggagtcgtcggacgtctagtacttacttaccgtgtaccgacgttaccggtgggtaccttacgttgggttaacgttcgggttcgggttccgggacgggacggtaaccgtaggccgttacggtacccgtcgttaacggccgacgtacccgtacggcccgtcccgtacccccgg

SEQ ID NO: 218108 - DNA, 649 bp, Homo sapiens
  misc_feature: GYAE6OF01CWJ59.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacaggtctctctcccagcttgtgctgactcaatccgccctctcgcctctcgcccttcccgtgggactccctcggtacaagtcctcatctgccactcgtgagctaggtcgggacacgagaccaacgtaccgcctagtcgcagtggacatcagcagcacgacgaggaacggaaccgggcccgttacggtacttgaagtaggtaaacggttaacgagtagagtacggacacgaccaacgaacggaaggacggacggactccgtagtacgtttacgtttcgacggttcagtcgtcggtggtctggacgccgtacctaccctacacctctaccctaccgtacgtccctacgtacgtcgtacgagtacgtacggtacgtattacgtactttagttacacgtacgtacgtaccggtagggtaccttaggttacggtttggttgggttccgggttacgggacgggtacggaacgtacggtccgtacggtacccgttacgtacgaccgaccgacccgtaggtccccgtacccgg

SEQ ID NO: 218109 - DNA, 658 bp, Homo sapiens
  misc_feature: GYAE6OF01AIR7Q.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtggcacagccaactacgccatcgcagtggcatcagcagcagccagagaacgggccctggtacttgataggaaggttaacagtgagtggacacgaccaacgaaccggaagggggacggactccgtagtacgtttcgttttacgacgggtcctaggccgttcggtacggggctcggacggtccgtccgtaacccgttacacccgtaactccctacccgacgtccctaccggtaacgtaccgtaggaaggactgggtaacggcttagtaacttaactttagtacgtacgaacgtaccggttcgggacttaccggttaggttaacgttgggtttacggggtttaccgggcgggtaaaccggggtaccgaagtccggtacggtaccccggtttacgacgggttaccgaaccggtacccggacggtcccgtcccggttaccccccgg

SEQ ID NO: 218110 - DNA, 878 bp, Homo sapiens
  misc_feature: GYAE6OF01C47RK.19.28.C06.1.454.CMB.1.raw
  modified_base (186)..(186): a, c, t, g, unknown or other
  misc_feature (186)..(186): n is a, c, g, or t
  modified_base (214)..(214): a, c, t, g, unknown or other
  misc_feature (214)..(214): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacncctcggtcaagctcatctgcactctgancaggtggacacgtagcaaacgtccggcctatcgacagtcggacatcagcagcagccaggtagaacgggcccctaggtactgatggaacggttacaggtacgtagtggacacgaccgaacgaccggaaaggggggaccgtactacccgtggtaactttccggtttttacgaacgggtccgtacggtccgttcggtcggggtcttaggacggtacccggtacccttaaccccgtaccggtaaccctaacgttccccgtaccgttaaccggtcccctttaaccgtaaacgggttcccgtttaacggggaacgggtaacgttaccgggtaacggttacccgttaacgggttaaacccttttaacggtttaacccggttacgggttaaaccccggtaccgggttacccggggttaccggggggttaacctttaaaccccgggttttggggttttaaaccggtttccgggggtttttacggggttttaaccccggggacccgggggtaaaaccgggggttaacccccgtaaaacgggttcccggttacccgggggttaaacccccggttttacccggggttaaacgggtaaacccccggttaaccccgggtaaccccgggtaaacccgggggttaaccccgtttccccccgggggttaaccccccccggg

SEQ ID NO: 218111 - DNA, 656 bp, Homo sapiens
  misc_feature: GYAE6OF01B6RIY.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctcccgtgggagcctcggtcaagctcatctgcactctgagcaggtgggcacagcaactacgccatcgcatggcatcagcagcagccagagaacgggccctggtacttgatgaagtaacagtgagtggcagccgaacgaccggaagggggacggactcccgtgattcggttttcgaacgggttccagtcgtcgtgggctggacgcgacctaccgtcacctacgtctccagccctaccgagtcgtacggaggtataggaacggtcgttaggtaaccttaagtttaaccgtagttacccgaacgggtacccggtagggggtacttaacccggtttagggtttaacggttgggttttacggggttttccgggggaccggggtaaccggggtacctaacggcccggttcgggaccccgttacccggtaggggttacccgtaaccggaccccggtaaacgggtcccgttaccccgggtaccccccgg

SEQ ID NO: 218112 - DNA, 634 bp, Homo sapiens
  misc_feature: GYAE6OF01EIBEA.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagaggaacgggccctcggtacttgatggaaggttaacagtgatggcagccaacgaccggaaggggggacggactcccgtagtacgttcggtttttcgacgggtccagtcgtcgtcggggctggacggccgtacctaccctccgaacctacttcctcccgacgtccctaccgtacgttcgtaggtacggtagtcggacggtctagtaacctttagtttacgtcgtaccgacggtaccggtcggggtaccttacggttggtttacgttgggtttacggggttttccgggacgggtacgggtaaccgtaaggtccgtacggtacccgttcggtaacggtccgtaaccggacccgaacgggtccgtcccggtccccccgg

SEQ ID NO: 218113 - DNA, 676 bp, Homo sapiens
  misc_feature: GYAE6OF01BF2CC.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactacgccatcgcatggcatcagcagcacgccagagacggcctggtactgatgaaggtaacagtgagtggcacgaccacgaaccggagggggacggactcccgtagtacgttcgttttcgacgggtccagtcgtcggtgggtctggacgtccgtcctaccgtaccacctactccgtcccgaccgtcccgtaccgtaggtccgtaggacggtacgtcgggaacggtcgttacgtaaccgtttacgttaccgtacggtacccgtacgggtaacccgggttcggggtaccttacgggtttaggggtttaagtttcggggtttcggggtttaccgggacggggttaaccgggtaacccggtaacgggttccggttaccggtaccccggttcgttaaccgggtacccgaacccggtacccggtaacgggtccccgtacccgggtacccccccggg

SEQ ID NO: 218114 - DNA, 821 bp, Homo sapiens
  misc_feature: GYAE6OF01BRVRW.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgccttctcgccctcccgtgggactcctcggtacaagcctacatcctgcacttctaggacgcgaggtcgggaccaacgacgaccaaaccgtaccgccaacgtccggactaacgtcggactaactccgaacgccgaacggccgaacgacccgaaggaacgggtaaaccggggtccccgtttaccgggttaacctttaggaacgttaagggtaaaacgggtttaacgtacggtaggtagtacggacgaacgtacccgaacggaaccgggaacgggggacggtacttaccgtaggtacgttcggttttacgacggtcgagtcgtcgtacggcgtacgacgcgtacctacctacgacctactccgtcccgaacgtcctaccgtaagttccgtaagggacggtacttacgggtcgtaccgtttagtaccttaagtttccgtacggttacggaaccccgggttaccggttaggggtaccctttagggtttaacgggttcggttttacggggtttaccggggtttaccgggaaccgggggtaaccgggtaaaccgttaggggtacccggtttaaccgggtaccccggtttaacccgggacggttacccgggaacccggtaccccgttaaaggggtcccccgtcccccgggtttacccccggg

SEQ ID NO: 218115 - DNA, 766 bp, Homo sapiens
  misc_feature: GYAE6OF01AGP4J.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctcgcctctcgccctcccgtgggacgccgtcggtcaagcctcatctgcactctgacgcgaggtcgggcacgacgaccaacgtaccgcctagtcgacagtcggactactcgacgcacgcgacgaccgaaggaacggaccgggtccccgttacggttactagaacgtaggtaacggtaacgaggtcgagtacggacgacgaccgaaccggaaccgggaacgggggaccggtacttacccggtagttaccggttttaccggttttccggacgggtccgtacggtccgtcgggtacggggtcgtacggacggtcccgtaccttaccgtaccgtaccgtacgttcccgtaccgaccgtacccgtacgtacgttcggtaacggcggtaacgtcgggtacgtccgtaagtaaccgtttacgtaccgtacgtaccggtaccgggtaccgggtagggttacccgttacgggtttacggtttacgttccggggttacggtttacccggggaacgggtaaccgggtaccgtaaccggtcggttaccccgggaccgtttaacccgcgggtacccgtaccggtaccgtaccggtcccgttccccgggtaccccg

SEQ ID NO: 218116 - DNA, 726 bp, Homo sapiens
  misc_feature: GYAE6OF01BKHQB.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctcgcctctcgccctccgtgggacgccgtcggtacaacgctcatctgcactctgagcgaggtcggacacgacgaccaacgtacgccagtcgacagtcggacactcgagcgacgcacgaccgaaggaacggacggtcccgtacggtacgttgaacgtaggtaaaggttaacgaggtagagtcggacacgaccgaacgaaccgggaacgggggacgtacgtccgtaggttacgtttacggtttacggacggttaccgcgtaccgttacggtcgggtacgtacggacggtccgtaccgttaccctaccgtaacccgtacttcccgtaccgtaccgtcccgtaccgtaggtaccgtagggtaccggtagttcgggacgtctttaacgttacgttaacgttccgtcggtaaccgcgggttacgggtcggacgttacggtttgttacggtttcgggttacgggtttaccgggacgggtaacgtaccgtaggtaccgttccgggaacccggtttacggacggttacccgacggttaacccgacggttccccgtccccgttacccccggg

SEQ ID NO: 218117 - DNA, 624 bp, Homo sapiens
  misc_feature: GYAE6OF01EYDMV.19.28.C06.1.454.CMB.1.raw
tcagtactctcgtgcacgaccggtgctcgatttagagctcacgtattggggtttggggagagctctggggagtctgcaccatggcttggaccccactcctcttcctcaccctcctcctccactgcacagggtctctctcccagcttgtgctgactcaatcgccctctgcctctgccctccctgggacgcctcggtcaagctcatctgcactctgagcgagtgggcacagcaactacgccatcgcatggcatcagcagcagaccgaggaacggaacggggccccgtcggttacttggagtaggtaaaggttaacagtgagtgggcacgccaacgaaccggaagggggacggactccgtagtacgttcgttttcgacgggtcagtcgtcgtgggctggacgccgtcctaccctaccacctactccctaccgaccgcccgtccgacgtcgtaggaggtagtcggacggtcttagaacttattacgtacgtcgacggtaccggtgggactacggttggttagttgggtttcgggttttcgggacgggtaacgggtaccgtaacggcggtacggacccgttcggtacggtaccgtaccggacccggtacggtccgtcccggtcccccgg

SEQ ID NO: 218118 - DNA, 698 bp, Homo sapiens
  misc_feature: GYAE6OF01C659E.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctcccgtgggacgcctcggtcaagctcatctgcactctgagcaggtgggcacagacaactacgccatcgcagtggcatcagcagcagccaggacgaacgggcccgtcggtacttgagtaggaaagttaacgagtgagtggacacgaccaacgaaccggaacgggggacggtacgtcccgtaggtacgtttcggtttttacggacgggtccgtacggtcgttcggtcggggtctagggacggtccgtaccttaccctccgaacccgtactcccgtacccacggtcccctaccgtacggttcgtagggtaacggtacgtcgggaacggtcttacggtaactttaacgtttacgtacggttacgacggtaccgggttacggggtcttacggttgggtttacggttgggttttcgggtttaccggggacgggtacgggtaacccgtaggtccggttacgggaacccgttcggtaacgggtacccgaaccggtaccccggtaacggtcccgtccccggtaccccccgg

SEQ ID NO: 218119 - DNA, 841 bp, Homo sapiens
  misc_feature: GYAE6OF01EJRS3.19.28.C06.1.454.CMB.1.raw
  modified_base (188)..(188): a, c, t, g, unknown or other
  misc_feature (188)..(188): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctcccgtgggacnccgtcggtcaagctcatctgctactctgacgctaggtcgggacacacgaccaaccgtaccgacctagtccggacctaagtcggaccactacgacgacgaacggaccaacggaccgaaacgggaacggggtaaaccgggggtcccccgtttaacggggttaaccgtttaaggaacggttaaggtaaaacgggtttaacgagggttagtacggtacgggaccaaccggaccccgaaaccggaacccggggaaacgggggggtaccggacgttacccggtaggttaccgttttaccggtttttaccggaacggggttcccgaacgggtcccgggtaccgggttcgggggtaccgttacgggaccgggtacccgttacccgttaaccccgtaccctaaaccccgttaccgttacccctaccccgaacgtccccgtaccgttaacggtccgtaaggacggtacgtgggtaaccgttacgttacgtaaaccgtttacgttacgttaccggtcgaaccggttacgggttccgggtacttacgggtttgttacggttcgggtttacggggtttaccgggagggtaacggtacggtaagtcggtccggtaccggttaccgtacggtcctaacggcccgtaaccggtccgcccggttccccgg

SEQ ID NO: 218120 - DNA, 856 bp, Homo sapiens
  misc_feature: GYAE6OF01AW9DB.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctgccctcccgtggggacgcctcggtcaagctcatctgcactctgagcaggtgggcacagacaactacgccatccgcagtggcatcagcagcagaccgaggaacggaacgggccccgtacggtacttaggaagtacggtaaaggtttaacaggtaggagtacggacacggacccgaaccggaaccgggaaacgggggggaccggtacgtaccccgttagggttaaccgtttaccgggttttttacggacggggttaccgtaacggtcccgttcgggtcggggggtcctacgggaccggtcccggtacccgttacccgtacctaacccgtacgtccccgtacccgtaccgtaccccgttaccgtacggttccgtacgggaacggttaacggtaggggacccggtacgttacgttaaaccgtttacgttttaaccggtcggtacctaacccggggtacccggggttacggggtaaccgttaaccgggttttaggggtttaacggtttcggggttttaccgggggttttaccggggaaccgggggttaaaccggggtaacccggttaaacggggtccccggttaacggggttaacccccggttacgggtttaaacccgggtacccggaacccgggaaccccccggttaaacggggtcccccgttccccccggggttaacccccccggg

SEQ ID NO: 218121 - DNA, 658 bp, Homo sapiens
  misc_feature: GYAE6OF01BGM2M.19.28.C06.1.454.CMB.1.raw
  modified_base (306)..(306): a, c, t, g, unknown or other
  misc_feature (306)..(306): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctgccctcccgtgggacgccgtcggtcaagcctcatctgccactctgacgcagtggacacagcaactacgccagtcgcagtggcatcagcagcagccagacgacgggccctacggtactgataggaaggttaacngtagagtgcacgaccgacgaccggaagggggacgtactccgtgtacgttcgtttacgacggtccaggtccgtacggtcgggtctggacgccgtaccctacccgttaccgacctactcctacccgacgtccctaccgtaacgtccgtaagggacggtaagtcgggaggtaccgttacgtaacgttacgttaccgttacggtaccgacggtaccggttacgggtaccttacggttaggtttacgttggggtttccggtttacgggacgggtaaccgggacctacggtccggtaccggtaccgtccgtaacggtaccgaccggacccggtacggtcccgtcccggtaccccccgg

SEQ ID NO: 218122 - DNA, 553 bp, Homo sapiens
  misc_feature: GYAE6OF01BTHYP.19.28.C06.1.454.CMB.1.raw
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
tcagtactctcgtgcacgaccggtgctcgatttagagctcacgtattgggtttggggagagctctgggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtgggcacagcaactacgccatcgcatggcatcagcagcagccagagaacgggccctcggtacttgataggaaggttaacagtgatggcagccaacaccggaagggggacggatcccgtgtacgttcgttttcgacgggttccagtcgtcgtggggtctgacgcgtctacctcaccatctccagccctccagtcngaggatggngctgattacttacgtgtcagaccgtgggctagtggtttagtggttcgggtttcgggacgggtagggtacccgaaggtcgtcggtaccgtcccgtagggtccacggaccccgaagggtcctcccggtcccccg

SEQ ID NO: 218123 - DNA, 713 bp, Homo sapiens
  misc_feature: GYAE6OF01CY5YB.19.28.C06.1.454.CMB.1.raw
tcagtactctcgtgcacgaccggtgctcgatttagagctcacgtattgggtttggggagagctctgggggagtctgcaccatggcttggaccccactcctcttcctcaccctcctcctccactgcacagggtctctctcccagcttgtgctgactcaatcgccctctgcctctcgcctcccgtgggacgtccgtcggtacaagtctcactctgcactcgtgagcgaggtcgggacacagacaactacgcatcgacagtcggacatacagcacgcacgccgaaggacggaacggtcccgttacggtactgtagtacggtaaaggttaacgaggtagacgtcggacgacgaccgaacgaacggaacgggggacggtacgtcccgtaggtacgtttcggttttaccggagggtacccgaggtccgttacgggtcggggtacttacgggacggtccgtaccgtaccctaccgaaccctactcccgtacccggacctacctacccgtagttcgtaggaagtcggtgaacggtcttagtaacctttacgttacgtacgtaccgacgggtaccgtgggtacttacggttgggttacgtttacgggtttcgggtttaccgggaccgggtaacgggtacccgaaggttccgttaaccggtcccgttaacggttacggtaccgaccgggtacccgtaacggtcccgtccccgggtacccccgg

SEQ ID NO: 218124 - DNA, 160 bp, Homo sapiens
  misc_feature: GYAE6OF01CGJQD.19.28.C06.1.454.CMB.1.raw
  modified_base (159)..(160): a, c, t, g, unknown or other
  misc_feature (159)..(160): n is a, c, g, or t
tcagtactctcgtgcacgaccggtgctcgatttagagctcacgtattgggtttgggaggggaccaggctggagatcaaaggaactgtggctgcaccatctgtcttcatcttcccgccatctgacacgagagtactgagcgggctggcaaggcgcatagnn

SEQ ID NO: 218125 - DNA, 546 bp, Homo sapiens
  misc_feature: GYAE6OF01B9ZTA.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaagggggacggatcccgtgactcgtttttcgagggtccagctcgtgggctgagcgctacctcaccatcctccacgccctccagtctgaggatgaggctgactattactgtacgacgtaccgtggggactacgtgttagtggttcgggttttcggcggtacgggaccgtaaggtccgtcggacccgttccgtacgggtccacggaccccgtaaacgggtccctccggtaccccccg

SEQ ID NO: 218126 - DNA, 673 bp, Homo sapiens
  misc_feature: GYAE6OF01AL3V5.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcacgccaggagaacgggccctacggtacttgatagtaacggttaacagtgagtggacacgccgaacgaaccggaaggggggacggtacgtcccgtgtacgttcggttttcgacgggtccgagtcgtcgtggggctggacgccgactccgtcaccgtatcctcccgacgtccccgtaccgtacggtctacggaggtacgtcggacggtcttacgaactttacgtttaacgtcgtaccggaacgtaccggtcggggaccttacggtttaggttaacggttgggtttccggggttttacgggaccggggtaacggggtaacccgttaacgggtccgttacccgggttaccccggttacggttaccgggtaccggtaacccggaccccggtaacgggtccccggttaccccggttccccccggg

SEQ ID NO: 218127 - DNA, 902 bp, Homo sapiens
  misc_feature: GYAE6OF01E46HX.19.28.C06.1.454.CMB.1.raw
  modified_base (577)..(577): a, c, t, g, unknown or other
  misc_feature (577)..(577): n is a, c, g, or t
  modified_base (605)..(605): a, c, t, g, unknown or other
  misc_feature (605)..(605): n is a, c, g, or t
tcagtactctcgtgcacgaccggtgctcgatttagagctcacgtattgggttggggagagctctaggggagtcctggcaccatggcttggaccccactcctcttcctaccaccctcctcctcctacctgtcacgtagggtcctctcctacccagtccttggtcgctacgacctacgtaacgtcccgccctcgtcggtcccttccgtcgtcccgtcccggtagggacgtcccggttacggtacgaacggtccttacgtacgtccgtacgaccgtaccttcgacgacgtacgtagggtcgggaccaacgtacggtaaccctaaccggtaccaccgtacgttccggacttacggttaggtacctacgtaccgacggaccgaccggtacgaccgacggaggtaacggaccgggtccgtacggtacgtagtaacgtagtaaccggttaatacggttagtacggtacgacgtacgaaccgaacggtaacgggacgggaaccgtacgtacgtacggtacgtttacggtttacgacggttacacggttcgtacgggtaccggtgtaccggtacgcccgttaaccncccgtaactaccgttactacccggttanaacccggttcctacggtacgtcgggaggtacggtacggtacgtacgtaacgtaaccgttaccgtaacgttcgtacggtaacccgttacgggtacccggtttagggaccctttaagggtttaccgggttaacgggtttccggggtttacggttaaccccggggaaaccgggttaacggttacccgttaaccggttccggggtttaaccctttaaccccgggggcttaaccccgggaaacccgttcccgggaaaaccccgttccggtttaccccggggtcccccctttaaccccggggg

SEQ ID NO: 218128 - DNA, 629 bp, Homo sapiens
  misc_feature: GYAE6OF01BHHR4.19.28.C06.1.454.CMB.1.raw
  modified_base (305)..(305): a, c, t, g, unknown or other
  misc_feature (305)..(305): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctcgccctcccgtgggacgcccgtcggtcaagctcatctgcactctgagcaggtggcacagacaactacgccatcgcagtggcatcagcagcagccgagaggacggcctcggtactgatagaagtacagtgagnggacacgaccgacgaaccggaaggggacgactccgtgtacgttcgttttacgacggtccgacgtcgtacggtcgggtcgtcggacgtcgtacctacccgtccaacctacgtccgtacccgaccgtcccttaccgacggttcgtaggaggtactagggacgtcgtacgtactttacgttcgtacgttaccgaacggtaccggttcgggacttacggttggttacgttcgggtttcgggtttccgggacggtaacggtaccgtaggtcccgtacggtacccgttacggtaccgtacgaccgtaccgcggtccggtcccgtccccgg

SEQ ID NO: 218129 - DNA, 684 bp, Homo sapiens
  misc_feature: GYAE6OF01A3ZMP.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtgggacgcctcggtcaagctcatctgcactctgagcaggtgggcacagccaactaccgcatcgcagtggcatcgagcagcacgccaggaacggaacgggtcccgtacggtacgttcggaagtaggtaaaggttaacgtaggtagagtcggacgacgaccgaacggaaccggaaacgggggacggtacgtccgttaggtacgttcggttttacgacggtaccgtacgtcgtcggtggtcgtgacgcgtaccgtacctaccactacgtccgtaccaccgtcctacgtacgtcgtacggagtacgtcggacggtacgtacgttaccgttacgttcgtacgtccggaacgtaccggtcgggttacctacggttagggttaccgtttgggtttcgggtttacgggaccgggttaacgggtaaccgtaggttcccgttacgggtacccgttaccggtaacgggtacccgtacggaccccggtaacgggtcccgtccccggttacccccgg

SEQ ID NO: 218130 - DNA, 945 bp, Homo sapiens
  misc_feature: GYAE6OF01CZRAD.19.28.C06.1.454.CMB.1.raw
  modified_base (173)..(173): a, c, t, g, unknown or other
  misc_feature (173)..(173): n is a, c, g, or t
tcagtactctcgtgcacgaccggtgctcgatttagagctcacgtattggggtttggggagagctcgtgggggagtctgcaccatggcttcggaccccactcctcttcctcaccctcctcctccactgcacgaggtctctcctaccagtcttgtgctagactcaactccgcctntcgcctctcgccctccgtagggactccgtcggtacaacgtctacatcctacgacactcgtagagcgtaggcggacacgacgaccaactcgctagtcgactagcgacaacgcgagacgacgacgaaccggaccgtaagggaaccggtacccgggtaccgttacggtacgttaagaacggtaacggttaacgtagtggtagacggtacgaccgaaccgtaaccggaacggacggggaacggggtccgtactccgtagttacgtttccggttaacggccggtacctaggtcgtcgggtacgggtacacggtaccgtacccggtacctttaaccacccgaaccgttaccgttaccccgacggttaaccgaccccggtttacggtaaggtccgggttacgggaaacggttacgggtaacccggttagggtaacccttttaacggttaaccgtttaacggtttaccggtacgggttaaaaccccggggtcggggtttaaacccgggggttcgttaaaccggtttgggggtttttaacgggttttacggggtttacccgggggtttttaacccggggggaccccgggggtaaaacggggttaaaccccggtaaccggggttaccgggtttaacccccgggtaaacccccgggttttaaacccggggggtttacccgaaaaaccccgggggttcccccgtaaaaccccgggggggtttaaaccccgtttccccccggggtttaccccccgggaaccccccgggttttttaaccccccggg

SEQ ID NO: 218131 - DNA, 762 bp, Homo sapiens
  misc_feature: GYAE6OF01BISQF.19.28.C06.1.454.CMB.1.raw
  modified_base (165)..(165): a, c, t, g, unknown or other
  misc_feature (165)..(165): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctntcgcctctcgccctcccgtgggacgcctcggtcaagctcatctgcactcgtgagcaggtggcacgagacaacgtacgccatcgcagtggacatcgagcacgcgacgaccgaaggaacggtaaccggggtccccgtacggttaccgttggaacgtacggtaaaggttaaacgaggtagagtacgggacacgaccgaaccgaaccgggtaacgggggacggtactacccgtaggtacgtttcggttttacgacggtaccagtcgtacgggtggtccgtaggacgtccgtacccttacccgtaccgtaacctacgttcccgtaccccgaccgtacccgtaccgtaacgttccgtaggtaacggtagtcggacggtaccgttaacgtaaccttacgttaacgttaccgtacggtaaccgggttaccggtacgggtaccgttaggtttacgggttacgttcgggggttttacgggtttaccggggaacggggtaaccggtaaacccgttagggaccgtttacccgggtacccggttaccggttaaccggtaccgaacccggaacccggttaacgggtccccggttccccggttaccccccgg

SEQ ID NO: 218132 - DNA, 969 bp, Homo sapiens
  misc_feature: GYAE6OF01EOIIR.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctcctcccagtcttgtcgctgacctcaactccgccctctcgcctctcgccctcccgtgggacgccgtcggtacaacgtcctacactccgtcgcctacctcgtaggacgcgtagggtacgggaccaacgaccgaaccgtaaccgtaccggtaccacgttccgactagtcggactactaccgacgacgacgaccgacgaccggaagggaaccgggtaacccgggtaccccggttacgggttaaccgttacgggtaaggttaacgggttaaaacgggttaaccgtaagggtacggtaacggtacggacccgaaccggaaccccgaacgggaaacccggggtaaacggggggtaaccggttaccgttacccggttacggttaccggttttacggtttaccgggtacgggtaccgtacgggtccggttcggggtcggggtacgtcgggaccgtaccgttcccttacccgtaccaccgttaccgtcccggtaacctccggtacccgttacggtacggtttacggtaacgggtaccggttagtacccgggttacgtaccgtttaacgggttaaccttaaacgttttcccgggtacgttaaacccgggggtacccgggttacccgggtttagggggttaaccccggtttttacggggtttacgggttttaaccggggttttccgggggtttttaccggggggttaaaccccggggaaccggggggtaaacccgggtaaccggttacccgggttaccggttccccgggttaaacccggttcgggtaaccggtaacccggtacccggtaccccgggtaccgtcccgggttccccccgtaacccggg

SEQ ID NO: 218133 - DNA, 626 bp, Homo sapiens
  misc_feature: GYAE6OF01B4P44.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgccctcccgtgggacgcctcggtcaagctcatctgcactctgagcagtggcacagcaactacgcatcgcatggcatcagcagcagccagagacggcctcggtacttgataggaagttaacagtgagtggctacgccgaacgaaccggaacggggggcgtactcccgtgtacgttcggttttcgacgggtcctacgtcctcggtacggggctcggacggccgtaccgttaccctaccacccgtatcccgtaccaccgtccttaccgacgttcgtaggaggtacgtcggaacggtcgtacgtaacttacgttacgtcgtacgaacgtccgtagggtacctacgttggttacgttgggttacggtttcgggacggtacgggtaccgtaagccgttacggtacccgttacgtacggtccgaaccggacccgtaacggtcccgtccgttaccccccgg

SEQ ID NO: 218134 - DNA, 711 bp, Homo sapiens
  misc_feature: GYAE6OF01CBJGV.19.28.C06.1.454.CMB.1.raw
  modified_base (314)..(314): a, c, t, g, unknown or other
  misc_feature (314)..(314): n is a, c, g, or t
tcagtactctcgtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatccgccctctgcctctcgccctcccgtgggacgcccgtcggtcaacgtctcatcctgctactctggagcgaggtcgggacacacgacaaacctaccgcctatcgcagtggcatcagcagcagccagagacggcctaggtacttgataggaagtaanagtgagtcggacacgaccaacggaaccgggaagggggaccggacttaccgtaggtacgtttccggttttacgaacgggtccgtacggtccgttcgggacggggtcgtacgggacgtccggtacctaccccgtccaacctacgtccctacccgaaccgtcccgtaccgtagtccgtagggtacggtagtacggtacggtcgttaacggttaacctttagttaccgtacgtacggtaccggtacgggtcggggtacttacggtttgggtttacggttcgggtttacggggttccgggacggggtaacggtaccggtaacggttccggttccggacccgttaccggttaccggtaccgaacccggtacccggtaacggtcccgtcccccgggtaccccgg

SEQ ID NO: 218135 - DNA, 742 bp, Homo sapiens
  misc_feature: GYAE6OF01DZ7RC.19.28.C06.1.454.CMB.1.raw
tcagtactctcgtgcacgaccggtgctcgatttagagctcacgtattgggtttggggagagctctgggggagtctgcaccatggcttggaccccactcctcttcctcaccctcctcctccactgcacagggtctctctccagcttgtgctgactcaatcgccctctgcctctcgcctcccgtgggacgcctcggtacaagctcatctgcactctgagcaggtggcacgacgcaacctacgccagtccgacagtcggacatcagacagcacgaccaggacggaacggtcccgtcggttacgttgtagtaggtaaaggtaacaggtgagtcggacacgaccgaacgaaccggaacgggggacggtactccgtagtacgtttcgttttacgacggtcacggtcgtacggtcgggtactggacgtccgtcccttacccgtacctaacccgtacttaccctacccgacgtccccgtaccgtacggttcgtaggagggtacgtacggaacgggttcttacggtaaacctttaacgtttacccggttacggtacccgtaaccgggttaccgggttacggggtaccgttaacgggttttcggggtttaacggtttcggggtttaccggggtttacggggaaccggggttaacccgggaaccggttacgggtccgttaccgggtacccggttaccggaccggtaccgacccggtacccggtaaccgggtcccgttccccgggtacccccgg

SEQ ID NO: 218136 - DNA, 716 bp, Homo sapiens
  misc_feature: GYAE6OF01AJNZA.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctccctgggacgcctcggtcaagctcatctgcactctgagcagtgggcacagcaactaccgccatcgcatggcatcagcagcagccagagaacggccctcggtactgatgaagtacagtgatggcagccacgaccggaacgggggacggtactccgtgtacgtttcgttttacgacgggtcctacgtcgtcggtggggctaggaccgccgtacctacctccacctagtaccctccgaacggtccctaccgtacgtaccgtagggtaacggtacgtacggtaccgggtctaccgtaactttacgtttaccgtacggttaccgtaacggtaccgggttacggggtacccttaacggggtttacgggttttagggttcgggttttacccggggggttttaccggggacgggggttaaacccgggtaacccgtaacggggttacccgtaccggggttaccccggtttaaccgggttacggggtacccggtaacccggaacccccggtaaccggttccccggttcccccgggttaccccccccggg

SEQ ID NO: 218137 - DNA, 671 bp, Homo sapiens
  misc_feature: GYAE6OF01C8J3U.19.28.C06.1.454.CMB.1.raw
  modified_base (525)..(525): a, c, t, g, unknown or other
  misc_feature (525)..(525): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctcctcccagcttgtgctgactcaatccgccctctcgcctctcgcctcccgtgggacgcctcggtcaacgtctcatctcgcactctagagcaggtcggacacacgacaaccgtacgccagtcgacagtcggacatcgacgacgagcgacgacgaaggacggacggtccgtacggtacgtagacgtaggtaaacggttacgtaggtacgagtcggaccgacgtacccgaaccggaaccgggaaccgggggtaccggtaccgtccgttaggtaccgtttccggtttacggacgggtcctacggtcggtcgggtcggtacggtagccgtccgtacctacccgtaccgaaccgttacctccgtaccgtcgtaccctcgacgtcgtaggacgtacgngtaccgtctacgtactttcgtacgtcgtaacgtcggtaccgtgggacttacggttggtgttacggggttcggtacgggaccggtacggaccgtgtaccggtcgtccggtacgtcggtccgacgacccgacgtccgtcccgtccccg

SEQ ID NO: 218138 - DNA, 875 bp, Homo sapiens
  misc_feature: GYAE6OF01CDHCO.19.28.C06.1.454.CMB.1.raw
tcagtactctcgtgcacgaccggtgctcgatttagagctcacgtattgggtttggggagagctcgtggggagtctgcaccatggcttggaccccactcctcttcctcaccctcctcctccactgcacagggtctctcctcccagtcttgtgctgactcaactccgccctctgccttcgtcgcccttcccgtgggacgtcccgtcggtacaacgtcctacactctgacctactccgtggacgcgtaggtcgggaccaaccgacggaccaaaccgtaccgcctaacgtcgactaggtcggactactacgacggacacgacacgaccgaaggaacgggaaccggtccgttacggttacgttagagtaaggtaaacggttaacgaggtaggtagtacggacgaccgaccgaaccggtaacgggaacgggggacgtaccgtaccgttggttacgtttcggtttacggacggtccgagtcgtacggtcgggtctacggtcgccgtacccttacccgtaccgtaaccgtaccgtcccgtaccccgaccgtacccgtaccgtacggttacgacgggtaaggtcggtttacggaacggttaccgtttacggttaaaccgtttacggttaaccgttaaccgggtaaccggttacggggtaacccggggtttacgggtaaaccgttttacgggtttcgggttttaacgggggtttcggggttttcccggggggtttaaacgggggaaccgggttaccccggggttaaaccggtccggttaacccgggttaaccgggtttacccccgggttaccggttaacccggggaccctaccgggtaaaccccgggccgggtttaccccccggtaccccgggtttccccccggg

SEQ ID NO: 218139 - DNA, 784 bp, Homo sapiens
  misc_feature: GYAE6OF01AL95C.19.28.C06.1.454.CMB.1.raw
tcagtactctcgtgcacgaccggtgctcgatttagagctcacgtattgggtttggggacgaagctctgggggatctgcaccagtcggcttgggaccccactcctcttcctcaccctcctcctccactcgcacgagggtctctcctcccagcttggtgcgtacggacctcgaaagttcccgcccctatcgcccttcctcggaccctcccgtggggacgcccgtcgggcaaagcctacatcctcggacctactcgtggacgcgtacggtcgggaccaccgagaccctaaccgtacggaccctaagtccgtaccgaaggtcgggtactacgtccgaagtccgaacgtcgaacggtaccgagggtaaccgggaacggggtccccgttacgggttaccttagaacgttaggtaaacggttaacgaggtacgacgtaggacgaaccgtaccgaacgaaccgggtaacgggggacgtacctaccgtagtaacgttcggtttacgaacgggtctaaggtacgttcggtacggtactacggacgtccgtacctacccgttaccgaaccgtacgttccccgaccgtaaccggttacctaccggtacgtcgggtaggtacggaacgtacggtccgttactacgtaccttaacgtccgttaggtaccgtacgggtaccggtaggccttagggttaggttacgtcgggtttcgggtacggacgggaaccggtcgccttacggtccgaccgttaccggaccggtacaccggtaccgtccggtccgtccccggtcccgg

SEQ ID NO: 218140 - DNA, 949 bp, Homo sapiens
  misc_feature: GYAE6OF01EWWCF.19.28.C06.1.454.CMB.1.raw
  modified_base (192)..(192): a, c, t, g, unknown or other
  misc_feature (192)..(192): n is a, c, g, or t
tcagtactctcgtgcacgaccggtgctcgatttagagctcacgtattgggtttggggagagctctggggagtctgcaccatggcttggaccccactcctcttcctccaccctcctcctccactgcacagggtctctctcccagctttgtgctgactcaatccgccctctgcctctcgccctcccgtgggacnccgtcggtacaacgctacatcgtgcactcgtgacgacgtaggtcgggaccaacacgacctaaaccgtaccgacctaacgttccgacgtaagtcggacctaagtaccgaacgaccgaacggaccgaaccggacccgaaacggggtaaaccggggtaaaccccggggtcccccggtttaaccggggtttaaccgtttaagggtaaacgggttaaacgggtttaaaaccggggtttaaaaccggtaggggttaacgggtaacggttaccggggaacccggtaaacccggtaacccccggaaaacccggggaaaacccgggggtaaaccggggggggaaacccgggttaacccgtttaccccggttaaggtttaaccccggtttttacgggtttttacccgggtaacccggggtaccgtaacgggttccgtccggggttacggggtaccgtacggtaccggtacccgttacccgtaaccccgttaacccgacccgttcgtaccccttaccggacccgttacccgtacgttacggttaccggaacgggtaacggtacggtacggaacgggtactttaacggtaacctttacggtacgttaccgtacggacggtaccgggtacggttacgtacggtttaggtttcggttggggtttaccggggttaccgggaacgggttaccggaacgtagttcccggtaccggtaccgttacggtaccggaccgtaccggaacccggtacggcccgttaccccggtccccgg

SEQ ID NO: 218141 - DNA, 682 bp, Homo sapiens
  misc_feature: GYAE6OF01DNBHO.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgccctcccgtgggagcctcggtcaagctcatctgcactctgagcagtgggcacagacaactacgccatcgcatggcatcagcagcacgccaaggaggaacgggcccctacggtacttgataggtaaggttaacagtgagtcggacacgaccacgaaccggaagggggacggactcccgtagtatttcggttttacgacgggtccagtcgtcggtggggtctggacgtccgtccgtaccctccacctacttccgtacccgtacgtccctaccgacgttcgtaggaacggtagtacggacggtctacgtactttaacttacgttcgtacgtacggtaccggtacggggtaccttaacggttgggtttacggttcggggtttacggggttttaccggggaccgggtaacgggtaacccggtaaggttcccggttacgggttaaccccggttaccggtacgggtacccgtaaccggaccccggtaaacggtccccgtcccggtaccccccggg

SEQ ID NO: 218142 - DNA, 688 bp, Homo sapiens
  misc_feature: GYAE6OF01EYDOY.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtgggacgcctcggtcaagctcatctgcactctgagcaggtggcacagacaactcgccatcgcagtggcatcagcagcagccagagaacgggtccctacggtacttagagtaggtaaacggttaacaggtgagtcgggactacgaccgaacgaaccgggaaggggggacggtacgtcccgtagtacgttcggtttttacgacgggtccacggtcgtcggtacggggctacggacggtccgtacctacccgtaccaccgtactccctaccctacgtccctactacggtcgtacggtaacggacgtacgggacgtcgttacgtacttaagttaccgtacgtaccgaacggtaccggttacgggtactaacggtttagggttacgttggggtttaccgggtttaccggggacggggtaacgggtaaccgtaacggttaccggtaccggtacccggttaccgtacgggtaccgaaccgggtaccccgtaggtccccgtcccggttacccccgg

SEQ ID NO: 218143 - DNA, 700 bp, Homo sapiens
  misc_feature: GYAE6OF01APBU8.19.28.C06.1.454.CMB.1.raw
tcagtactctcgtgcacgaccggtgctcgatttagagctcacgtattgggtttggggagagctctgggggagtctgcaccatggcttggaccccactcctcttcctcaccctcctcctccactgcacagggtctctctcccagcttgtgctgactcaatcgccctctcgcctctcgccctcccgtgggacgtcccgtcggtacaacgtctcatctcgctactcgtgacgcaggtggacacgagaccaacgtacgccatccgacagtcgacagtcagcagcacgccgaaggacggaaccgggtccgtacggtactgagtaggtaagtacgagtagagtcggacaacgaccgacggaaccggaagggggaccggtactaccgtaggttacgtttccggtttacggacgggtctacggtcgtcggtcggtctacggtacgtccgacccttacaccgtactaccgttccacccgccgtacctacgtacggtcgtagggtacgtacggtacgtcggtacgttacgtaacgttacggttaacctaggtaaccggtaccggtaaccgggttccgggtaacttaggttttaccggttaggtttcggggttaacggttccggggaacggtacggtaccgtagtaccggtacccggtttaccgtaacggtcgtaccggacccgaggtaacccgtccggtcccgtacccgg

SEQ ID NO: 218144 - DNA, 842 bp, Homo sapiens
  misc_feature: GYAE6OF01C0QPD.19.28.C06.1.454.CMB.1.raw
tcagtactctcgtgcacgaccggtgctcgatttagagctcacgtattgggtttggggagagctcgtggggagtctgcaccatggcttggaccccactcctcttcctcaccctcctcctccactgcacagggtctctcctcccagtcttgtcgctgactacaacgtccgccctctcgtcctctcgtccctccgtcgggacgtcccgtcggtacaacgtcctacatcctcgacctacgtcgtacggacgacgtaaggtcgggaccaacgacgacctaaccgtaccgacctacgtcgctacggtcggactacgaccgagaccgaacgacgaacggaccgtaacggaaccgggtaacccgggtacccggttacggttaacgtaggaacggttaacggtaaacggttaacgtaggtaggtacgtacggaacgaccggaacccggtaaccggaaccggggaaaccgggggtaccggttaaccgttcccggttaacggttacgttttaccgggtttacggtaccgggtccgtacggttcgttacggggtacgggtcggtacggaccgtaccggtaacctttacccggaacccgttaaccgtacgtcccgtaccctaccggtaccctaggttaaccggtcgtacggaacggttcgacggttaccgtactacgttaacttacgttacgacgggtaccgtaacgggtccgggtaggttacccgtttagggtttacggttacggtttcgggttaccgggtaccgggacggaaccggtacgtaccgtcgggtaccgtaaccggttacgggacgtaccgtaacccggtcgtaacccggcccgtcccggtacccgg

SEQ ID NO: 218145 - DNA, 826 bp, Homo sapiens
  misc_feature: GYAE6OF01EEFA8.19.28.C06.1.454.CMB.1.raw
  modified_base (104)..(104): a, c, t, g, unknown or other
  misc_feature (104)..(104): n is a, c, g, or t
  modified_base (127)..(127): a, c, t, g, unknown or other
  misc_feature (127)..(127): n is a, c, g, or t
  modified_base (147)..(147): a, c, t, g, unknown or other
  misc_feature (147)..(147): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
tcagtactctcgtgcacgaccggtgctcgatttagagctcacgtattgggtttggggagagctctgggagtctgcaccatggcttggaccccactcctcttccncaccctcctcctccactgcacgngggtctctctcccagcttgngctgactcaactccgccctctgcctctcgcccttccggtgggacgtcccgtacggtacgaacgtcctactactccgtcgcctacgttcgaggaaggtaacgggtcggaccaacgacgacctaaacgtccgacgtacnccggtnaagtcggactaactcccggaagccgaacggtaccaacggtaccgaaacggggaacggaaccgggttcccgttaggtaaccgttagaaggttacgggtaaaggtttaaccgaggttcggacgtacggaccaaccggaccctaaaccgggaccggggaacggggtaccgtactacccggtagttacgttttaaccggttgggaaaccgttccggtaagtccgggtttacgggtacgggaccgtacggtacccgggtaacctaccgtaacccgttacccgaaaccgttccgtaccgttaccgacccttacccggtacgtacggttcggagtacggtacgcggtaacgtcgttaacgttacttaacgtacgtcggttaacgaccgggttacggtacgggttccggtttaagttgggttttcggttcggggtaccggtttacgggccggggtaaccggtacggtacgggtccgttaacggttccccggtagttaccggccggtaccgacgtaccccgggtctccggtcccccgttaacggg

SEQ ID NO: 218146 - DNA, 713 bp, Homo sapiens
  misc_feature: GYAE6OF01BACVL.19.28.C06.1.454.CMB.1.raw
  modified_base (185)..(185): a, c, t, g, unknown or other
  misc_feature (185)..(185): n is a, c, g, or t
tcagtactctcgtgcacgaccggtgctcgatttagagctcacgtattgggtttggggagagctctggggagtctgcaccatggcttggaccccactcctcttcctcaccctctcctccactgcacagggtctctctccagtcttgtgctgactcaatcgcctctgcctctcgcctccgtgggacncctcggtcaagctcatctagctactctgacgcgaggtcggcactacgacaaaccgtcgccatccggactagtcggactactcgagcacgacagccgaggacggacggtcctcggtactagacgtaggtaacggttaacgcgtagagtggacctacgaccgacggaaccgggaacgggggggtaccgaccttacccggtagtaccggtttaccgttttcggaacgggtccgtacgtccgtacggtgggcctaggtcgtaccgtaccgtaccgtcctaccgtacgtccctacgtccgtaccctcgtacgtcgtacgggacgtacggtcggtacgtcgtacgtacgttacgttacgtccgtaccggtacggtaccggttcgggtacgttaacggttgggttaccgtttcgggggttccgggttttaccgggaaccggggtaaccgggtaccggtacgtacccggttccggacccggttacgtaccgggtcccaccgggtacccgaccggtcccggtacccggttcccccgg

SEQ ID NO: 218147 - DNA, 649 bp, Homo sapiens
  misc_feature: GYAE6OF01BIXIY.19.28.C06.1.454.CMB.1.raw
  modified_base (190)..(190): a, c, t, g, unknown or other
  misc_feature (190)..(190): n is a, c, g, or t
  modified_base (253)..(253): a, c, t, g, unknown or other
  misc_feature (253)..(253): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctccagcttgtgctgactcaatccgccctctcgcctctcgccctcccgtgggacnccgtcggtcaagcctcattcctcgcctacttctgagcgagtggacacagaccaactacgccancgcagtgcatcagcagcacgccgaaggacggaacggtcccgtacggtacgttgagtaggtaaggtaactggtgagtcgcgacgaccaaccgaaccgggaaggggaccggtctaccgtgtactttcggtttcgacggtcaggtcgtacggtgggctacggcgtccgtccgtaaccctcacccgtactccctaccgaccgtccccgtactacggtctagggaaggttcgacggacgtcttacgtaaccttagttctacggtacgacggtaccgggtggtacgttacggtttggttacgttcggggttacgggttcgggacgggtacgactagggtcctaacggtcccgttacggacgtccggaaccggtacccgacggtcccgtccccgtacccccgg

SEQ ID NO: 218148 - DNA, 836 bp, Homo sapiens
  misc_feature: GYAE6OF01DDV3Y.19.28.C06.1.454.CMB.1.raw
  modified_base (133)..(133): a, c, t, g, unknown or other
  misc_feature (133)..(133): n is a, c, g, or t
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
tcagtactctcgtgcacgaccggtgctcgatttagagctcacgtattgggtttgggggagagctcgtggggagtctgcaccatggcttcggaccccactcctccttcctccaccctcctcctccactgcacgnggtctctcctccagtcttgtcgctcgacctacaacgtcccgccctcgtcgtcctccgtccgcccgtcccggtgggacctcccggtacggtaccaacgtctacngtccgtacgacctatcgnggagcggtaggtacggacacgacgacctaacgtaccgctacgcgacgtagcgacctacacgcgacgagaccgaacggcggaaggaaaccggggtaccggtccgttaacggttacgtaggtaacgtaagggtaaacgttagacggtaggacgtacggaccgaaccgaaccggtaaccgggaaccggggacggggtaccgtctaccggttagttaccggtttacgtcggtacggtcgtacgttacggcggggttcggactcggtaccgaaccgttaccgacccgttcgtaacccgtccgttacccggtaacccgttccgtacccgtacgtaacggtaccggtgggaacgggttaacggcgttaacgtaccgttacgttacgtttacggacgtttaccgggaaccgccggggtttacggtacgggttcttaacgggttttcgggtaacgggttttccggggtttaggaccggggtaacggtaccggtaaccggttacggtcccgggttacccggttaccgggtaccgttaccgggtaaaccccgggactacccggggttccgtcccccgtccccgggtttacccg

SEQ ID NO: 218149 - DNA, 796 bp, Homo sapiens
  misc_feature: GYAE6OF01BYQSY.19.28.C06.1.454.CMB.1.raw
tcagtactctcgtgcacgaccggtgctcgatttagagctcacgtattgggtttggggagagctctggggagtctgcaccatggcttggaccccatcccctcttcctcaccctcctcctccactgcacagggtctctctcccagcttgtgctgactcaatcgccctctgcctctcgcctcccgtgggacgcctcggtcaagctcatctgcactctgagcagtgggcacagacactacgccatcgcatcggctactcagcagacacgaccaggacggaaccgggcccgtacggttacttgagtaggtaacggttaacgaggtagagtcggacgtacgacccaacggaaccgggaaacggggggaccggaccgttacccgtaggtacgttttccggtttttaccggacggggtacccgtaaggtccgttcgggttcggggtctacgggtacggtacccgttacccgtaacccgttcccaacccgtaccgttacccctacccgtaccggtccccgttacctacggtttccgtagggaacggtagttacggacgggtacttaccgttaaccgtttacgttaccgttacggttaccgtaaccgggttacccgggtaggggtacccttagggtttacgggtttacgttcggggtttttacggggtttacccgggggaacgggtaaccggggtaacccgttaagggttcccggtacgggttaaccccgttacccggttaacgggttacccgtacccgggtaacccgaaccggggttcccccgttcccgggttaccccccccggg

SEQ ID NO: 218150 - DNA, 831 bp, Homo sapiens
  misc_feature: GYAE6OF01BGGDR.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctcgccctcccgtgggacgcctcggtacaagctcatctcgccactctgagcgaggtcgggacacgacgaccaaccgtaccgccatccgacgtagtcggactacgtacgacgaccgacgaccgacgaccggaacggaacgggtaaccgggtcccgttacggttacgttaggtaacgttaacggtaaacggttaacgtaggtacgtacgtacggaccgaccgaaccggaaccggaaccgggaacgggggtaccggtaccgttaccgttacggttaccgtttacggtttaccggtaccggtccgtacggtccggttcgggtacgggtacgtacggtaccgtacccgtacccgtaccctaccgtaaccgttaccgttacccgtacccgtaccgttacccgtacggtacggttacggtaacgggtacggtacggtacgggtacgttaccgttaacgttacgtttacgttacggttaccggtaccggtacgggttaccggttacgggtaccgtttacgggtttacgggtttacgggtttcggggtttaccggggttaccgggaacggggttaaccggtacgttaccggtccggttaccgggtaccggttaccggtaccggtacccggaacccggtacccggccggtccccggttccccgtccccgg

SEQ ID NO: 218151 - DNA, 845 bp, Homo sapiens
  misc_feature: GYAE6OF01BKYAG.19.28.C06.1.454.CMB.1.raw
  modified_base (192)..(192): a, c, t, g, unknown or other
  misc_feature (192)..(192): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgacctacaactccgccctctgcctctcgccctccgtgggacnccgtcggtacaagctcatctcgctacgtctaggacgcgtaggtcggaccaacgtacgaaccaaccgtaccgacctagtccgacagtcggactacgccgacgacgacgacgaacgacccggaaaggaaccggggtaaccgggtccccgtttacgggttaacgtttaggaacggtaacgggttaaacggttaaacgtaggtaccgtaagtaccggaaccgaccgaaccggaaccggtaaaccggggaaacggggggtaccgtaccgttaccggtacgtttacgtttaccggttttacgggaccgggtaccgtacggttcggtcggggttaacggggtccgtacgggtaccggtacccggttaaccttaccccgtaccgtacccgttaaccgttccgtaccccgtaaccgtccccttaacgtaaccggttcgaagggtaacggtagttacggacgttaacgtacggttaaccttaacgtttacggtacggtaaccggtacggggttaaccggtagggtacccgtttaggtttacgggtttaaggttccgggggttacgggttacgggaccgggttaacgtaccggtaggtcccggtacggtcccgttacggaccggtacccgacggaccgaccggtccccgtacccgttaccccgg

SEQ ID NO: 218152 - DNA, 760 bp, Homo sapiens
  misc_feature: GYAE6OF01AQHJV.19.28.C06.1.454.CMB.1.raw
tcagtactctcgtgcacgaccggtgctcgatttagagctcacgtattgggtttggggagagctctgggagtctgcaccatggcttggaccccactcctcttcctcaccctcctcctccactgcacagggtctctctcccagcttgtgctcgactcaatccgccctctcgcctctcgcctcccgtgggactccgttcggtacaacgcctctaatccgtcgactacttcgtagagccgaggtcgggaccaacgacgacctaaccgtaccgctacgtaccgcgtaacgtcggactacgtacgacgcgacgacgacgaccgaaggacggtaaccggtcccgttacggtacgtaggaagtaggtaaacggttacaggttagagtcgacgacgaccgaacggtaaccggacgggggaaccgtacgttaccgtagttaccgtttcgtttacgacgggtaccgtacggtccgtcgggtacgggtacgtcggtacgtcccgtaccgttaccctaccaacgtcgtaccctaccgtaaccgtcccgtacgtacggtcgtacggtacggagtacggtacgtcgtacgttaaccttagttccgtcgtaacggccgggttaccggtacggttacgtaccggtttgttacgggtttcgggttcggttaccgggaccgggtaaccggtaccggtacgttacccggttcgtaaccccggttacgacccgggtaccgtacccggaacccggttccggtcccgttccccgggtacccgg

SEQ ID NO: 218153 - DNA, 767 bp, Homo sapiens
  misc_feature: GYAE6OF01CCF99.19.28.C06.1.454.CMB.1.raw
  modified_base (750)..(750): a, c, t, g, unknown or other
  misc_feature (750)..(750): n is a, c, g, or t
tcagtactctcgtgcacgaccggtgctcgatttagagctcacgtattgggtttggggagagctctggggagtctgcaccatggcttcggaccccactcctcttcctccaccctcctcctccactgcacgagggtctctctcccagtcttgtgctgactcaatccgtcccctctcgcccttcgtccgccccttaccggtacggggcctcccggttcggtaccaagtcctacgctcgtcgacctactcgtggacgacgtacgggacggaccacgacaccaaaccgtccgcgttacgcgacgtagcggactacgtacacgacgacgacaacggcgaacggaccgggacccgggtcccgttacggttagttaggtaacgtaacggtaacgttaacgtggtacgcgtaccggacgaccggaaccgaacccgggtaacggggaaacgggggtccgttaaccgtacgttacggttacggtttttccggtttacggtccgtacgtacggttccggtcggggtcgtcgtacggacccgtccgttacctacccctaccaccttacgacccgttacccgtacccgtacccgttacggtcggttaacgggagtaacccggtggtaggttacgtcgtacttaaccgttacgtcgtaccgttacggcgttaccgggtacgttcgttagggttcgttcgggttacgggtttcggtaccggacggcgtacgccgttaggcccggttacgtcacgtcgaacggtccnccggtcctcccggtccg

SEQ ID NO: 218154 - DNA, 919 bp, Homo sapiens
  misc_feature: GYAE6OF01DPUKY.19.28.C06.1.454.CMB.1.raw
  modified_base (168)..(168): a, c, t, g, unknown or other
  misc_feature (168)..(168): n is a, c, g, or t
  modified_base (175)..(175): a, c, t, g, unknown or other
  misc_feature (175)..(175): n is a, c, g, or t
  modified_base (219)..(219): a, c, t, g, unknown or other
  misc_feature (219)..(219): n is a, c, g, or t
tcagtactctcgtgcacgaccggtgctcgatttagagctcacgtattgggtttggggagagctctgggggagtctgcaccatggcttggaccccactcctcttcctcaccctcctcctccactgcacagggtctctctcccagtcttgtgctgactcaatccgccctntcgcctntcgcccgtccgtgggacgtccgtcggtacaacgtctcacgttcncgccacgttcgacgagacgacgggtcggaccaacgaacgacctaaccgttaccgacctacgtcgtacgtaggttccggactaacgtaccgaacggaccgacggaccgacggaaccggaaacggggtaaccgggtaacccgggggtaccccgtttacggggttaaccgtttaaggtaaacggttaaggggttaaaccgggtttaaacggtagggttagtacggtacgggaccgaacccggaaccggaaccgggaaaccgggggtaaacgggggggtaacccggtacctttacccgggttaggttaaccggttttcggttttaaccgggaccgggttaccggtacggtccgggtttacgggtcggggtactaccgggaaccgttccggtaacccttaccgaacctaacccggtactacccggtacccgtaccgtacccgtacggtaccggttacggtaacgggacggtaacggtaacgggttccgaacgttacgttacgtttaaaccgtcggtacgttaacccggacgggggttaacgtcgggttaaccttaagggtttcgggtttaacggtttcgggttacgggggttacccgggaacggggtaaacgtaaccgggttgttacccggccgggtttaaccgccggttaccggtaacggtacccgggaccgttaacccgggtcccgtccccgttaaccccggg

SEQ ID NO: 218155 - DNA, 907 bp, Homo sapiens
  misc_feature: GYAE6OF01DUI0L.19.28.C06.1.454.CMB.1.raw
  modified_base (233)..(233): a, c, t, g, unknown or other
  misc_feature (233)..(233): n is a, c, g, or t
tcagtactctcgtgcacgaccggtgctcgatttagagctcacgtattgggtttggggagagctctggggagtctgcaccatggcttcggaccccactcctcttcctcaccctcctcctccactgcacgagggtctctcctcccagtcttgtgctgacctcaacgtccgccctctcgcctccgtcgtccctcccgtgggaccgtcccgttcggtacgaacgtcctctacttccncgacctactcgtagacgcgaggtcggaccacgacgacctaaccgtaccgacctacgtcgacgagtcggacactacgacgaccgacgaccgacgaccgaacggacgggaaccgggtcccgttacggttacgttaggtaagtaggtaaacggttacgtaggtagacgtacggacgacgaacccgaacggaaccggggaacgggggtaccgtaccgtaccgttacggttaacgttttccggttttacggtaccgggtaccgtacggtcggttccgggacgggtacggtacggacggtcccggtaccttaaccccgtacctaacccgtaccgttacccgtaccccgtacccggtacccgttacgaccggtttaccgtagggtaacggttacgggacggttaccggtacgttaccgttaacgttttacgtttaaccggtgggtttaaacccgacggggtttaccggggtacggggttaaccgtttacggggttttacggttttaaggggtttaccggggttttacgggggtttcccggggaagggggttaacccggtaaacccgggttacgggtacccgggtttaacccggtacccggggttacccgttaccggggtaccccggtaacccggacccgggttacccgggtcccccgttacccccgggtttaccccccggg

SEQ ID NO: 218156 - DNA, 618 bp, Homo sapiens
  misc_feature: GYAE6OF01EDLAO.19.28.C06.1.454.CMB.1.raw
  modified_base (149)..(149): a, c, t, g, unknown or other
  misc_feature (149)..(149): n is a, c, g, or t
  modified_base (187)..(187): a, c, t, g, unknown or other
  misc_feature (187)..(187): n is a, c, g, or t
  modified_base (215)..(215): a, c, t, g, unknown or other
  misc_feature (215)..(215): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (395)..(395): a, c, t, g, unknown or other
  misc_feature (395)..(395): n is a, c, g, or t
tcagtactctcgtgcacgaccggtgctcgatttagagctcacgtattggggtttggggagagctctggggagtctgcaccatgggcttggaccccactcctcttcctcaccctcctcctccactgcacagggtctctctcccagcttgngctgactcaatccgcctctgcctctgcctccctgggancctcggtcaagcctcatctgcactctgngcagtggacacagccaactcgacctacgtcgcaagtcggacctatccagcagcagccaggacgacggtccctggttactggactaggtaacgtacnggtnagtcggcacgccaacggtaaccgggaggggccgactccgtgtacgtttcgtttacggacggcctagtcgtacggtcggtntcggacgtccgtactacccgtaccacgtactcctccgaaccgtccctacgaacgttccgtaggtacgacgtacggacgtcgttactacgtttactcgtacgtcggaccgtaccggtcggtacttacgttaggttgtcggtttcgggttacggcgggtaacgtcgacgtcgtacggtaccgtacgacggtcccgacgtaacccggcgtccgtccggtaccccgg

SEQ ID NO: 218157 - DNA, 785 bp, Homo sapiens
  misc_feature: GYAE6OF01AQVET.19.28.C06.1.454.CMB.1.raw
tcagtactctcgtgcacgaccggtgctcgatttagagctcacgtattgggtttgggggagagctctggggagtctgcaccatggcttggaccccactcctcttcctcaccctcctcctccactgcacgagggtctctctcccagcttgtgctgactacaatccgccctctcgcctctcgccctcccgtgggacgccgttcggtacaacgtctacgattctcgcctacctcgtagacgcgtaggtcgggacacgacgtaccaaccgtaccgcctaagtccgacctaagtcggctactacgacgaccgaacgccgaacgccggtaaaggaacgggtaacccggggtccccgtttagggttaaccgttacggtaaacggttaacggttaaaacgggttaacgaacggttacggaacggtaggaccgaaaccggaccgaaccgggtaaaccggggaacggggggtaacccggtactacccggttagttaccgttttccgggttttacggacgggttaccgtacggtcgttacggggtcgggtactacggaaccggtccgtacccttaccgaccctacctactcccgtacccgacgtccccgtacgtacggtccgtaagggacgtagtacgggtcgtactactaacgtttactcggtacggtacgtacgggtaccggtcggtacgttacggttaggttcgttgggttcgggttaccggacgggtacggacgtacggtcgttccggaccgtcgtacggaccccgacggtaccgccgtccgcccgttacccg

SEQ ID NO: 218158 - DNA, 718 bp, Homo sapiens
  misc_feature: GYAE6OF01AW7VW.19.28.C06.1.454.CMB.1.raw
  modified_base (189)..(189): a, c, t, g, unknown or other
  misc_feature (189)..(189): n is a, c, g, or t
tcagtactctcgtgcacgaccggtgctcgatttagagctcacgtattgggtttggggagagctctggggagtctgcaccgatggcttggaccccactcctcttcctcaccctcctcctccactgcacagggtctctctcccagcttgtgctgactcaatcgccctctgcctctcgcctcccgtgggacncccttcggtcaagctcatctgcactctgacgctaggtcgggccacacggaccaaccgttaccgccctagttccgctagtcgggacactccgagcacgccacggccaggaacggaacgggtccccgtacggtacttggacgtaggtaaacggttaacgaggtagacgtcgggacacggaccaaccggaaccgggaacgggggacggtaccgtcccgttagtacgtttaccggttttacgacgggtaccgtacggtccgttacgggtcgggtacgtacgggcggtccgtaacccgttacctacccgaccttaccgtccgtacccaccggttcccgtacgtaacggttcttacggagtacgtagtacggcttaggaacctttagttactcgtaccggacgtaccgggttcggtacttacggttggtttacgttggggtttcggttacggacgggtacggtaccgacgtcggttacgacccggttacgtcgggtacccgtacgaccccggtcggtccgtcccggtacccccgg

SEQ ID NO: 218159 - DNA, 774 bp, Homo sapiens
  misc_feature: GYAE6OF01EQ0AH.19.28.C06.1.454.CMB.1.raw
  modified_base (307)..(307): a, c, t, g, unknown or other
  misc_feature (307)..(307): n is a, c, g, or t
  modified_base (481)..(481): a, c, t, g, unknown or other
  misc_feature (481)..(481): n is a, c, g, or t
tcagtactctcgtgcacgaccggtgctcgattttagagctcacgtattgggtttgggggagagctctgggggagtctgcaccatggcttggaccccactcctcttcctcaccctcctcctccactgcacaggtctctctcccagcttgtgctgactcaatccgccctctgccctctcgtccctccgtgggacgtccgtccggtacaagtctcacttctcgactacctgtgacgcgtaggtcgggaccaacgacggaccaaaccgtacccggacctacgtccggacacgtcggacctagtccgagacncgacgacgaccgaaggaacggacggggtacccctacgggttactaggaagtaggtaaacggttaagacggtgacgacgacgaccgaaccgaaccggaaccggggtaaggggaccgtacctcgtaagttaccgtttcgttttacgggacggtccgacgtcggtcgggtcggtacncgggtaaccgtccgtacctaccctacccgtaaccgtccgttaccctccgaacccgtccgtacccggtagttaccggagtaaggtagtacggtaccgtacggttaacttaccgttattcccgtaccggtaggaccgttacggtccggtcggttaagtttcgggtagtttcggggttccggttacgggaacgggtacggtaacccgtaggttacccggtaccgggttaacccgttcgggaaaccgtaccggaacccgtccgggtaacggcccccggttccccgtaaccccccggg

SEQ ID NO: 218160 - DNA, 884 bp, Homo sapiens
  misc_feature: GYAE6OF01AETYI.19.28.C06.1.454.CMB.1.raw
tcagtactctcgtgcacgaccggtgctcgatttagagctcacgtattgggtttggggagagctctgggggagtctgctaccagtggcttggaccccactcctcttcctccaccctcctcctccactgcacagggtctctctcccagtcttgtgctagactacaactccgccctcgtcgtcctctcgtccctcccggtgggacgtaccgtcggactaacgtctactacggtctcgcgtactcgtagacgtacgtaggtacggacctaacgacgtaccaccgtaccgcctactccggatacggtcgtacgacgcaaggtacgtaacgacggacctaaccggtaaggaacgggtaacccggtcccggttaacggttaagtaccggtaagttacggtaaacggttacgagttacgacgtcggaacgtacggaccgtacggtaaacgggtaccggggtacgtacgtacgttagggttacctttcgggtttaacgtaccgggtagttacccggttacggtccggggttaacgggcgttaaccggccgttaccgaaccgttacccgtaaccctccgttaccgtacccgttacgaccgtaacccgtacggtacgttacgacgggtacgtaacgggtacgttaccggtaacgttaccttaacgtttacccggttaagtttaacccgggaccgtaaggggttacccggtaaccgggtttacggttaggttacggggttttccggttaaccgggttccgggggtttaacccggtacgggtaacccggggttaccgttacccggttacggtcccggttaaaccggtttccgaaaccggttcccgggaaaccggttaccccgggtaaccgggttcccgtaccccccggtttacgggg

SEQ ID NO: 218161 - DNA, 987 bp, Homo sapiens
  misc_feature: GYAE6OF01CTZVP.19.28.C06.1.454.CMB.1.raw
  modified_base (240)..(240): a, c, t, g, unknown or other
  misc_feature (240)..(240): n is a, c, g, or t
tcagtactctcgtgcacgaccggtgctcgatttagagctcacgtattggggtttggggagagctcgtggggagtctgcaccatggcttggaccccactcctcttcctcaccctcctcctccactgcacgtagggtctctcctcccagtcttgtgctgactacaatccgccctctcgcctctcgcccgtccgtcgggactccgtcggtacaacgcctacgtactcgtcgacctacgttcgngacgcgtacgggtcgggaccaaccgacaccgtaaaccgtaccgcctaacgtcggaactcggtacggtaccagtaccgaacgaccgtaacgccgtaaccggaacccggaagggaaaccgggtaaccccggggtaccccgtttacggttaacgttaacggttaacggttaaacggtaaaacgggtttaaaccgagggttaggtaacggtaccggaacccggtaaaccggaaccccggaaccggaaaaaccgggggtaaccggggggtacccggttaaaccgtttccccggttagggtttaaacccgtttttccgggttttaccggaaccggggtccgtaacgggtccggttcggggtaacgggtccgtttaccggggaaccgttaccgtaccccgtaacccctacgtaaccccgtacgttaccccgttcccgaaacccggttccctaacggggtacttacggtaacggggtagtaacgtccgggtaacgttccgttaacgttacgggttactttaaccggtacgggtaccgtaaacccggggtcggttaacggggtcccgtttaagggttttcgggttccgggttaaccggggtttttcgggggtaaaccggggtaacccgggtaacccgggtaaaaccggtccgtttacccggggtaacccggttacccggtttaacccggtaacgggtaccccgtaaacccggtcccggtaaaccggggtcccccgttacccccgggtaacccccgg

SEQ ID NO: 218162 - DNA, 752 bp, Homo sapiens
  misc_feature: GYAE6OF01DYQJK.19.28.C06.1.454.CMB.1.raw
  modified_base (127)..(127): a, c, t, g, unknown or other
  misc_feature (127)..(127): n is a, c, g, or t
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (722)..(722): a, c, t, g, unknown or other
  misc_feature (722)..(722): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacngggtctctctcccagcttgtgctgactacaactccgccctctgccctctcgcctcccgtgggacgtccgtcgcaacgctnctctgcactntacgagcgtaggtggccacacgaccaacgtcgacctagtaccgccagtcggctaactcgaacggcacgaccgaacgtaccgaacggaacgggtaacccgggtcccgttacgggttacgttaggtaaggttaaacgggtaaacggttaaaccgtacggtaggtacggtaagacgaccggaacccggacggaaaccggggaacgggggaccgtaccgttacccggttagtaccgttttcggttttacggtacgggtaccgtcggtcggtcgggtacggggtcacggtacggccccgttacccggtaacctccctaaccgtcttaccccggtaccctaccgtcccgttacccgtacgttaccgtagggtaccgtaggtcggtaccgtcgttacgttacgtttaacgtaccttagggtcctacgggtaccggttcggagttacgtttacgggttggttacggttcggttcgggagggttacgaacggtcgtaccgttacgccgttacgnggtaccacggacctacgcgcccgttacccg

SEQ ID NO: 218163 - DNA, 489 bp, Homo sapiens
  misc_feature: GYAE6OF02I0TI5.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaaggggacggatccctgatcgttttcaggtccagctctgggctgagcgctacctcaccatctccagcctccagtctgagatgaggctgactattactgtcagaccgtggggcacgtggttatgttggtttcggcggagggccaagcgtgaccgtctaggtcagcccaaggctcgccccg

SEQ ID NO: 218164 - DNA, 156 bp, Homo sapiens
  misc_feature: GYAE6OF02JI5CK.19.28.C06.1.454.CMB.1.raw
  modified_base (155)..(156): a, c, t, g, unknown or other
  misc_feature (155)..(156): n is a, c, g, or t
tcagtactctcgtgcacgaccggtgctcgatttagagctcacgtattgggtttggggaccaggctggagatcaaaggaactgtggctgcaccatctgtcttcatcttcccgccatctgacacgagagtactgagcgggctggcaaggcgcatagnn

SEQ ID NO: 218165 - DNA, 525 bp, Homo sapiens
  misc_feature: GYAE6OF02GNDDB.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaagggggacggatccctgatcgttttcgagggtccagctcgtggggctgagcgctacctcaccatcctccacgccctccacgtctgaggatggaggctgacttattactgtcagaccgtgggctacgtggttagtggttggtttcggcgggtagggaccgaaggtcgtacggtaccgtccgtaggtccgacggcccgaaggcctccgtcccccg

SEQ ID NO: 218166 - DNA, 555 bp, Homo sapiens
  misc_feature: GYAE6OF02IVO81.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatggaaggttaacagtgatggcagccaacaccgaagggggacggatcctgattcgttttcgagggtcagctcgtgggctgagcgctacctcaccatctccagcctccagtcgtgaggtactggacgtctggacttattactgtcagaccgtggggctacgttggttattggttcgggttttcgggacgggtacggggtaaccgaacggtcgtacggtacccgttccgtacgggtaccgaccggtacccgaacgggtcccgtaccggtccccccgg

SEQ ID NO: 218167 - DNA, 554 bp, Homo sapiens
  misc_feature: GYAE6OF02HJSMR.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacgaccgaagggggacggactcccgtgattcgtttttcgagggtccagctcgtgggctgagcgctacctcaccatctccagcctccagtctgaggatgaggctgacttattacgtgtcacgaccgtggggcctacgttggttagttggttcgggttttcgggacgggtaacggggaccgtaaggtccgtacggacccggttaccgttagggtccaacggtaccccgaacggtccgtccggtccccccgg

SEQ ID NO: 218168 - DNA, 592 bp, Homo sapiens
  misc_feature: GYAE6OF02IQTRN.19.28.C06.1.454.CMB.1.raw
tcagtactctcgtgcacgaccggtgctcgatttagagctcacgtattgggtttggggagagctctgggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtgggcacagccaactacgccatcgcatggcatcagcagcagccagagaacgggccctcggtacttgatagaaggtaacagtgatggcagccacgaccggaaggggggacggactcccgtagtacgtttcgttttacgacgggtccaggtccgtcggtggggctcggacggccgcctaccctcaaccatcctcccgacgccctaccgacgtctggtacggatcggaggtctacgtacttaacttacgtgtacacggtaccggtggggctacggttggttagtgggttgggtttcgggacgggtagggaccgtaaggccgtacggtacccggtcgtaacgggtcgaacggcccgaacggtccgtccggtcccccgg

SEQ ID NO: 218169 - DNA, 511 bp, Homo sapiens
  misc_feature: GYAE6OF02GBQJN.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaagggggacggatcccgtgattcgtttttcagggtccagctcgtggggctggagcgctacctcaccatctccagcctccagtctgaggatgaggctgacttattactgtcagaccgtgggcacgttggttatggttggtttcggcggagggaccaagctcggaccgtcgtaggtcgacgcccgaaggtcctcgtcccccg

SEQ ID NO: 218170 - DNA, 576 bp, Homo sapiens
  misc_feature: GYAE6OF02JDMWC.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatggaaggttaacagtgatggcagccacgaccgaagggggacggatccctgacttcgttttcgagggtccagtctcgtgggctgagcgctacctcaccatcctccacgcctcagtcgtgagatggacggctgacttattacgtcgtcgacgtaccgtggggacctacgttggtttacgttgggttcggggttttcgggcgggtaacgggtaccgtaacggtcgtaccggtacccggttaccggtacgggttaccgaaccggccccggtaacgggtcccgtacccggtccccccgg

SEQ ID NO: 218171 - DNA, 891 bp, Homo sapiens
  misc_feature: GYAE6OF02HTM5T.19.28.C06.1.454.CMB.1.raw
  modified_base (432)..(432): a, c, t, g, unknown or other
  misc_feature (432)..(432): n is a, c, g, or t
tcagtactctcgtgcacgaccggtgctcgatttagagctcacgtattgggtttggggagagctctggggagtctgcaccatggcttggaccccactcctcttcctcacccctcccctcctacctacgtcgacacggtggtcctctccctaccgacgttcgttggtcgtcgtacgtacctaactacgtccccgtcccttcgtccgtccttcgtccgtccccttccgggtagggccgtcccggttaccggtaacgaacgtcctactacttccgtcgaccttaccttcggtaggaccgacggttagggtcggaccaacgacgaacctaaccgtacccgacctacgtccgactaggtcgaactacacgacgacgcgacgaccgacgaaggaacgggacccggtccgttacgttacgtagagtaaggttaacgtagnggtacgtaggtcggacgaccgacccgaacggtaaacggggggaacgggggaccgtccttccggtagtttaccggtttttccggttaacgggaccggtaccgacggttccgttacgggggtcgggtacgtagggccggtacccgttaccctacccgtaccgtaaccttccgttccccgaaccgtcccgttcccctaggtaccgttcggaacggggtaagttacggacgggtaccgtccgtaagttaaccgttttacgttaccgttacggaaccggtaccgggtaccggggtacggttaaccttcggggttttaaggtttcgggtttccgggggtttttacgggggtaccggggaacggggtaacccgtaacgtccgggttcggttaacccggttacccggttacgttaccgggacctacccggtaacccgggtcggttcccgtacccccggttaccccgg

SEQ ID NO: 218172 - DNA, 527 bp, Homo sapiens
  misc_feature: GYAE6OF02F8TUN.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatgaaggttaacagtgatggcagccacgaccgaagggggacggatcctgattcgttttcaggtccagctcgtgggctggagcgctacctcaccatctccacgcctccagtctgaggatgaggctgactattactgtcgagaccgtgggcacgttggttatggttggttttcgggcgggtacgggaaccgaaggcgtacggacccgttccgtacggtcgacggcccgaagggtcctccgtcccccgg

SEQ ID NO: 218173 - DNA, 543 bp, Homo sapiens
  misc_feature: GYAE6OF02HB3UW.19.28.C06.1.454.CMB.1.raw
  modified_base (383)..(383): a, c, t, g, unknown or other
  misc_feature (383)..(383): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatagaaggttaacagtgatggcagccacgaccgaagggggacggatcccgtgattcgttttcgagggtccagctcgtgggctggagcgctacctcaccatccnccacgccctccagtctagaggatgagctgactattacgtgtacagaccgtggggactacgttggttagtgttcgggtttcgggcgggtacgggtaaccaaggtccgtacggacccgttccgtacggtccaccggacccgaacggtccgtccgtcccccgg

SEQ ID NO: 218174 - DNA, 574 bp, Homo sapiens
  misc_feature: GYAE6OF02JFI4U.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctcgccctcccgtgggacgcctcggtcaagctcatctgcactctgagcaggtgggcacagcaactacgccatcgcatggcatcagcagcagccagaggaacgggccctcggtacttgataggaaggttaacaggtgagtggcagaccaacgaaccggaagggggacggactcccgtagtacttcggttttacgacgggtccagtctcggtgggctgacgcgctacctcaccactcctccgacgtcctccagtctaggacgatggagctagacttattacgtgtacgacgtaccgtgggcctaggttggttagttggttagggtttcgggacgggacgggaccgaacgtcgtacggtacccgttcgtacggccgacggacccgaaccggacccaacccgtaccg

SEQ ID NO: 218175 - DNA, 590 bp, Homo sapiens
  misc_feature: GYAE6OF02JB8TV.19.28.C06.1.454.CMB.1.raw
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
tcagtactctcgtgcacgaccggtgctcgatttagagctcacgtattgggtttggggtaggagctctggggaggtctgcaccatggcttggacccactcctcttcctcaccctcctcctccactgcacagggtctctctccagcttgtgctgactcaatcgccctctgcctctgcctccctgtgagccttcggtccaaagcctcatcgtgctactctgagccagtgggccacagcaaactacgccatcgcatggcatcagcagcagccagagaacggccctcggtactggactgaacggttangtgatggcagccacaccgaaggggacggattcccgngattcgttttacgagggtccaggctcgtacggggctggacgcgactaccntaaccngtctccagccctacngtcgtgacggtatggacgtctagtaccttagttacctcgtcgagtaccggtggggtcctacgttggttaagtcggtttacgggttttggggaccgggtaacggggtaaccaagggtcccgtacggtacccgttaccggtacggttccgaaccggttcccgaacgggtccttacccccggg

SEQ ID NO: 218176 - DNA, 542 bp, Homo sapiens
  misc_feature: GYAE6OF02H6RIC.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcgagtgggcacgagcaactacgccatcgcatggcatcagcagcagccagagaaggcccctcggtacttgatgaaggttaacagtgatggcagccacgaccgaagggggacggatcccgtgattcgtttttcgaggtccagctcgtggggctgagcgctacctcaccatctccagcctccagtctgagatgaggctgactattactgtcagtccgtgggcacgttggtagttggttggttttcgggcgggtacgggaccgtaaggtccgtacggtacccgttccgtacggtcgaaccggtaccccgaaggtcccgtacggtcccccccgg

SEQ ID NO: 218177 - DNA, 737 bp, Homo sapiens
  misc_feature: GYAE6OF02I0ZAV.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcagtgggcacagacaactacgccatcgcagtggcatcagcagcagaccaggagaacgggccctcggtacgttgagtggaaaggttaacagtgagtcggcacgaccaacgaaccggaaacggggggacgggtactcccgtagtacgttcggtttttacggacgggttaccgaacggtccgttccgggtacgggggtaccgttagggtaaccggtcccggtaccccgttaaacccttacccgaaacccgttactacccgttacccgaacggtaccccttacccgtaacggttaccgtacggtaagggtacgttacggacgggtaccttacggtacctttaacgtttaccgtacggtaccgtaacggtaaccggtcggggtacctaacggtttagggtttaacgttgggtttacggggttttcgggacggggtaaccgggtaaccggtaacggtcgtaccggtacccggtttaccggtacggtaccgtaaccggtaccccggaacggtcccgtacccgtcccccgg

SEQ ID NO: 218178 - DNA, 543 bp, Homo sapiens
  misc_feature: GYAE6OF02HUFAA.19.28.C06.1.454.CMB.1.raw
  modified_base (401)..(401): a, c, t, g, unknown or other
  misc_feature (401)..(401): n is a, c, g, or t
tcagtactctcgtgcacgaccggtgctcgatttagagctcacgtattgggtttggggagagctctggggagtctgcaccatggcttggacccccactcctcttcctcaccctcctcctccactgcacagggtctctctcccagcttgtgctgactcaatcaccctctgcctctgcctccctgggagcctcggtcaagctcatctgcactctgagaagtgggcacagcaactacgccatcgcatggcatcagcagcagccagaggaaggccctcggtactgatgaaggttaacagtgatggcagccacaccgaagggggacggactcccgtgacttcgttttcgacggtcagcgtcgtggggctggagcgactacctcgaccatcctccacgcctccagtcngtaggatgaggctgactattacgtgtcagtccgtgggctacgtggttatggtttggttcgggcggtacgggaccgaaggtccgtacggaccgttaccgtaggtccgacggacccgaaggtcccgtccgtccccccgtaccgg

SEQ ID NO: 218179 - DNA, 161 bp, Homo sapiens; identical to SEQ ID NO: 218075
  misc_feature: GYAE6OF02FGMXU.19.28.C06.1.454.CMB.1.raw
  modified_base (159)..(161): a, c, t, g, unknown or other
  misc_feature (159)..(161): n is a, c, g, or t

SEQ ID NO: 218180 - DNA, 557 bp, Homo sapiens
  misc_feature: GYAE6OF02FWY8N.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaagggggacggatccctgatcgtttttcgagggtccagctcgtggggctgacgcgctacctcaccatcctccacgccctccagtctaggaggatggacggctgacttattactgtcagaccgtggggactacgttggttagttggttcgggttttcgggacgggtacgggtaaccgaaggtccgtacggtacccgttccggtacggtccgaaccggacccgaacgggtccgtcccggtccccccgg

SEQ ID NO: 218181 - DNA, 665 bp, Homo sapiens
  misc_feature: GYAE6OF02IED6X.19.28.C06.1.454.CMB.1.raw
  modified_base (261)..(261): a, c, t, g, unknown or other
  misc_feature (261)..(261): n is a, c, g, or t
  modified_base (326)..(326): a, c, t, g, unknown or other
  misc_feature (326)..(326): n is a, c, g, or t
  modified_base (394)..(394): a, c, t, g, unknown or other
  misc_feature (394)..(394): n is a, c, g, or t
tcagtactctcgtgcacgaccggtgctcgatttagagctcacgtattgggtttggggagagctctggggagtctgcaccatggcttggaccccactcctcttccctccaccctcctcctccacgtagtcacgacggggtctcgtcgtaccgaggccttagtgctgactcaatccgccctctgcctctcgccctcccgtgggcgccttcggacaacgctcatcctgcaactcgtgagcaggtggcaacgagcaactcgccancgcagtggcatcagcagccagccagacgaacgggcccctcggtacttggataggtaacggttaangtagagtggcagaccgacgaaccggaagggggtacgctccgtagcgtttccgtttacggcggttaccncgtcgtcggtacggcgtacggcgccgtcctaccgtaccacctacgtcccgtaccgaccgtcccgtacgtacgtacgtaggtacggtagtacggtacgtacgtacgtaaccgtttagttaccgttacggaccgtacgggtaccgggtacgggtacttacggttaggtttcggttgggtttccgggttacgggacgggtacggtacgtacggtcggtaccggtacccgttggtacgtccggaccgtaccggtccggtccccgtcccgtacccg

SEQ ID NO: 218182 - DNA, 617 bp, Homo sapiens
  misc_feature: GYAE6OF02HLOMO.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcagtgggcacagcaactacgccatcgcatggcatcagcagcagccaggaagaacgggccctcggtacttggatggaaaggttaacaggtagagtggcagccaacgaaccgaaggggggacggactcccgtagtacgttcgtttttacgacgggtccaggtctcggtcggggtcgtggacgcgctacccgtacaccgtactcctaccgacgccttccagttcgtggaagggtagtacggaggtcgtagaacttattacgtcgtaccgaacggtaccggttcggggacttaacggttggttagttcggtttcggggttttacgggacgggtacgggtaaccgaggtcgtacggtacccgttcgtacggtaccaccggtacccgaaggtcccgtacgtacccccgg

SEQ ID NO: 218183 - DNA, 543 bp, Homo sapiens
  misc_feature: GYAE6OF02JCN9S.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctcggtacttgatgaaggttaacagtgatggcagccacaccgaagggggacggatccctgattcgttttcgagggtccagctcgtgggctgagcgctacctcaccatcctccagccctccagtctggaggatggagctgactagttactcgtcgacgaccgtggggctacgtcggttagtcggttggtttcgggcgggtacgggtaccaacggtcgttcggtacccgttccggtacggtccaccggacccgaacgggtccctccggtccccccgg

SEQ ID NO: 218184 - DNA, 603 bp, Homo sapiens
  misc_feature: GYAE6OF02JWGAI.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtactgataggaaggttaacagtgagtggcagccacgaccggaagggggacggactaccgtgacgttcgttttacgacgggtcagtcgtcgtagggcgtggagccgtctaccgtccacctactcctccacgtccctcacgtcgtaggacggtagtggacgtctagacgttattacgtcgtcgtacgaccggtcggggtactacggttacggttagtcgggtttcgggttttacgggccgggtaacgggtaaccggtaagtccgttaccggaacccggttccggtaacggtccgtaaccggcccgtaacgggtcccgtcccggtcccccgg

SEQ ID NO: 218185 - DNA, 532 bp, Homo sapiens
  misc_feature: GYAE6OF02IW63N.19.28.C06.1.454.CMB.1.raw
  modified_base (394)..(394): a, c, t, g, unknown or other
  misc_feature (394)..(394): n is a, c, g, or t
  modified_base (469)..(469): a, c, t, g, unknown or other
  misc_feature (469)..(469): n is a, c, g, or t
tcagtactctcgtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgccctccctgggagcctcggtcaagctcatctgcactctgagcagtgggcacagcaactacgccatcgcatggcatcagcagcagccagagaacgggccctcggtactgatggaaggttaacagtgatggcagccacgaccgaaggggacggatccgtgagttcgttttacgaggtcagctcgtgggctggagcgcctacctcaccactctccagcctacngtctggagagtagaggctagacttattacgtcgtacagtaccgtgggctacgtggttagtggttcggttttcggngggtacgggacaacggctcggtaccgttcgtacggtcacgacccgaaggcctccggtcccccg

SEQ ID NO: 218186 - DNA, 560 bp, Homo sapiens
  misc_feature: GYAE6OF02I5JEI.19.28.C06.1.454.CMB.1.raw
  modified_base (402)..(402): a, c, t, g, unknown or other
  misc_feature (402)..(402): n is a, c, g, or t
  modified_base (491)..(491): a, c, t, g, unknown or other
  misc_feature (491)..(491): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctccctgggacgcctcggtcaagctcatctgcactctgagcagtgggcacagcaactacgccatcgcatggcatcagcagcagccagagaacgggccctcggtacttgataggaaggttaacaggtgaagtggcagccaagaccgaagggggacgactcccgtagtacgttcgtttttacgacgggtcaggcgtacgtgggactggacgcgcctacctcacacgtcnccacgcctccacgtctggacgatgacggctagacttattaacgtcgacgacgtaccgtgggctacgttggttatgggttcgtttcgggnggtaacgggtacaacggcgtacggacccgtcgtacggtcacggtacccaacgggtccctcgtcccccgg

SEQ ID NO: 218187 - DNA, 671 bp, Homo sapiens
  misc_feature: GYAE6OF02I9DM5.19.28.C06.1.454.CMB.1.raw
  modified_base (185)..(185): a, c, t, g, unknown or other
  misc_feature (185)..(185): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggancctcggtcaagctcatctgcactctgagcagtgggcacagcaactacgccatcgcatggcatcagcagcagccagagaacggccctcggtactgatggaaggttaacagtgatggcacgccacgaccggaagggggacggactcccgtagtacgttcgttttcggacgggtccggtacttcggtggggctaggacgtccgtcgtaccctacgaccgtacttcgtacccgacgtccctaccgtacggtccgtaggtaacggtacgtggacggtccgttaacgtacgtttaacgtttaccgtggtacccgaacggtaccggtcggggtaccttacggtttcggttacgttgggtttcgggtttaccggggaccgggtaacggggtaaccgttacggaccgttaccgggtaacccgtttccgtaacgggtaccgtaacccgggtaccccggtaacggtccccggttaccccggtccccccgttaccggg

SEQ ID NO: 218188 - DNA, 737 bp, Homo sapiens
  misc_feature: GYAE6OF02IF69M.19.28.C06.1.454.CMB.1.raw
  modified_base (185)..(185): a, c, t, g, unknown or other
  misc_feature (185)..(185): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggancctcggtcaagctcatctgcactctgagaagtgggcacagcaactcgccatcgcatggcatcagcagcagccagagaacggtccctcggtacttgatggaaggttaacagtgagtggcacgccaacgaccggaagggggaccggactccccgtagtacgttccggtttttacgacgggttccacggtcgtcggtcgggggtctggacggtccgtccttaacccgtcctaaccctacgtcctacccgacggtccctaccgtacggttccgtcggaacgggtacgttacggggaacggtccgttacggtaaactttacgtttaaccgttcgtaccggaaccggtacccgggttgggggtacctacggtttacgggtttaatttccggggtttacggggtttttaccggggacggggttaaccgggtaacccggaaacgggttcccggttaaccgggttaacccccggtttaccggttaccggggtacccgtaaaccggtacccccggtaaacggggttccccgttaccccgggtacccccccgtttacccgggg

SEQ ID NO: 218189 - DNA, 577 bp, Homo sapiens
  misc_feature: GYAE6OF02G6429.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatgaaggttaacagtgatggcagccacgaccgaagggggacggactcccgtgacttcgttttcgagggtccagctcgtgggctgagcgctacctcaccatcctccgacgtccctccgacgtcgtaggaggagtggaggtctggaacttagttacgtcgtacacggtaccgtgggcctacgttggttaagttgggttcgggtttacgggacgggtaacgggtaaccgtaacggtccgtacggtacccggttacgtacgggtccgaccggacccggacggtccgtccggtacccccgg

SEQ ID NO: 218190 - DNA, 590 bp, Homo sapiens
  misc_feature: GYAE6OF02IMB85.19.28.C06.1.454.CMB.1.raw
tcagtactctcgtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagaggaacgggccctcggtacttgatggtaaggtaacagtgatggcagccacgaccgaagggggacggactccgtgacgttcgttttacgacgggtccgacgtactcggtaggggtctgggacgccgtcctaccctaccacctacgtcctccctacgccctacctacgtcgtggaggtagtaggacggactacgtacttattacgtagtcgacgtacggtcgggctagtggttagttgggttggttttcgggacgggtacgggaccgagtccgtacggtacccgtacgttacggaccgaccggacccgaacgggtccgtcccgtcccccgg

SEQ ID NO: 218191 - DNA, 552 bp, Homo sapiens
  misc_feature: GYAE6OF02GZSJN.19.28.C06.1.454.CMB.1.raw
tcagtactctcgtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggggacggactcccgtgattcgtttttcgacgggtccagcttcgtcggggctggagccgactaccctcaccatctcccagccctccagtcgtggaggatggagctgacttattactgtcagaccgtgggactacgttggttactgggttgggttttcgggcgggtacgggtaccgtaagtccgtacggacccgttccgtacggtccgacggtacccgaggtcctccgtccccccgg

SEQ ID NO: 218192 - DNA, 583 bp, Homo sapiens
  misc_feature: GYAE6OF02FZULK.19.28.C06.1.454.CMB.1.raw
  modified_base (391)..(391): a, c, t, g, unknown or other
  misc_feature (391)..(391): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacggccctcggtactgatgaaggttaacagtgagtggcagccaacgaccggaagggggacggactacccgtgtacgttcgtttttacgacgggtccagtcgtcgtgggctgacgcgtctacctcaccntcctcgacgccctcgacgtcgtggaggatggagtctagtactattactgtacacgtaccgtcgggtctacggttggttacgttgggtttcgggtttcgggacgggtacgggaacctaacggtccgttaccggacccgttaccgttacgggtccgaccggtaccccgaacgggtcccgtcccggtccccccgg

SEQ ID NO: 218193 - DNA, 559 bp, Homo sapiens
  misc_feature: GYAE6OF02GT5VZ.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatgaaggttaacagtgatggcagccacgaccgaagggggacggatccctgattcggttttacgacgggtccagctcgtgggctgagcgctacctcacctactcctccacgcctccgacgtcgtggaggtagtgaggctgtacttattactgtcgacgtaccgtgggctacgtgttagtggttcgggtttcggacgggtacgggaccgtaaggtccgtacggtacccgttaccggtacggtccgaaccggacccgaacggtcccgtaccggtcccccgg

SEQ ID NO: 218194 - DNA, 698 bp, Homo sapiens
  misc_feature: GYAE6OF02GO03L.19.28.C06.1.454.CMB.1.raw
tcagtactctcgtgcacgaccggtgctcgatttagagctcacgtattgggtttggggagagatctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatgaaggtaacagtgagtcggcacgaccacgaccggaagggggaccggacgtcccgtaggtactttcggtttttacgacggggtcctacggtccgttcggtggggaccttgggaacgtcccggtactacccgtaccgaaccctacgttcctcccgaacgtccccttaccgtacgttccgtagggtaacggacgtggacggtcttacggtaccttaatttaccgtcgttacgtacgggtaccgttacggggaccttacggttgggtttaacgttcgggtttacggggttttaccggggacggggtaacggggtaacccgtaacgggtaccggtaccggtaacccgggttaccggttaaccgggttccggtaacccggtaccccggaacgggttccccgtacccgggttacccccccgg

SEQ ID NO: 218195 - DNA, 606 bp, Homo sapiens
  misc_feature: GYAE6OF02G51RF.19.28.C06.1.454.CMB.1.raw
  modified_base (185)..(185): a, c, t, g, unknown or other
  misc_feature (185)..(185): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggancctcggtcaagctcatctgcactctgagcagtgggcacagcaactacgccatcgcatggcatcagcagcagccagaggaacgggccctcggtacttgagtggaacggttaacaggtgatggacagccaacgaaccggaagggggacggactcccgtgtacttcggtttttcgacgggtccagtcgtcgtggggctggacgcgctaccctccacctactcctcccacgtccctccacgttcgtggtacggagtggacgtctgtaacttattactgtacgacgtccgtgggacttacgttggttagttggtttcgggttttacgggacgggtacgggaaccgtaacggtccggtacggtaccccggttcggtaacggtccgtaccggaccccggtaacggtcccggtccccgttaccccccgg

SEQ ID NO: 218196 - DNA, 685 bp, Homo sapiens
  misc_feature: GYAE6OF02IK878.19.28.C06.1.454.CMB.1.raw
tcagtactctcgtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatccgccctctgcctctcgcctcccgtgggacgcctcggtcaagctcatctgcactctgacgcaggtgggcacagcaactacgccatcgcatggcatcagcagcacgcagaggaacggccctcggtacttgagtaggaaggttaacagtgagtggcacgccacgaaccggaagggggacggactccgtagacgtttcgttttcgacggtccagtcgtcggtgggctagacgcgactccgtacacctactcctccacgtccctaccgtacggttcgtacgggacggtagtacgggacggtacgttacgtaactttacgtttaccgttacggttaccgaaccgggttaccgggtacggggtaccttaacgggtttacgggttttacggttttggggtttaccggggttttaccggggacgggggtaaccgggtaacccgtaagggtcccggttacgggtacccggtttaccggtaacgggttaccgtacccgggaacccggtaacggtcccgtcccggttaccccccggg

SEQ ID NO: 218197 - DNA, 603 bp, Homo sapiens
  misc_feature: GYAE6OF02GTOZ1.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggcagtcggtacttgatgaagttacagtgatgcagccaacaccgaaggggacggactcccgtgactttcggttttacgacgggtccagtcgtacggtggggtctgacgcgcctacctcacctagtcctaccacgtccctaccgagttccgtaggaggtatcggaggtctacggtaacttagttacgtcggtacgaacggtaccgtggggtacctacgtttgggttagttcgggtttacgggttttcgggacgggtaacgggtaacctaagggtccgttaaccggtacccgttaccgttacgggtacccgacggtaccccgtagggtcccgtaccccggg

SEQ ID NO: 218198 - DNA, 664 bp, Homo sapiens
  misc_feature: GYAE6OF02HDDCN.19.28.C06.1.454.CMB.1.raw
  modified_base (293)..(293): a, c, t, g, unknown or other
  misc_feature (293)..(293): n is a, c, g, or t
tcagtactctcgtgcacgaccggtgctcgatttagagctcacgtattggggtttggggagagctctggggagtctgcaccatggcttggaccccactcctcttcctcaccctcctcctccactgcacagggtctctctcccagcttgtgctgactcaatcgccctctgcctctgccctcccgtgggacgcctcggtcaagctcatctgcactctgagcagtgggcacagcaactacgcatcgcatggcatcagcagcagcagaggaacggccctcggtactgatagaagtacngtgagtgacagaccaacgacggaacgggggacggactccgtgtacgtttcgttttcgacgggtaccaggtccgttcgggtaggggtcctagggaccggtcgtacccttacccgtaccaaccgtactcccgtacccaaccgtccctaccgacggttccgtaggaacggtactacggacggtcttacggtaacctttagttacgtacggttacgaacggtaccggtcggggtaccttacgggtttacggtttacgttcgggtttaccggggtttcggggaccgggtaacggggtaccgtaacggtcgttaaccgggtacccgttacggtaccggtaccgaccggaacccgtacgggtccctccggtcccccgg

SEQ ID NO: 218199 - DNA, 575 bp, Homo sapiens
  misc_feature: GYAE6OF02FPPWG.19.28.C06.1.454.CMB.1.raw
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactaccgccatcgcatggcatcagcagcagccagacggaaggccctcggtactggatagaaggtaacaggtgagtggcagcctacgaccggaagggggacggacgtcccgtgtactccggttttacgacgggtccagtcgtacgtggggtctggacgcgtctaccncaccntccnccacgtcctacacgtcgtagacggatgacgtctacgtactattacgtgtaccaggtaccgtagggtctacgttggttacgtgggtttggtttacggacgggtaacggtacaacgtcgtaccggtaccgttacgtacgtacgacccggacccgtacggtcctcccggtcccccgg

SEQ ID NO: 218200 - DNA, 638 bp, Homo sapiens
  misc_feature: GYAE6OF02IBCZ3.19.28.C06.1.454.CMB.1.raw
  modified_base (185)..(185): a, c, t, g, unknown or other
  misc_feature (185)..(185): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggancctcggtcaagctcatctgcactctgatcagtgggcacagcaactacgccatcgcatggcatcagcagcagccaggagaacggccctcggtacttgataggaagttaacgagtgagtggcacgaccacgaaccggaagggggacggactccgtgtacgtttcgttttcgacggtccagtcgtcggtcggggtctaggacgccgtcctaccctacacctactccctcgaccgtccctaccgtacggttcgtaggaacggtagttacggacggttccgttaaggtaactttaacgttacgtcggttaccacgggtaccggtgggaccttagggttggttaagttcgggtttgggtttaccgggacggggtaacgggaaccgtaaggtccggttaccggtaccgttcggtaacggtccgaaccgtacccggaacggtccccgtccgtaccccccgg

SEQ ID NO: 218201 - DNA, 561 bp, Homo sapiens
  misc_feature: GYAE6OF02HT0X1.19.28.C06.1.454.CMB.1.raw
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatgcatcagcagcagccagagaacggccctacggtacttgagtagaagttaacagtagatggacagccaacgaccggaagggggacggactccgtgtacgttcgttttacgaggtccagtctcgtgggctgagcgctacctcaccntcctcacgcctcagtctaggagtgngagtctanactattacgtgtacgacgtaccgtagggactacgttggttagttggttcgggtttacggcgggacggaaccgtaacggcgttacggacccgtaccgtacggtaccgaccggtacccggaaggtcccgtcccggtacccccgg

SEQ ID NO: 218202 - DNA, 751 bp, Homo sapiens
  misc_feature: GYAE6OF02IJ7LD.19.28.C06.1.454.CMB.1.raw
  modified_base (298)..(298): a, c, t, g, unknown or other
  misc_feature (298)..(298): n is a, c, g, or t
tcagtactctcgtgcacgaccggtgctcgatttagagctcacgtattggggtttggggagagctctgggggagtctgcaccatggcttggaccccactcctcttcctcaccctcctcctccactgcacagggtctctctcccagcttgtgctgactcaatccgcctctgcctctgcctccctgggcgcctcggtcaagctcatctgcactctgagcagtggcacagcaactacgccatcgcatggcatcagcagcagccagagaacggccctcggtacttgataggaaaggttaacgngtagagtggcacgaccgaaccgaaccggaaaggggggaccgggtactacccgtagtacgtttccggtttttacggacgggttccacggtccgttcgggtcggggtcgtagggacggccggtacccgtaccctaccgaaccctaacgtcccgttaccgtaccggtcccttacccgtacggttccgtaagggaacgggtacgtcgggaacggtccgttacgtaactttaccgtttaacgttacggttaaccgtaacgggtacccgggttacgggggtacccttaaccgggtttaggggtttttaacggttcggggttttaccgggggtttttaccgggggaccggggttaaccggggtaacccgtaacgggtcccggttacggtacccggttaccggttacgggtaccggtaccggtaaccccggtaacgggtcccgtacccgggttccccccgg

SEQ ID NO: 218203 - DNA, 631 bp, Homo sapiens
  misc_feature: GYAE6OF02HS1P1.19.28.C06.1.454.CMB.1.raw
  modified_base (185)..(185): a, c, t, g, unknown or other
  misc_feature (185)..(185): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggancctcggtcaagcctcatctgcactctgagcaggtcgggactacagctaactacgccagtcgcagtggcagtcagccagcacgccagacggaacggccctggtacttgatgaagttacagtgatggcagccagaccggtaaggggacgtactccgtagtacttcggttttacgacggtcctagccgttcgtcgggtctacggacgtccgtacgtacccgtcgaaccctagttccgtaccgtacgcccgttacgacgttcgtaggacggtacgtggaccggtctaacgtaccgttaagttccgtagtaccgacgtaaccgtgggtacctacggttaggttaacgtcggttacgggtttcgggaccggtagggtaacccacgggttacgtcggtacccggtgtacggtaccgtaccggaccggtaacggtccgtaacccgttccccggg

SEQ ID NO: 218204 - DNA, 657 bp, Homo sapiens
  misc_feature: GYAE6OF02IA9DG.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcaggtgggcacagcaactacgccatcgcatggcatcagcagcagccaggacgaaggcccctcggtacttggatagaaggttaacagtgatcggcacgccacgacggaagggggacggactcccgtagagttccgttttcgacgggtccaggtccttcggtaggggtctaggtacggccgtaccgtaccgtcctaacctactccgtaccgacggtccctaccgtgtcgtacggacggtacgtagggacgtcgtacgtaacttagttactacggtaccacggtaccggtcggggtacttacggttaggtttaacgttcgggtttacgggttttccggggaccggggtacggtaaccggtaacggtccgttaccgggtaacccggttaccgttacgggtccgtaaccggaccccggtaacgggtcccgtacccggttaccccccgg

SEQ ID NO: 218205 - DNA, 661 bp, Homo sapiens
  misc_feature: GYAE6OF02IVYGQ.19.28.C06.1.454.CMB.1.raw
  modified_base (149)..(149): a, c, t, g, unknown or other
  misc_feature (149)..(149): n is a, c, g, or t
  modified_base (189)..(189): a, c, t, g, unknown or other
  misc_feature (189)..(189): n is a, c, g, or t
tcagtactctcgtgcacgaccggtgctcgatttagagctcacgtattgggtttgggggagagctctgggggagtctgcaccatggcttggaccccactcctcttcctcaccctcctcctccactgcacagggtctctctcccagcttgngctgactcaatcgccctctgcctctgccctccctgggacncctcggtacaagctcatctgccactctgagcaggtggaacacgagaccaactacgccatcgcatgcatcagcagcacgaccgagacggaacgggccctacggtacttggagtaggtaaacggttaacagtagaacgtggacacgacccaacgaaccggaaaggggggaccggtactacccgtgtacgttcggttttacgacggtccagtcgtcgtcggggctaggacgccgtacctaccaccgacctactccctaccgacgtccctaccgtagtaccgtagggaacggtagtacggacgtcgtacggtaacttaacttacgtcgtaccgacgtaccggtacgggtcctacggttaggttacgttcgggtttcgggtttacgggaccgggtacgggaaccgtaacggtccggtaccggttaccgtacggtacggtccgaccggtacccggacggtcccgtacccgtaccccgg

SEQ ID NO: 218206 - DNA, 582 bp, Homo sapiens
  misc_feature: GYAE6OF02FSMK7.19.28.C06.1.454.CMB.1.raw
  modified_base (386)..(386): a, c, t, g, unknown or other
  misc_feature (386)..(386): n is a, c, g, or t
  modified_base (569)..(569): a, c, t, g, unknown or other
  misc_feature (569)..(569): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagacggccctcggtactgatagaaggtacagtgatggacacgccaacgaccggaagggggacggactcccgtagtacttcggttttacgacgggtccagtcgtcgtggggctgacgcgacctaccncaccactcctaccgacgtccctaccgacgtcgtaggacggatacggacggtctagtactattacgtcgtacgacgtccggtagggcctacgttggttagtgggttcgggtttcgggacgggtacgggtactaacggtcgtaccggtaccgtaccgtacggccgtaccggacccgaacggtccncccggtcccccgg

SEQ ID NO: 218207 - DNA, 698 bp, Homo sapiens
  misc_feature: GYAE6OF02GBH7B.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagccaactacgccatcgcatggcatcagcagcagccagaggacgggccctcggtacttgatagaaggtaacaggtgagtggacgacgaccaacgaaccggaacggggggacggtacgtcccgtaggtacgtttccggtttttacgacgggttaccacggtcgttcggtcggggtctaggacggtcgtaccgttacccgtaccctaaccgtacttcccgtacccgacgtccccttaccgacgttccgtaggtaacggtagtcggacggcgttacggtacttaacgttacgtacgtacgtaaccgtaccggttcggggaccttacggttggtttaacgttggggttttacggggttttccgggacggggtaacgggtaaccggtaacggtccggttaccggtaacccggttacccggttacgggtacccgtaacccggacccggtaaccgggttcccgtaccccggttaccccccgg

SEQ ID NO: 218208 - DNA, 609 bp, Homo sapiens
  misc_feature: GYAE6OF02GG5UG.19.28.C06.1.454.CMB.1.raw
  modified_base (194)..(194): a, c, t, g, unknown or other
  misc_feature (194)..(194): n is a, c, g, or t
  modified_base (449)..(449): a, c, t, g, unknown or other
  misc_feature (449)..(449): n is a, c, g, or t
tcagtactctcgtgcacgaccggtgctcgatttagagctcacgtattgggtttgggagagctctggggagtctgcaccactgggcttggaccccactcctcgttcctcgacccctcctcctccactcgcacaggtctctctccagcttgtgctgactcaatcgccctctgccctctcgaccctcccgtgggacncctcggtaccaaaggcctcgatcgtgccactcgtgagtcaggtcggcacgagaccaaactacgccatcgcagtggcatcagcagtcacgccagagacggccctcggtactgagtggaacggttaacgaggtgacgtggctacgccgaaccgaccgaagggggacggactcccgtgtacgttcgttttacgacggtaccgagcgtcggcgggctgacgtcgcctaccgtcgaccgagtccgtaccacgcccgtacncgtcgtggaacgtgtgacggctacgacttacgtacgtggtccagaccgtcgggtactacgtaggttatcggttacggtttcgacggtacgggtaccacggtctacggtaccgtacggtacggtacgaccggtacccgtaacggtccgtaccgtaccccgg

SEQ ID NO: 218209 - DNA, 586 bp, Homo sapiens
  misc_feature: GYAE6OF02H5J9R.19.28.C06.1.454.CMB.1.raw
  modified_base (384)..(384): a, c, t, g, unknown or other
  misc_feature (384)..(384): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgataggaaggttaacagtgatggcacgccaacgacggaagggggacggactccgtgattcgttttcgaggtccagtctcgtgggctggacgcgctacctcacctntcctcacgtcctccgagttcctaggacggtactaggacggtctacgaacttagttacgtacgtacgacggtaccggtcggggtctacggttgtttagttgggtttcgggtttcggggtcgggtacgggtaacggtacgtacgtccggtaccgttcccgttacgggtaccgtaccggacccgaacggtccgtccggtcccccg

SEQ ID NO: 218210 - DNA, 745 bp, Homo sapiens
  misc_feature: GYAE6OF02GKCH6.19.28.C06.1.454.CMB.1.raw
  modified_base (167)..(167): a, c, t, g, unknown or other
  misc_feature (167)..(167): n is a, c, g, or t
  modified_base (185)..(185): a, c, t, g, unknown or other
  misc_feature (185)..(185): n is a, c, g, or t
  modified_base (211)..(211): a, c, t, g, unknown or other
  misc_feature (211)..(211): n is a, c, g, or t
tcagtactctcgtgcacgaccggtgctcgatttagagctcacgtattggggttttgggggacgacgctctggggaagtactgcaaccgatcggcttgggtacccccactccctcttcctcacccgtcctcctccacctgcacgacgggtctctcgtcccagcttgtnctgactccaatcgccctntggcccttcgtgccctccctgggacnccctcggtcaagctcatcgtgccacctctgagctaggttcgggcacgcgtcgaacgtccgccatccgcgagtggcgatcagtcagtcagccagagaacgggtcccgtcgggttaccttgtagtacggtaacggttaactacgtgaagtggtccgacggtcccaaccgaaccggaaagggggtaccggtaccgtcccgtacggacgtttccgtttttacgacgggtacctacgtcgtttccggtggggtactcggacgccgtaccttacccgtcgacccgtacgtccgtaccgacgtcccgttacccgtagttccgtggaggacgttacggaacggtccgtacgtaacctttaacgtttacgttcggtttacgaccggttaccggttacggggtaccttaaccggttacggtttacgttacgggtttcggggtttaccggggaccgggtaacgggtaaccccgaggtccgtaacggtacccgttaccggttacggtcccgaccggtacccgaacggtccgtcccgtaccccccgg

SEQ ID NO: 218211 - DNA, 639 bp, Homo sapiens
  misc_feature: GYAE6OF02HVLEM.19.28.C06.1.454.CMB.1.raw
tcagtactctcgtgcacgaccggtgctcgatttagagctcacgtattgggtttggggagagctctgggggagtctgcaccatggcttggaccccactcctcttcctcaccctcctcctccactgcaaacagggtctctctcccagcttgtgctgactcaatccgccctctgcctctgccctcccgtgggagcctcggtcaagctcatctgcactctgagcaggtgggacacagcaactacgccatcgcatggcatcagcagcagcaggaggaacggccctacggtacttgatagaaaggttaacaggtgtagtggacacgacccaacgaaccgggaaaggggggaccggtaactcccgtagtaacgtttcggtttttcgagggttccagtcgttacggtggggctcggacgtccgaccttacccgtacaccgtactccgtccacgtccctccgaggtcgtagacggactaggacggctagtacttagttaccgtgtaccgaacgaccggtcggggtaccttaacggtggttaacgttgggttcgggtttacgggaccgggtacgggtaccaacggtcgtaccggtacccgtccgtacggtaccgacggtacccgtaagggtccctacccggtaccccgg

SEQ ID NO: 218212 - DNA, 535 bp, Homo sapiens
  misc_feature: GYAE6OF02I01TP.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggtcctcggtacttgatgaaggttaacagtgatggcagccacgaccgaagggggacggatcccgtgattcgttttcgagggtccagcgtcgtgggctgagcgctacctcaccatctccacgcctccgagtctaggagatggacggtctgtactattactgtcagtccgtgggctacgttggttagtggttgggtttcggacgggtacgggaccgaggtcgtacggtaccgtcgtacggtccgacgcccgaacggtcctaccggtcccccg

SEQ ID NO: 218213 - DNA, 544 bp, Homo sapiens
  misc_feature: GYAE6OF02FGOXN.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagagggccctcggtacttgatgaaggtaacagtgatggcagccacgacgaaggggacggatcctgacttcgttttcgacgggtcagtctcgtgggctgacgcgctactcaccatcctccacgtcctccagtcgtagaggatggacgctagacttagttacgtgtcacgtccgtgggactacgttaggttagttggttgggttttacggcgggtacgggtaacgacgtcgtacgtacccgtcgtacggtacctaccggacccgaacggtcctaccggtcccccgg

SEQ ID NO: 218214 - DNA, 646 bp, Homo sapiens
  misc_feature: GYAE6OF02IOJAY.19.28.C06.1.454.CMB.1.raw
  modified_base (188)..(188): a, c, t, g, unknown or other
  misc_feature (188)..(188): n is a, c, g, or t
tcagtactctcgtgcacgaccggtgctcgatttagagctcacgtattggggtttggggagagctctgggggagtctgcaccatggcttggaccccactcctcttcctcaccctcctcctccactgcacagggtctctctcccagcttgtgctgactcaatcgccctctgcctctgcctccctgggacncctcggtcaagctcatctgcactctgagcagtgggcacagaccaactacgccatcgcatggcactcacgcacgcacgacagaggaacggggccctacggtacgttggataggtaaggttaacagtgagtggcacgacacgaaccggaagggggacggactccgtagtacgttcgttttacgacgggtctacgtcgtcggtgggtctcggacgacggtcctacccgtacacccgtactccgtccgacgcccgttaccgtacgttcgtagggtaacggtagtacggtacggtacttacggtaccttagttaccgtcggtaccgtacggacggtgggaccttgtttagggttacttggggttcgggtttcggggacggggtaccggtaacgaacggtcgtacgggtaccgttcggtaacggtacgtaccggaccggtaacggcccgttccgtacccccggg

SEQ ID NO: 218215 - DNA, 662 bp, Homo sapiens
  misc_feature: GYAE6OF02GLRB9.19.28.C06.1.454.CMB.1.raw
  modified_base (420)..(420): a, c, t, g, unknown or other
  misc_feature (420)..(420): n is a, c, g, or t
  modified_base (490)..(490): a, c, t, g, unknown or other
  misc_feature (490)..(490): n is a, c, g, or t
tcagtactctcgtgcacgaccggtgctcgatttagagctcacgtattgggtttgggggaggagctctggggagtctgcaccatggcttggacccactcctcttcctcaccctcctcctccactgcacagggtctctctcccagcttgtgctgactcaatcgccctctcgcctctcgcctcccgtggggacgccgtcgtcgaagtctcatctgcactcgtgagcgaggtcgggacacgtacgacaacctaccgccagtccgacagtcggacatacagccaggcacgaccgagagggaaccgggcccttacggttactggataggaaacggttaacgagtacgagtcggacgacgacccaacgaccggaaggggggacgacgtcccgtagtagtttcgtttacggaggttccagtcggtcgnggggtctaggacgccgaccttaccgccaaccgtagtcccgtcacggtccctcacgttcgtaggagtacgnggaacgcttacgacttagtccgtgtacccgaagtccgggtggaccgttattagggtttagtcggggttagggtttccggaacggtaacgggtaccaacggtcggtacccgtaaccggttaccgacggttaccgaaccggaccccggttaagccccggtacccgttccccggg

SEQ ID NO: 218216 - DNA, 775 bp, Homo sapiens
  misc_feature: GYAE6OF02HS7LL.19.28.C06.1.454.CMB.1.raw
  modified_base (167)..(167): a, c, t, g, unknown or other
  misc_feature (167)..(167): n is a, c, g, or t
tcagtactctcgtgcacgaccggtgctcgatttagagctcacgtattgggtttggggagagctctggggagtctgcaccatggcttggaccccactcctccttcctccaccctcctcctccactgcacaggtctctctcccagcttgtgctgactcaatccgccctntcgccctctcgccctcccgtaggggacgcctcggtacaaagtcctacatctgacactcgtgaacgcgaggtcgggccaacacgacctaaacctacgcctatcgcagtggcaatcagcagcagccaaggaagaacggcccgtacgtacgttagatagaaaggttaacaggtagagtcggacacggaccaaccgaaccgggaaaacggggggaacggacgttacccgtacggtagtttaccggttttttacgacggggttaccgacgtccgtttccggtcgggggtctacgggaacgccggtacctacccctaccgtaaacccaactccgttacccgaacgtccccgttaaccgtacggttaccgttacggaacgggtaagtacggtacgggtctacggtaactttaaagttaaccgttaccggttacgaaccggtacggtaccgggggaccttaaccggttaggtttaaccggtttgggtttacgggttttaccgggggaccgggtaacggggtaaacccgtaacggtacggtaccggtaaccccggttacggttaaccggtccgaaccgtaccccgggtaacgtcccggtaccccggttcccccccgg

SEQ ID NO: 218217 - DNA, 597 bp, Homo sapiens
  misc_feature: GYAE6OF02ISUBB.19.28.C06.1.454.CMB.1.raw
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacgcctcggtcaagctacatctgcactctgagcagtgggcacagccaactacgccatcgcatggcatcagcagcagccagaggaacggcccgtcggtactgatggaaggttaacagtgatggcagaccacgacgaaggggacggatccgtgattcgttttacgaggtccagtcgtcgngggctgagcnctacctcacntccaccacgccctcgagtccgtaggacgtagtcggacggtactaggtaaccttaattaccgtggtaccacgggtaccggtcggggaccttacggttcggtttaagtcgggtttacgggttttccgggacgggtacggaacccgtaaggtccggtacgtacccggttaccgtacggtaccgaccggacccgtacggtccgtacccggtaccccccgg

SEQ ID NO: 218218 - DNA, 630 bp, Homo sapiens
  misc_feature: GYAE6OF02J1OD8.19.28.C06.1.454.CMB.1.raw
  modified_base (251)..(251): a, c, t, g, unknown or other
  misc_feature (251)..(251): n is a, c, g, or t
tcagtactctcgtgcacgaccggtgctcgatttagagctcacgtattgggtttgggggagagctctggggagtctacaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcancagcagccagagaacggccctcggtacttgatagaaggttaacagtgatggcacgaccacgaccggaagggggacggactcccgtagtacgtttcggttttacgacggggttacacggtccgtacggtcgggggacttagggaaccggtccgtaccgttacccgtaccaacccgtactcccgtaccgacgtcccgtacctacggtccgtaggagggtaactgggacgggtactagtacttacttacgtcgtacacggtaccggtgggactacgttggttacgtggtttcgggttaccggcgggtaacggtaaccgtagccgttacgacccggttacgtacggtacacggacccgtacggcgttcccggccccgttacgg

SEQ ID NO: 218219 - DNA, 652 bp, Homo sapiens
  misc_feature: GYAE6OF02HBI79.19.28.C06.1.454.CMB.1.raw
tcagtactctcgtgcacgaccggtgctcgatttagagctcacgtattggggtttgggggagagctctgggggagtctgcaccatggcttggaccccactcctcttcctcaccctcctcctccactgcacagggtctctctcccagcttgtgctgactcaatccgccctctgcctctgccctcccgtgggacgcctcggtcaagctcatctgcactctgagcaggtgggcacagcaactacgccatcgcatggcatcagcagcagccaggaagaacgggtccctcggtacttgagtagtaacggttaacaggtgacgtaggacacgacccaaccgaaccgggaaggggggaccggtacgtcccgtgtacgtttcggttttacgacgggtccgagtcgttcgggtgggtcgtggacgccggtcctacctaccaccgtaactccgtaccgtaccgcccttaccgaacgttcgacggacggtagtagggacgtcgttactaccgttaacttcggtacgtaccgtacgggtaccgggtcgggtaacgttacggtttaggttagtttcggggtttcgggttacgggacgggtacggaaccgtaggtcgtacgtaccgtacgtacggtaccaccgaccggtacgtccgtcccgtcccgg

SEQ ID NO: 218220 - DNA, 603 bp, Homo sapiens
  misc_feature: GYAE6OF02F2551.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcagtggcacagcaactacgccatcgcatggcatcagcagcagccagaggaacggccctcggtactgatagaaggtaacagtgagtggcagaccaacgaaccggaaagggggacggactccgtagtacttcggttttacgacgggtccacgtcgtcgtcggggctggacgccgacctacccgtcaccactcctccacgtccctccgagtccgtaggacggagtcggacggtctaggtaacttaacgttacgtagtaccgacggtaccgtcggggaccttacggtggtttagtgggttgggtttcgggacggtacgggaaccgtaacgcgtacggtaaccgttccgtacggtccgaaccggtacccgaacggtccgtaccggtacccccgg

SEQ ID NO: 218221 - DNA, 685 bp, Homo sapiens
  misc_feature: GYAE6OF02HZLHF.19.28.C06.1.454.CMB.1.raw
tcagtactctcgtgcacgaccggtgctcgatttagagctcacgtattgggtttggggagagctctggggagtctgcaccatggcttggacccccactcctcttcctcaccctcctcctccactgcacagggtctctctcccagcttgtgctgactcaatcgccctctgcctctcgcctcccgtgggacgcctcggtcaagctcatctgcactctgagcaggtggcacagcaactacgcatcgcatggcatcagcagcagccagagaacggcctcggtacttgataggtaaaggtaacaggtgagtcggacgacgaccgaacgaaccgggaaacggggggaacggtactcccgtagtaacgtttccgtttttacgacgggttaccacgtcgttcggtacgggggctacgggacggtcccgtaccgtaccccgtaccgaccctaactccgtacccgacgtcccgtacgacgtccgtaggacggtattcggaacggtcgttacgaacttacgttacgttacggtactaacggtaccgggtacggggtacctacggttacggttagttcgggtttcggggttttacgggacgggtaacgggtaaccgtaggtacggtaccggtacccggttaccggttacggtacccggaaccgtacccggtaacggttcccgtcccggtacccccggg

SEQ ID NO: 218222 - DNA, 793 bp, Homo sapiens
  misc_feature: GYAE6OF02I9NCQ.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgccctcccgtggggacgtcctcggtcaagctcatctgcactctgacgcaggtgggcacacgcaactaccgccactcgcagtcggcactcacgcacgcacgccgaagaacggaacgggtccccgtacggtacttggaactagggtaaaggtttaaacgaggttacggaacgtcgggaccgacggacccgaaccggaaccggggaaacggggggaccgggtaaccgtcccgtacggtacgttttaccggtttttaccggaacggggttccaacggtccgttccgggtcgggggtaccgttacgggacggtcccgtacccgttaccccgtaccgtaacccgtccgtcccgttacccgccggttaccccttaaccggttaggtccggttacgggaacgggtacgttacgggaaccggtcgttaccgtaacgtttaacgtttacgtacggttaccgaacgggtacccggttagggggaccttaacggtttacgggtttacgttcggggttttcggggtttaccgggacggggaacggtaccggtaacggttcgttaaccgggtacccggttaccggtacgtaccggaccggtacccgtaacggggtccctccccgggttacccgg

SEQ ID NO: 218223 - DNA, 670 bp, Homo sapiens
  misc_feature: GYAE6OF02HALAA.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctgccctcccgtgggagccctcggtcaagctcatctgcactctgagcaggtgggcacgagacaactacgccatcgcatggcactcagcagcagccgaggaacggaacgggtccccgtcggtacttggagtaggtaaaggttaaacgaggttaggagtcggacgacgacccgaacgaaccgggaaaggggggaccggtactcccgtaggtacgtttccggttttacgacggggttacacggtccgttcgggtcggggtctacgggacggcccgtcccttaacccgtccgtaaccctacgtccctcccgaccgtcccgtacccgtaggtccgtaggaacggtagtacggacggtctagtacgttacttacgtacgtaccggtacgtacggtacgggacttacggttaggttgttgggttacgggttcgggacgggtacggacgtacgtacgtcgtaccgttcgttacgccgtaccggaccgacggtcccgtccgtccccgg

SEQ ID NO: 218224 - DNA, 710 bp, Homo sapiens
  misc_feature: GYAE6OF02H6H2Q.19.28.C06.1.454.CMB.1.raw
  modified_base (172)..(172): a, c, t, g, unknown or other
  misc_feature (172)..(172): n is a, c, g, or t
  modified_base (254)..(254): a, c, t, g, unknown or other
  misc_feature (254)..(254): n is a, c, g, or t
  modified_base (334)..(334): a, c, t, g, unknown or other
  misc_feature (334)..(334): n is a, c, g, or t
  modified_base (390)..(390): a, c, t, g, unknown or other
  misc_feature (390)..(390): n is a, c, g, or t
tcagtactctcgtgcacgaccggtgctcgatttagagctcacgtattgggtttggggagagctctggggagtctgcaccatggcttggaccccactcctcttccctccaccctcctcctcactcgcacgcgggtctcgtctacccgagcttgtgctgactcaatccgccctntgcctctcgccctcccgtgggcgctcggtacaagctcatctgcctatctgacggcaggtgggcaactacacaaacctcgcancgcagtggccatcagccagacacggccaggagtaaggtcccctaggttaacttggataaggtaacgttaacgagttagcngggactagcccaggaaccggtaaggggggacctcggtactgacgtttcggtttacncggggtactccgtgtcggtcgggttcagggtacgcccggtactaacctccgtacctaacgtccctaccgtccgtcccttagtaacggtccgttgggaaccgagttagggaccgttagccggtaaccttaaggttttcgacggttaaccgtaaacgggcccggttaggggaccccgtttaaggttcggttaacggttcgggttttaacggggttccggggaacggggtacccggttacgaaacggtccggttacggttaacccgcggtttaacgggccgtaaaccggttccgaaacccggtttcgtcccggtaacccccgg

SEQ ID NO: 218225 - DNA, 746 bp, Homo sapiens
  misc_feature: GYAE6OF02FW0B5.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacgagggtctctctccgagtcttgtgctgtactacaacgtccgtcctctcgcctctcgtcccttccgtgggactccgtcggtacaacgtctactatcgtcgactactcgtagacgtcgtaagggtcggaccaacgtacgaacctaaaccgtaccgacctacgtccgtaacagttcggactacgtacgacgacgacgacgacgacgaaggaacgggtaccgggtacccggttacggttaacgttaggaacgtaaggtaaacggttaacgtaggtacgtacggtacgaccgacgaaccgaaccggaaccgggtaacggggaccgtacgttccgtagttaccgtttacggtttacggacggtctacggtcgttcggtacggggctcggacgtccgtaccgtaccgacctacgtctaccgtccgtaccgtccgtacgtacgtcgtaagggtcgtacgtacgggtactacgttaacgtacgttacgtacgtcgtacgtaccggtacggtacggtacttacgggttcggttaggtcgggtttacggtacgggacggtacggtactacggtccggacggttaacgtcgtacggccgtaaccggtaccggtcggtcccgtacccggtccg

SEQ ID NO: 218226 - DNA, 774 bp, Homo sapiens
  misc_feature: GYAE6OF02JMBGI.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtacaagctcatctgcactctagagccaggtgggccacagcaacgtaccgccatcgcatggcatcagcacgcaacgagaggaacggtcccgtcggtaccgtgtagtaggtaacgttaacgacgtagagtcggacgacgccgtaaccgaaccggaaacgggggaccgggtaaccttcccgtaggtacgttaccggtttttcggtaacgggtaccgtaaggtccgtacgggttcggggaccgttaggacgggacccgtccttaaccgtaccctaacctacgttacccgtacccgtaccgtacccgttcccgtaacggtttccgtaacggtagggaacgttacgggtaacggtcccggtaagttaaccgtacgtttaaccgtacggtccgtaacgggtccggtaccgggttacggttaccgttaaggggtttacgtttcgggttaccggggtttttaccgggacggggttaccgggtaaccggtaacggttcggttacccggttacgggttacccgtttaacggggtaccgaacccggttacccgggtaaaccggtcccggttacccggtcccccggtttacccggg

SEQ ID NO: 218227 - DNA, 756 bp, Homo sapiens
  misc_feature: GYAE6OF02FEQ26.19.28.C06.1.454.CMB.1.raw
  modified_base (184)..(184): a, c, t, g, unknown or other
  misc_feature (184)..(184): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctccagctgtgctgactcaatcgcctctgcctctcgcctccgtgggacncctcggtcaagctcatctgcactctgagctaggtcggacacgagacaacgtccgcagtcggcagtcggcagtcagcagcacgaccgtaggacgtaaccgggtcctaggtactagacgtacgaacggtacnggtnacgtggacacggaccacggaccgggaacgggggtaccgtactcccgtagttaacgtttccgggtttaacgcgggtaccacgggtccgttacgggtcggggtacgttaccggacgggttacccacccgttaccgtaccggtacctaccgttacccgttacccggaaccgttccctaaccgggtacgtaacggttacgggaacggtaacgttccgggtaaacggtccttaaacggtacgttttaaccggtacgtaccggtttcggaaacccgggtttaccggtacggggtaccgtttacgtttacggggtttacgttacggggtttacccggggttacggacgggtaaccgggtaccgtacgggcccgttaaccgggtacccgttacggtaccgggtaccctaccgggaccgtacccgggttcctaaccccggtccccgg

SEQ ID NO: 218228 - DNA, 713 bp, Homo sapiens
  misc_feature: GYAE6OF02HEUNN.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctcgccctcccgtggggacgcccgtcggtcaacgtcctcatcctcgccactctgagcaggtggcacagaccaactacgccatccgcgagtcggacactcgagcagccgacggccgaaggaacggaccggtcccgttcggtacgttaggaagtaggtaaacggttacgaggtacggagtaggacctaccgaccgaaccggaaccggggaacgggggaccggtacgtccgtaggttacgtttacggtttcggacggtacgtacgtcgtcgggtcgggtcgtacggacgccgtaccgtaccctcaaccgtctcccgtaccgcgtacccgtacgtcggtacgacgggtacgtacgtggtacgtacgtagtaacctttacgttcgtacgtacgtaccgggtcggtcgggtacttacgggttcggtttaggttccggggttttgggtaccgggaccgggtaacggtacgtaacgggttcccgtacgggttaccggtaccggtacggtaccggacccggtaccggtacggtcccgtccccggtacccgg

SEQ ID NO: 218229 - DNA, 886 bp, Homo sapiens
  misc_feature: GYAE6OF02JLQ38.19.28.C06.1.454.CMB.1.raw
tcagtactctcgtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctcgtcgcccttcccgtggggacgtcccgtcggtccaaggtcctacagtctcggcctacttcctggacgtccgtaggtcggggccaacgaacggtccaaaccgttaccggaccctaacttaccgggcctaagttcgggaccaacttccgaacggaccgaacggccaacggcccaaggtaacgggaaccgggtccccgttacgggttaccgtttacggtaacgtaagggtaaacgggttaaccagggttacgaacgtcgggaccgtaacggaccccgaaaccggaaccgggtaacgggggggaaccggtaccttcccggtaggtacgtttaccggtttttacgaccgggtaccgtacggtccgtacggttcgggcgttacggacggtaccgtaccgttaccccgtacgaaccttacgtacccggtaccctacggtccccgttaaccgtacggttaccgttacggaacggtaacggttacggtacggttaccgtagggtaaccttaaacggtttacccgtacggtttaaaccgaccggggttaaccggtccgggggtaccctacgggttttacgggtttaacggttcggggttttaaccgggtttaccggggaaccgggtttaaccgggaaacccggttacggtaaccggtcggttaaccccgttagggttaccggtaccgaccggtacccgtaggggttcccctaccgggtcccccgg

SEQ ID NO: 218230 - DNA, 660 bp, Homo sapiens
  misc_feature: GYAE6OF02GA87V.19.28.C06.1.454.CMB.1.raw
  modified_base (187)..(187): a, c, t, g, unknown or other
  misc_feature (187)..(187): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacaggtctctctcccagcttgtgctgactcaatcgccctctgcctctgccctcccgtgggacncctcggtcaagctcatctgcactcgtgagcagtgggcacgagacaactaccgcatcgcatggcatcagcagcacgccagagacggccctcggtactgagtaggaaggtaacagtgagtgcacgccaacgacggaacgggggacgtactccgtagagtttcggttttacgacggtccaggtccgttcggtcggggtctacgggacgtccgtacctacccgtcaacctctaccgtacccgacgtccctcctacggtcctaggtacgtacgtaggcgtacgtacgtaacttacgttactacggttcgaacggttaccggtcgggtaacctacggtttggttaacgttcgggtttcgggttttaccgggacgggtaccgggtaaccgtaacgggtcccgttaccgggtacccggttaccgtaaccggttaccgtaaccggacccggtaaccggttcccgtacccgttaccccccggg

SEQ ID NO: 218231 - DNA, 689 bp, Homo sapiens
  misc_feature: GYAE6OF02F5WJA.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctcgccctcccgtgggactcccgtcggtacaagctcatctgcactctgagcgaggtcggacacgagaccaacgtccgccagtcgacagtcggcatcagcagacgacgaccaggaacgaccgggcccttacgggtacttagagtaggtaaaggttaacgagtagagtcggacgtacgaccaaccgaaccggaaacgggggacggtactccgtagtacgttcgtttacggacggtctaacgtcgttcggtacggggcttagggaccgtaccgtaccgtacccgtacaacccgtactcccgttacgaccgtccctaccggtacgtaccgtaggaaccggtagtcggaccgtctaaggtaccttaacgttagccgtaacgaacggtccggtaggggaccttaaggttcgttaagttcggttacgggttacggacggtacgggtacctaacgtccggtaacggtacccggtttacgtacggtaccgaccggtacccggtaacggtcccgacccgttaccccgg

SEQ ID NO: 218232 - DNA, 643 bp, Homo sapiens
  misc_feature: GYAE6OF02HOUN9.19.28.C06.1.454.CMB.1.raw
  modified_base (295)..(295): a, c, t, g, unknown or other
  misc_feature (295)..(295): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctccctgggacgcctcggtcaagctcatctgcactctgagcaggtggcacagcaactacgccaatcgcactggcatcagcagcagccaagagaacggcctcggtactgatagaagtaacngtgatgcacgacacgacgaagggggacgactccgtagtacttacgttttacgacggtccagtcgtcgtgggctgacgtcgactacctcgaccatcctaccgacgtccgtacgacgttcgtagacggtagtacgtacggtctagtacgttaattacgttacgttccgaacggtaccggtacggggaccttaccgtttaggttaacgtttcgggtttggggttttaccggggtccggggtaacggggtaaccccggaacggttccgtacggggttaaccccggttacccggttaacgggtcccgtaaaccggtaccccggaaacgggtcccgtacccggttaccccccgg

SEQ ID NO: 218233 - DNA, 755 bp, Homo sapiens
  misc_feature: GYAE6OF02F6O4I.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctcctacccagcttgtgctgactcaatccgccctctcgcctctcgcccttcccgtgggacgcctcgggtcaacgctcatctgccactctagacgcaggtcggacacagacctaaacgtaccgcctagtccgcagtggcactcagcacgcagaccgagaggacggtccctaggtactgatgtaagtacagtagatcggacacgaccacgaccggaagggggacggactccgtagtacgtttcgttttacgacgggtacacggtacgttccgggtacggggtctacgggacgtacccgtacctaaccccgttaccgaaccgtaccttacccgttaccccgacgtacccccgttacggttaccggttccgggttagtacggggtaacgttacggggaccgggttaccgtacgttaaaccgttttacgttacggttcggttacctacggggtaaccgggttggggttacctacgggttttgggttaacggtttcgggttttacggggggtttcggaccgggggtaacggtaacccggtaaggttcccgggttaaccggttacccggtacgttccgggtaacgtacccgggtacccggaccggttccggttaccccggttaccccgg

SEQ ID NO: 218234 - DNA, 701 bp, Homo sapiens
  misc_feature: GYAE6OF02HIZI0.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgcctctgcctctgcctccctgggagcctcggtcaaactcatctgcactctgacgaagtcggcacagcaactcgccatcgcagtggcatcgagcagcagccagaggaacggcccgtcgtacgtagacgtaggtaacggttaacgaggtcgagtcggcacgaccaacgacggaagggggacgactcccgtagtacgtttacgtttcggacgggttacacggtcgtcggtcggggtctacggtacgccgtccgttaccgtaccgaacctaccttaccgtccccgtaaccggtcccttccgtacggttccggtaaggtacgggtaagttcggggtacggttcctacggttaaacctttacggttaaccgtttcggaccggttacggacccgggttcggggacttacggtttgggttaagttttcgggttccgggttttacgggacggggacggtaaccggtacgggtaccgttccgggtaccggttaccggtacggtaccggaccgtacccggtacgggtcctccccgggtcccgtcgggttaccc

SEQ ID NO: 218235 - DNA, 752 bp, Homo sapiens
  misc_feature: GYAE6OF02GNJZM.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctcccgtgggagcctcggtcaaggctcatctgcactctgagcaggtcgggcacgagacaactacgccatcgccagtcggcatcagcagcacgccaggaggaacgggccctacggttaccgtaggagtaggtaacggttaacgaggtagacggtggaccgaacgacccgaaccgaaccggggaaacgggggggtaccggaacgttccccgtaggttacgttttacccggttttacggaacggggttacccgacggtccgttcgggtcggggtacgtacgggtaccggccggtaccttaacccgtcctaaacccgtctcccgtacccgacgtccctaccgtacgttacgtagggtaacgtacgtaggacggtccttaaggtaccttaagttacgtcggtaccgtacggtaccgggttacggggactttaccgggttacgggttttagtttcgggtttaccggggttttacgggaccgggtaaggggaacccgttaaggtcccggttaccggttacccggttacggttacggtcccggtaaccgtacccgggacggttacccgccccggttacccccggg

SEQ ID NO: 218236 - DNA, 697 bp, Homo sapiens
  misc_feature: GYAE6OF02IO56J.19.28.C06.1.454.CMB.1.raw
  modified_base (473)..(473): a, c, t, g, unknown or other
  misc_feature (473)..(473): n is a, c, g, or t
tcagtactctcgtgcacgaccggtgctcgatttagagctcacgtattggggtttggggagagctctggggagtctgcaccatggcttggaccccactcctcttcctcaccctcctcctccactgcacagggtctctctcccagcttgtcgctgactcaatcgcctctgcctctgcctcccgtgggacgcctcggtacaaggcttcatccgtgctactcgtgacgcgaggtcgggacacgcgtacaactacggccagttcggaccagtcggcctagtaccacggacacgcgacgaccgagggaacggaaccggcccttacggtacgtagagttacgaaacgttacgagtcgagtgcacgcgacgacggacggggtacgataccgtagtacgttcgttttacgcggactacggtcgtacgtgggacgtcgaacggcgtccttaaccgtacgtaccgacttcgaaaccgcgtaccncgtaacgtcttagggaacggttgtacgacggtaccttagtaaccgttcgttaaacgttcggtaaccgacgggtacgtacggggtaacttacggtttaacgttcgggttagtttaccggggtttccgggaacggggttaacggaaacgtccggttacggacgttacccggtaacggttacgtaccggaaccggtaccgggtaggtaccccggtacgttccccggg

SEQ ID NO: 218237 - DNA, 769 bp, Homo sapiens
  misc_feature: GYAE6OF02ICYGK.19.28.C06.1.454.CMB.1.raw
  modified_base (150)..(150): a, c, t, g, unknown or other
  misc_feature (150)..(150): n is a, c, g, or t
tcagtactctcgtgcacgaccggtgctcgatttagagctcacgtattggggtttgggggagagctctgggggagtctgcaccatggcttggaccccactcctcttcctcaccctcctcctccactgcacagggtctctctccagcttgtnctgctcatcgcctctgcctctcgcctccgtgggacgccgtcggtacaacgtctcgtactcgtacgactactcgttaggacgtcgagggtcgggaccaacgacgtacctaacgtaccggcctaacgttccgactaacgtcgggaccgtacgttaccgacgccgacgaccgtacgaccggaaggaacggtaaaccgggtccccggttaacgggttaacctttaggacgttaacgggtaaaacggtttaaaccgtacggtacggaacggttcgggaaccgtacggtaccgtaaccggaaaccgggtaacggggggggacggttaccgtaccgttagggttacgttttaccgggttttaccggaacggggttaccgacggttccgtacgggttacgggtacgtacgggtcgtaccggtacccgttaacccgtaccctacggttacctacccgtaccgtaccgtccctaccgtagtcgtacggagtacgtacggcgtctagtactatcgtacacgtacggtcgtagggtaccttgttacggttcgtggttacggttacggacggtacggcgtacgtcggtacgtcggtacgtcgacgtaccgacggtacgtccgccgtacccgg

SEQ ID NO: 218238 - DNA, 705 bp, Homo sapiens
  misc_feature: GYAE6OF02GFFLQ.19.28.C06.1.454.CMB.1.raw
  modified_base (201)..(201): a, c, t, g, unknown or other
  misc_feature (201)..(201): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacaggtctctctccagcttgtgctgactcaatcgccctctgcctctgccctcccgtgggacgctcggtacagctacntcgtgccactctgacgcgaggttgggcacgagaccctaaatacccgccagttccggacctagtcggaccatccgagcgaagcacgacgtaggacggtaacggccccgtcggtacgttagagtagtaaaggtaacgtagtaggacgtacggacacggtaccgaaccgaccgggaacgggggaacggtaccggtccgttacggtaacgtttcggttttttacccggacggggtaacccttaggtacccggttcggtccgggggttcgtacggcggtaccgtacccgtaccgtaaccgtaccgtaacgttcccggtacctaccggtccgtaccgtacgtccgtagggacggtaagtcggtacggcgttacgacgttaacgttcgcggttacacggtaccgacgggtacgtacgtaggttacgttgttcggttcggggacgtagggtccgaacgttcaacggtccggtacgtcgtacgaccgtccgacgggtcctacccggtacccgg

SEQ ID NO: 218239 - DNA, 894 bp, Homo sapiens
  misc_feature: GYAE6OF02INLFA.19.28.C06.1.454.CMB.1.raw
  modified_base (307)..(307): a, c, t, g, unknown or other
  misc_feature (307)..(307): n is a, c, g, or t
tcagtactctcgtgcacgaccggtgctcgatttagagctcacgtattggggtttgggggagagctcgtgggggagtctgcaccatggcttggaccccactcctcttcctcaccctcctcctccactgcacagggtctctctccagcttgtgctgactcatccgccctctcgcctctcgtcccgtcccggtagggacgtccgtcggtacaagtctctacttcgcgtactccttcgaggacgcgtacgggtcggacaacgtaacgaccgtaaacgtccgcctagtccggactggtcgactacgcacggnacgcgacgacgaaggtacggacccggtcgttacggtacgtagagttaacggtacgtaagtggtaggtagtcgaccgacggtaccgaacggaaccgggggaacggggtacgtaccgtacgtaggttaccgttttacgggttaacgggcggttaccgcgggtttcccggtagggtacggggtcgtaacgggtccgtaaccggtacccttaaccgttacccgtacccgtaccgttacccgtccgtacccgggttaccctacgggttacggtaccgggttaaccgggtaacgggttccgggtacggtttaccgtacgtttaacccgtttacggttaacccggtttaggtaacccggttaaccgggtacccggggttacgggttaacccgggtttaacggttaccgggttttagggggttttaccggggtttaccgggggtttacgggggtaacccggggtaaacgggtacccggttaacgggttacccgggttaaccggtttacccgggttaccggttaacgggttcccggacccgggtttaacccggcccgggtttaacccgggtccccggttacccccggttaccgggg

SEQ ID NO: 218240 - DNA, 700 bp, Homo sapiens
  misc_feature: GYAE6OF02GDGVS.19.28.C06.1.454.CMB.1.raw
  modified_base (191)..(191): a, c, t, g, unknown or other
  misc_feature (191)..(191): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
tcagtactctcgtgcacgaccggtgctcgatttagagctcacgtattgggtttgggggagagctctgggggagtctgcaccatggcttggaccccactcctcttcctcaccctcctcctccactgcacagggtctctctcccagcttgtgctgactcaatcgccctctgcctctgccctcccgtggggacncctcggtacaagcctcatctgcactcgtgacgcaggtgggacacagacaactacgcanccgnatggcatcacgcagcacgcaggaggaacgggtccctacggtacgtagagtggtaaacggttaacagtgatcggacagaccaaccgaacggaacggggggacggactcccgtagtactttacggtttacgacgggtaccaggtccgtacggtggggcctagaacggtccgtacccgttaaccctcgaacctactcccgtacccgaaccggtccctaccgtaacggttccgtaggaacggtagtacgggagttaccgtacgttaaccgttaagttacccgacggtaccgtaaccggtacgggttacgggaactttaaccgtagggggtttaatccggggttttacgggggttagggaaccggggtaacgtaaccgaagggttccgaacgggtaacccgttcgaacgggttaccaccggaacccggtacgtccggtccccgtaaccccgg

SEQ ID NO: 218241 - DNA, 833 bp, Homo sapiens
  misc_feature: GYAE6OF02JA940.19.28.C06.1.454.CMB.1.raw
  modified_base (127)..(127): a, c, t, g, unknown or other
  misc_feature (127)..(127): n is a, c, g, or t
  modified_base (149)..(149): a, c, t, g, unknown or other
  misc_feature (149)..(149): n is a, c, g, or t
  modified_base (627)..(627): a, c, t, g, unknown or other
  misc_feature (627)..(627): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacncgggtctctcctccagtcttgngctgactcatccgccttcgtgcctctcgcccttcccgtaggggtcgcccttcgggtacaacggcctacctagttctcggaacctccgttctaggaagtccgaggtccgggaccactaacggacctaaaccgtacccggcctacggtccgacctaaggttccggacgtaactccgaccggacacgaccgtaacggccgtaaacgggaaacgtacccgggttaccctagggttcgtttaggactaagggttaaaccgttaagaccggtgtaacggcgacgaccgtacccgaaacgtaaccggggtaacgggggacttcgtacccgttaagttggtttaccgttttacggaacggtaccgtagtccggttaacggtcggtacggtaggccgtaaccgtcccgttaacccgacctaaccgtacctaccgtacccgtactaccgttacgacgttacgacggtaacggacgttacggaccgttntacgtaaaccgttgtaaccgtcgtaaccgggtaacgttaccggggcgttaaccggttggttaacgtttgttacggggtttcggggtttaaccggcggggttaaaccggaccgtttaccgtacccgggtacggttaaccccggttaccgttaaccggggcttaaaccgggaccccgttaaccggtccgtttcccccgggaaccccgg

SEQ ID NO: 218242 - DNA, 704 bp, Homo sapiens
  misc_feature: GYAE6OF02FL3HA.19.28.C06.1.454.CMB.1.raw
  modified_base (186)..(186): a, c, t, g, unknown or other
  misc_feature (186)..(186): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagctgtgctgactcaatcgccctctgcctctgcctcccgtgggacncctcggtcaagctcatctgcactctgagcaggtcggacactagcaacctaccgccatccgcagtcggcatcagcagcacgccgagacgaacggccctacggtactgataggtaagtacagtgagtgacacgaccacgaccggaggggacgcgtccgtagtactttcggttttacgacggtccacgtccgttcggtacgggtctagggacgtccgtccgtaaccgtcccgaacctacgttacccgtacccgaccgtacccgtacccgttggtaccgttacgggtacgtacgtacgggacggttctacgttaaccgtttacgtttaacgtcgttacgtaaccggttaccggtacggggttaccttaacggtttaggtttacgttcgggttttaccggggtttcgggaccggggtaacggtaaccggtaacggttaccggttaccggttacccgttacggttaaccgggttaccgaaccgggtacccgtaacgggttcccgttaccccggttaccccccgg

SEQ ID NO: 218243 - DNA, 783 bp, Homo sapiens
  misc_feature: GYAE6OF02H804U.19.28.C06.1.454.CMB.1.raw
  modified_base (167)..(167): a, c, t, g, unknown or other
  misc_feature (167)..(167): n is a, c, g, or t
  modified_base (194)..(194): a, c, t, g, unknown or other
  misc_feature (194)..(194): n is a, c, g, or t
tcagtactctcgtgcacgaccggtgctcgatttagagctcacgtattgggtttggggagagctctggggagtctgcaccatggcttggaccccactcctcttcctcacccctcctcctccactgcacagggtctctctcccagcttgtgctgactcaatccgccctntcgcctctcgcccttcccgtggggacnccgtcggtcaagcctcatcctgccactctgacgcaggtcgggacacgagaccaaaccgtcgccagtccgactagtggcatcgagccagccacgaccgaaggtaacggaacgggtccccgttacggttaacttaggaagtaacggtaaggttaacgaggtacggagtcggacgaccgtaccgaaccggaaccgggaaacggggggaccggtaccttaccgtaggtacgtttccgttttacgacgggtacctggtccgttcggtcggggtactcgggaacggtcccgtacctacccgtaccgaacccttcgtaccccgtacgtacccgtacccgtaccggtacgtcggaagggtaacggtcgttacgggacggttacgtaccgtaaacgtttacgtttaccggtacgtaccgtaacccgggtccgggtacggggttacctacgggtttacggtttacgggttcggggtttacggggtttacccggggaaccgggtaccgggtaacgtacggttccgtaacccggttacccgttacggtaacggaccggaacccggtacccggtacggtaccccggtccccggttaccccgg

SEQ ID NO: 218244 - DNA, 867 bp, Homo sapiens
  misc_feature: GYAE6OF02H0UOC.19.28.C06.1.454.CMB.1.raw
  modified_base (219)..(219): a, c, t, g, unknown or other
  misc_feature (219)..(219): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
tcagtactctcgtgcacgaccggtgctcgatttagagctcacgtattgggtttggggagagctctggggagtctgcaccatggcttggaccccactcctcttcctcacccctcctcctccactgcacagggtctctctcccagcttgtgctgactcaatccgccctcttcgcctctcgccctcccgtagggcgcccgttcggacaagtcctacattcgngcctacttctggaacgctgggtcgggacaacacgcctaaccacggccagtccgcagtcggctacnccgaagcaacgngacgccgaaggaacggaacggtccccttacgggtaacttagacgttaaggtaaaccggtttaaacaggtagaggtaggaccgacgaaccgaaccggaaaccgggaacggggggtaacgtaccgttaccgtacggttaacgttttcgggtttttacccggaacgggttccgtaaggtcgtttccgggtacgggggttccgagggtaacggtttccggaaccctttacccgtacgttaaaccccggttaactccccgttaaccggacgttccgggttaaccccgttagggtaccgtacgggttaaacgggtagtaacgggttcccgggttagtaacggtttaaacctttacggttaccgttaacggtccgtaaacggggtaccgggtaccggggtttacttaacggggtttagtttacgggtttacgggtttaccgggttaccggggtaccggggttaacggggaaacccggttacggttcggttaaccccggttaccggtttacccgtttaagggaccccgttaacggggacccccgttaaggggttccccgtcccggtttaaccccccggg

SEQ ID NO: 218245 - DNA, 724 bp, Homo sapiens
  misc_feature: GYAE6OF02IQBEF.19.28.C06.1.454.CMB.1.raw
  modified_base (593)..(593): a, c, t, g, unknown or other
  misc_feature (593)..(593): n is a, c, g, or t
tcagtactctcgtgcacgaccggtgctcgatttagagctcacgtattggggtttggggagagctctggggagtctgcaccatggcttggaccccactcctcttcctcaccctcctcctccactgcacagggtctctctcccagcttgtgctgactcaatccgccctctcgcctctcgcccttcccgtggggactccctcggtacaagtcctcacttcgtgcctacctcgtgagccgtagggtcgggacaacgacgaccaaaccgtacgcctaatccggacagtcggctaatccgagaccgagccacggacccgaaggaacgggtaaccgggtccccgttaggttacgttagaacgttagggtaaacgttaaccgagttacgaaggtcggaccgacggacccaaacggaaccggggaaaggggggtaccgtaaccttcccggtaggttacgtttaccggttttacggaccgggtacctacggtcgttcgggtacgggtcgtacggacgtccgtaccttccgaactacgtaccgtcctaccgacgtccctcgtacgtgtacggagtagtcggatcgtaagtacttacgttaccgngtaccgaacggtccggtagggtactacggtttaggttcggttacgggttcggggtacggtacggaacggtactacggtcgtaaccggtacgttcgtaacgtcaccggaccggtcgtccgtcccgtacccgg

SEQ ID NO: 218246 - DNA, 1041 bp, Homo sapiens
  misc_feature: GYAE6OF02F4910.19.28.C06.1.454.CMB.1.raw
  modified_base (187)..(187): a, c, t, g, unknown or other
  misc_feature (187)..(187): n is a, c, g, or t
tcagtactctcgtgcacgaccggtgctcgatttagagctcacgtattgggtttggggagagctctggggagtctgcaccatggcttggaccccatcctcttcctcaccctcctcctccactgcacagggtctctctccagcttgtgctgactcaatcgccctctgcctctcgccctcccgtgggacnccgtcggtcaagcctcatcgtgaccactctgagcaggtcgggaccacgagacctaacctaccgcctacgcgactagtcggacatacgacggacgacgaccgacggaccccgaaaggaaccggggtaaaccgggtcccccgttacggggttaaccgtttacggtaaaggttaacggttaaacgggtttaaaccgaagggttacgtacggttacggacgtaaccgaccgaaccggaaacccggggaaacgggggggtacccggtaaccgttccccggttaaggttccggttttacggtttttacccggggtaaccgggtaacccggtacggttccgtttaccggggcgggggttacggtaccgggtacggtacccggtaccccgtttaaaccccggtacccttaaccccgggttaactttccccccgtaaaccccggttcccgggttaaaccccccttcccgggttaacccgggttttaccgttaacgggggttaaaccggtaccggggtttaccgggttaaccggttcccggtttaaaccgttaaccggtttttaaccggttttaacccgttacgggtttaccggtaacccggggttaacccgggggttccggggttaaccgttttaacggttttacggggttttacgggttttcggggttttacccggggggtttttaccgggggaaccggggtttaacccgggtaaaccgggttaaaccgggttacccgggtttaaaccccgggtacccgggttttaacccgggtacccggggttaacccccgggggttaacccggttaacccggggtccccccggttaccccccgggtttccccccggtttaaaccccgggg

SEQ ID NO: 218247 - DNA, 773 bp, Homo sapiens
  misc_feature: GYAE6OF02H3K9R.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactacaatccgccctctcgcctctcgccctcccgtgggacgtccctcggtacaacgctcatctgcctactcgtaggacgcgaggtcgggacaacacggacaaccgtaccgcctacgtccgacagtcggactacgtacgacgcagacacgaccgaaggaacggaaccgggtccccgttacggtacttacggtaagtaaggttaaacggttaacgtacggtagtacggtcggacgacgacccgaacggaaccggggaacgggggaaccggtaccgttaccgtcggttaacggtttccgttttacggaccggttacgtacggtcgttacgggtcgggtcgtacggacggtccgtactaccctaccgtacctacgtccgttaccgaccgtacctaccgtacgtcgtacggaggtaacgtgggtacgtacgttacgactttaacgttaccgtacgtaccggtaccggtccgggtacgggttacgttaggtttaggttacgtttggggtttaccgggttacgggggtacggtaccggggtaacgttacgggtccgttaaccgggttacccgttacggttaccgaccggaccggtaacccggtacgggtcccttaccccgggtaccccg

SEQ ID NO: 218248 - DNA, 691 bp, Homo sapiens
  misc_feature: GYAE6OF02HEXEJ.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctgccctcccgtgggacgcctcggtcaagctcactctgcactctgagaagtggcacagcaactacgcatcgcagtggcatcagcagcagccagagaacggcctaggtacttgataggaaggttacaggtgagtggcagaccgacgaaccggaagggggaccggactccgtagtacgtttcggttttacgacgggttacaggtcgtacggtcggggactaggcggccgtacctacccgaccaaccgtacttccgtacccgtaccgtccccgttacaacggttcctagggaggtacgtcggaggtcctagtactttagttaccgtacgtaccgtaacggtccggtaccggggtaactttacgggttaggttttacggttcggggttttacggggttaccggggacggggaacgggtaccggtaacggtaccggttaccgggttacccggttaaccggtacggtaccgtaacccgggtacccggaccggttacccgtaccccgggttacccccgttacccggg

SEQ ID NO: 218249 - DNA, 797 bp, Homo sapiens
  misc_feature: GYAE6OF02F7CUN.19.28.C06.1.454.CMB.1.raw
  modified_base (357)..(357): a, c, t, g, unknown or other
  misc_feature (357)..(357): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacaggtctctctccagcttgtgctgctaacatccgtccctctgtccctctcgccctcccgtaggggacgcccgtcggtacaacgtcctcactcgtgcctactccgtgacgcgtagggtcgggccacacgtccaaaccttaccggccagttccgctagtcggacatccgaagcaagcacgcaaggtacggaacggtcccgtacgggtacttagtaactaggtaaacggtaaacnggttacgaagtcggcacggaaccccaggaaaccgggaaacgggggacggtaccgttacccgtagtagtttttacccggttttagaccggggttccaacggttccgttacgggcggggtttccaacgggtcgtacccggtaacccttaacccgtttacccgaaaccgtaccgttacccttaccccggacccgtaccccgttaccggtacgttaacccgtaagggtaccggtaacgggtggttaacccgggcgtttaaccgtaccgtttaaacctttcggtacgttaccgaaccgggttaccgggcgttaaccgggttaacttggttttaaccccgggtgtttaccggggtttaccgggaggaaccggggtcctaacggtcggtaaccgttaccgtacgtacgtacggaccgtaccgtaccggccgttacccccgttaccgg

SEQ ID NO: 218250 - DNA, 795 bp, Homo sapiens
  misc_feature: GYAE6OF02HRRUT.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgccctcccgtgggacgccgtcggtacaagcctcatcgtcgcacttcgtagacgcgaggtcgggacaacgagacctaacctacgccaactcgcagtggacatcgagcgagcgacgaccgtaagaacggaacgggtccccgtcgggttacgttacggtagttaacggtaaacggttaaccgtaggttcgtaaggtacggaccgaaccggacccgtaaaccggaaccgggaaacgggggggaacggtaccgtaccgttaggttaccgtttacggtttttacggtaacgggttccggacggtcgttccgggtacggggtcgtacggacggtaccgtacccgttacccgtacccgaaccgtacctaccgtacccgtacgtacccgtccggtacgttccgtaagggtacggttacgtcgggtaacggtcgttaacgtaccgtttaacgttaccgtacggtaccgtaccgggtaccggtcgggtaccgttcggtttacgggttaagtttcggggtttcgggttacgggacggggtaaccgggtaaccgggtacgtcggttaccggttacccggttacggttacggtccgaccggtacccggtaacggtcccggtacccggttaccccgg

SEQ ID NO: 218251 - DNA, 627 bp, Homo sapiens
  misc_feature: GYAE6OF02IT5WF.19.28.C06.1.454.CMB.1.raw
  modified_base (414)..(414): a, c, t, g, unknown or other
  misc_feature (414)..(414): n is a, c, g, or t
tcagtactctcgtgcacgaccggtgctcgatttagagctcacgtattgggtttggggagagctctggggagtctgcaccatggcttggaccccatcctcttctcaccctcctcctccactgcacagggtctctctcccagctgtgctgactcaatcgccctctgcctctcgcctcccgtggggtagccctacggtcaacgctcatctgccatctcgagccaagtcgggacctacagcctaactaccgaccatcgactatggctaatcgacgcagccagccaagaggaacggccgtacggtacttgagtacaaaggttacgagtcgtagtggacacgacaccgtaacgaacgggggggtaccgaagtccctagacttcgttttacggaacggtccaagctacgtgggcttggacncgctacctacgactacgtacctcacgtcctaccgtacgtccttaggaacggtagttaccggaacgggttacctcggtaactaacgttaccgtcgtacggtacgttaaccggcggggtataaccggttggtccgttagtcgggtttcgggacggtacgggaacacggtcacgcgtaccgtaggtccaccgaccgtacggtccgtacctccccgg

SEQ ID NO: 218252 - DNA, 737 bp, Homo sapiens
  misc_feature: GYAE6OF02H1GVR.19.28.C06.1.454.CMB.1.raw
  modified_base (146)..(146): a, c, t, g, unknown or other
  misc_feature (146)..(146): n is a, c, g, or t
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (369)..(369): a, c, t, g, unknown or other
  misc_feature (369)..(369): n is a, c, g, or t
tcagtactctcgtgcacgaccggtgctcgatttagagctcacgtattgggtttggggagagctctggggagtctgcaccatggcttggaccccactcctcttcctcaccctcctcctcactgcacaggtctctctcccagtcttgngctgactacactccgccctctcgccctcgtcgccctcccggtgggacncccgtcggtacaacgctacntctcgccactctggagcgtagggcggacacgagtaccaaactcgccagtcgctagtcggactagtaccgaggacagtccgaaggacccgtaagggaacggtaacccggggtccccttaacggttcttaggacggttaacggtaaacgggttaacnggttaaggtacggacggaaccgaaccgacccgtaaaccggggaacggggtaacggggtaaccgttaccttaccgtagggttacgttttccgggttacggaccggtacgtacggttacgtcgggtacgggtacgtacggtccgtaccgtaccctaccgtaacctacctacgtccctccgtaccgtaccgtcgtacgtacgtaggaacgttgacgtacgtacgtacgtacttacgttacgtacggtacgtacggtcggtcggttacgtacggttgttagttcggttcggtacgggacggtacggtacgtacgtcggtacgacccgttaggttccgaccggtaccggtacccgccgtaccgtcccgtcccg

SEQ ID NO: 218253 - DNA, 856 bp, Homo sapiens
  misc_feature: GYAE6OF02F70K0.19.28.C06.1.454.CMB.1.raw
  modified_base (166)..(166): a, c, t, g, unknown or other
  misc_feature (166)..(166): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctntgcctctcgccctccctgggacgccgtcggtcaagctcactctgccactctgacgcgaggtcggacacgtagacaacgtaccgcctagtcgctagtcggctatcgacgacacgccgacgccgaaggaacggaaccggggtcccttacggttaccgttaggtaacgtaagggtaaaacgggttaaaccgtaaggttaggaacggttacgggaccgaaccggtaccccgaaaccggtaaacccggggaaaacgggggggtaccggtaaccgttaccccgttagggttaccgttttccgggttttacggaccgggttaccgtacgtacggttccgggtcggggtacgtacgggaaccggtaccggtacccgtaccccgtacgtaaccccgtcggttaccccggtacccgtaaccggtccccgttaacggtaccggtttaccgggtacgggtaaacgggtacgttacgggacggttcgttacgtaccgtttaacgtttacgacggttaccgaaccggttaccgggttacgggtacctttaacgggttacggtttacgggttccggggttttacggggtttaccggggaccggtaacggggtaaccctagggttcccgtaacccggtaccggttaccgggtacggtcccggaaccggttacccggacccggttcccggtcccggtttacccccgg

SEQ ID NO: 218254 - DNA, 650 bp, Homo sapiens
  misc_feature: GYAE6OF02G9W2A.19.28.C06.1.454.CMB.1.raw
  modified_base (360)..(360): a, c, t, g, unknown or other
  misc_feature (360)..(360): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgcctctgcctctcgccctcccgtgggacgcctcggtacaacgtctcacttctgacctactcgtaggacgtacgtagggtcggaccaacgacgacctaaaccgtaccgacctagtccgacagtcggactaatcgaggcagacgacgtacgaaggacgggaaccggtcccgtacggttacttaggacgtaggtaaacgtaanggtagagtcgaccacgaccaacggaacggagggggacgtcctcgtagtacgtttcgttacgacggtcacggtcgtggngggactcggacncgtactccgtaccactaccncgtccncgtcgacgtatcgtagacgtacgtacgagtcgtactaagttcttacgcgtacgtacggtacgtcggtagtcggttaggttacgttcggttaacgggttcggacggacggtacgtacgtacggtaccgtacgtacggttacggacgacggtacccgcggtccttccggtacccgg

SEQ ID NO: 218255 - DNA, 770 bp, Homo sapiens
  misc_feature: GYAE6OF02G6BVN.19.28.C06.1.454.CMB.1.raw
  modified_base (187)..(187): a, c, t, g, unknown or other
  misc_feature (187)..(187): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctccctgggacncctcggtcaagctcatcgtgccacttctagacgcaaggtcgggcaacgagacaaccgtaccgccatccgcatggcatacagtcacgacgagaccgaaggaacggaaccgggtcccgttacggttacttacggaagtaacgggtaaacggttaacgtacggtaggacgtcggacacgacccgaaccgaaccgggaacgggggaacggtactacccggtagttacgtttaccggttttacgaaccgggttaccgacgtccggttcggtacggggtactacgggacgtccgtacgtacccgtcccaaccgtacgttcccacccgtactacccgtacgtaacggttcgtaggaacggtacgttacggacgtacgtacttaaacgttcgttaaccgtcgttaacccgacggtaaccggtccgggtactttacgggttcggtttaacggttcgggttttaccggggttccgggaacgggttaaccgggaacccgttaacgggtccggttaacccggtacccgttaacggttacgggtacccgtaacccggtacccgggtaaccggtcccgttccccggtaccccccggg

SEQ ID NO: 218256 - DNA, 872 bp, Homo sapiens
  misc_feature: GYAE6OF02HC5ZK.19.28.C06.1.454.CMB.1.raw
  modified_base (190)..(190): a, c, t, g, unknown or other
  misc_feature (190)..(190): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctcgtcgccctcccgtgggacncctcgggtcaagctcatctgcacttctgacgcgtaggtcgggaccacgaaggaccaaaaccgtccgaccctaagtccggaccgagttcggacctaagtaccgaacggaccaacggaccaacgggaccccaaaggggaaacggggtaaacccgggggtcccccgttaaccgggttaccgttacggtaaacggttaacggggtaaaaacgggtttaaaccgtagggtacgtaacggtcgggaacaacgggtccccaaaacggtaacgggttaaccggggaaacggggggtaaccggtaccgttacccggttaggtaaccgtttttcgggttttaaccggaacggggttccgtaacggttcgtacgggtacggggtcttagggaccgtaccgtctacccgtaccgtaccgtactcccgtaccgacgccctttaccgcgttacgtaagggcgtaagtcgggacgtcgtaacgtaacgtttacgttaacctggttaacccgacggtaaccgggtcggttaacgttacggtttacggggtttagttcggggttttaccgggttacggggtaccggggtaacggttaacccggtacggttacccggttaaccgggtaccccgtttacgggtacgggtaaccccgtaacccgggtacccggttaaccgggtccccgtttaccccccgggg

SEQ ID NO: 218257 - DNA, 703 bp, Homo sapiens
  misc_feature: GYAE6OF02GE1OK.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctcccgtgggacgcctcggtcaagcctcatctgctactctgagcgaggtcggacacgacgcaactacgccagtccgcagtggcactcagcagcgacgccgaaggacggaaccgggcccttcggttacttggaagtaggtaaacggttaacagtagtacgtcggacctacgacccaacggaaccgggaacgggggacggtactcccgtagtacgtttcggttttacggacggttccacggtacgtcggtacgggtctacggacgtcgtacccttacctaccgtaacctactcccgtaccgaccgtccctccgtacgttcgtaggaacggtacgttacggacgtacgtacgttaacttacgttacgtcggtaccgtacgggtaccggtacgggtacttacggttacggttacggttcgggtttacgggtttaccgggacgggtacggtaaccgtaacggtccgttaccggtacccgttacggtacgtacgtacccggaacccgtacggtcccgtacccggttacccccgg

SEQ ID NO: 218258 - DNA, 747 bp, Homo sapiens
  misc_feature: GYAE6OF02HLWTX.19.28.C06.1.454.CMB.1.raw
  modified_base (183)..(183): a, c, t, g, unknown or other
  misc_feature (183)..(183): n is a, c, g, or t
  modified_base (308)..(308): a, c, t, g, unknown or other
  misc_feature (308)..(308): n is a, c, g, or t
tcagtactctcgtgcacgaccggtgctcgatttagagctcacgtattgggtttggggagagctctgggagtctgcaccatggcttggaccccactcctcttcctcaccctcctctccactgcacagggtctctctcccagcttgtgctgactcaatcgccctctgcctctgcctccctgggancctcggtcaagcctcatctagcactctgagcagtgggcacgagcaactaccgccatcgcagtcggcaatccgagacagtcgagccgagtaacgacggtccctggtacttgactggaaaggttaanaggtagagtggacagaccacggacgaaggggggacgtactcccgtagtaacttccggttttacgcggtacctaggcccgttacggtcggggtacctacgggccgtacgtacccgttacccgtaccctaaccgtaacgttcccgtaccctacggtcccctaccgtacgttaccgtacggtaacggtacgttacggtaccggtaccgttacgggtaaaccttaacggtttaaccttaacggtaccgtaaaccgggttccgggttacggggtaacccgttacggtttaacgggtttaacggtttacgggtttaccgggtttttcggggaaccgggtttaaccggggtacccggtaacggtacccggttaccggtacccggtttaccggtaccgggttaccgaccggtaaccccggaaccggttcccgtacccggtccccggg

SEQ ID NO: 218259 - DNA, 885 bp, Homo sapiens
  misc_feature: GYAE6OF02GIATO.19.28.C06.1.454.CMB.1.raw
  modified_base (190)..(190): a, c, t, g, unknown or other
  misc_feature (190)..(190): n is a, c, g, or t
  modified_base (238)..(238): a, c, t, g, unknown or other
  misc_feature (238)..(238): n is a, c, g, or t
tcagtactctcgtgcacgaccggtgctcgatttagagctcacgtattgggtttgggggagagctctgggggagtctgcaccatggcttggaccccatcctcttcctcaccctcctcctccactgcacagggtctctctcccagcttgtgctgactcaatccgccctctgcctctgccctcccgtggggancctcggtacaacgctcatctgcctactctagacgcaggtcgggcaacngacaaactcgaccatcgcatggcatcgagcagcagaccgaggacgaacgggtccctacggtacgtagtagtaggtaacgggtaacaggtagagtacgggacgacgtaccgaacgaacccgggtaaggggggaccggtaaccgttacccgtagttaacgtttaccggtttttaccggaacggggttccgtacggtccgtcgggttacggggcgtacggtacgggtacccgtacccgttaacccgtacccgtaaacccgtaccgttaccgtaacccggtaaccgttaccccggtaccccgttaaggttaccccggtaaggggtaaccggggtaacggttaacgggtaccggggttaacccttaaaccgggtaacccgtttaaaccgtttaaccgggttaccggttttaacccgggaaacccggggttaacccggggttaaccgggggtaacccgtttaaccggggttttacgggttttaacgggttttcggggttttaccgggggttttacccgggggaaccggggtaaacccggggtaacccggtaaagggttcccggttaaccggtacccgggttaccggttaacgggtacccggtaaaccgggtaccccggtaacccggtcccggttaccccggtaaccccccggg

SEQ ID NO: 218260 - DNA, 681 bp, Homo sapiens
  misc_feature: GYAE6OF02JD0RQ.19.28.C06.1.454.CMB.1.raw
  modified_base (96)..(96): a, c, t, g, unknown or other
  misc_feature (96)..(96): n is a, c, g, or t
  modified_base (249)..(249): a, c, t, g, unknown or other
  misc_feature (249)..(249): n is a, c, g, or t
  modified_base (663)..(663): a, c, t, g, unknown or other
  misc_feature (663)..(663): n is a, c, g, or t
tcagtactctcgtgcacgaccggtgctcgatttagagctcacgtattggggtttgggggagagctcgtggggagtctgcaccatggcttggacccnctcctcttcctcaccctcctcctccactcgacacgaggtcctctcctccagtcttgtcgctcgacttcacttccgcctcgtcgccgtcctcggtccctccggtagggactccgtacggtacaacgtcctcactcgtcgactacgtctaggacncggtacgggcggaacacacggaccgtaaacgtccgaccgtaagtccgactaacggtcgacgtactacgacgacgacgagtaccgacgaacggacggtaccggtcgtaccggttagtacgtagtaacggtaacgtagtacggacgtaggctaacgacgtacgacggtacgggacggtacggtactcgtagtccgtttacgtacggacggtcgtacggcgttcggacgtacgacgtctcgtacgacctcgtctacgtaccgtcgacgtacgtaccgtaggtcgtacggacgtaggtcgacggtactacgtcgttacgtcgtacgtacggacttcggtacgacgtttacggtagttacggtcgggtacggtcggaacggtcggtaacacggttcctacggtgtccgtagccgtaccncgtacggcctccgtacgg

SEQ ID NO: 218261 - DNA, 926 bp, Homo sapiens
  misc_feature: GYAE6OF02I5KHH.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctcctcccagcttgtgctgactcaactccgccctctgcctctcgccctcccgtgggacgtccctcggtacaacgctcatcgtacgctactcgtgacgcgtaggtcggaccacgagaccaaaccgtccgccactccgacgtacgtacggacatccgacgtacgagccacggaccgtaaggaccggaaccgggtcccgttacggttacttaggaacgttacgggtaaacggtttaacggaggttacggtaacggtcggaacgtaccgacccgtaaccggaaaccgggtaaacgggggggtaccggtaaccgttcccgtaacggttaaccgttttccgggtttttaaccggaccgggttaaccgtacgggttacccggttcgggggttaccgggggtaccgttacgggtaaccgggtcccgttaaccccggttaacccgttaccccgtaaaccgtttaccgttaccccggttaaccccgtaccgtaccccgttaaccggttacccggtaccggtaacggggttaaacgtcggtacgggtaaccggttcgttaacggttaacctttacggtttaccggttcgggtaacccgtaaaccgggttcgggtaccgggtaccgttttaacgggtttaccggtttaagggttccgggggttttaccgggttaccggggtaaccgggtaacgggtaacccggttaacggtaaccgggttcccgggttaaacccgttcgggtaaccggttcgaacccccggggtaacgttaccgggtacccccggttacccggttaacccccggg

SEQ ID NO: 218262 - DNA, 884 bp, Homo sapiens
  misc_feature: GYAE6OF02IF8J9.19.28.C06.1.454.CMB.1.raw
  modified_base (60)..(60): a, c, t, g, unknown or other
  misc_feature (60)..(60): n is a, c, g, or t
  modified_base (294)..(294): a, c, t, g, unknown or other
  misc_feature (294)..(294): n is a, c, g, or t
  modified_base (421)..(421): a, c, t, g, unknown or other
  misc_feature (421)..(421): n is a, c, g, or t
  modified_base (534)..(534): a, c, t, g, unknown or other
  misc_feature (534)..(534): n is a, c, g, or t
tcagtactctcgtgcacgaccggtgctcgatttagagctcacgtattgggtttggggganagctctgggggagtctgcaccatggcttggaccccactcctcttcctcaccctcctcctccactgcacagggtctctctccagcttgtgctgactacaagtccgtccctctcgccctctccgcccttcccgtggggacgtcccgttacgggtacaaacgtccttacgacttccgtcgcctaaccttctggaacggccggtaggttacggggccaaacgacggtaccctaaaccnccggacctaacgttccgccaagtttcggactacacgacgacacggtaccaaggaccccgtaggaaaccgggtaaacccgggtccccgttacgggtttaccttggtaagtaacggttaaagtaaacgnggttacgaggtacgacgaccgacccgaacggtaaccgggggaacgggggaccgtaccttcgtaggttacgttttcggtttacggacgggtctacggtcgtcgggtcgggtacncgggacggtacccttacccgtacctaccccgaccgtttactccccggtaacctccggtaccccgttaccggtagggttccgaaggggttaaccgaccggttgggacccgtttacgttaccaccgttttaacgtaccgggtttacacccgggtacggggttccgggtagttaacccggtttagggttttaccgggttttacggttcgggggtttttaccgggttacccgggggaagggttaccggtaaaccgtccgggttacggttacccggttaccgggtacccgtttagggaaccccggtaccgggttaacccggacccggtttcccccggtccccggttaaccccggg

SEQ ID NO: 218263 - DNA, 763 bp, Homo sapiens
  misc_feature: GYAE6OF02G1MHK.19.28.C06.1.454.CMB.1.raw
  modified_base (386)..(386): a, c, t, g, unknown or other
  misc_feature (386)..(386): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacagggtctctctcccagtcttgtgcttgactcaactccgccctctcgcctcgtcgccctaccgtgggactccgtcggtacaacgctcactcctcgccgtactcgtgacgcgacggtcggacacgaacgacctaaccgtaccgccgactccgactacgtcggacctagtcacggacacgcgacgaccgaggtaacgggaccggtcccgttaggttaccgttaggaagtacggtaaacgttacgtaagtcggtaagccggtanaccggaaccgtaaccggaacgggacgggggaccgtccgtacggttcgttacgtttacgtttcggacggtacacgtacgtcgggtcggtacgtcgcggtccgacccgtacccgtacaccttacgtccctaccggtacctcccgttaacgtacctcggtacggtaacggtagtaccgggacgttcgtaccgtaaacctttagttccgttaccggaactacccggggtcggtacggtaccttagggttttcggtacggtttacgggtttcgggtacgggtaccggtaacgggtacccgttaggaccgttacccgggtacgtttaccggtaacccgcggtacccgggaccgttacccgggtcccgttaccccgtaacccgg

SEQ ID NO: 218264 - DNA, 866 bp, Homo sapiens
  misc_feature: GYAE6OF02GOYB8.19.28.C06.1.454.CMB.1.raw
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
tcagtactctcgtgcacgaccggtgctcgatttagagctcacgtattgggtttggggagagctctggggagtctgcacatggcttggacccactcctcttcctcaccctcctcctccactgcacgagggtctctcctccagcttgtgctgacctacaactccgccctctcgcctctcgcccgtccgtggggactccctcgggtacaagtctacctagtcgtcgcctacttcgaggacgcggagtcggaccacgtaacgaccaaacgtccgaccaacgtccgagtacgtcggtactactacgacgacganaccgagaccggaggtaacgggaccgggttccctacggttacttcggaagtacggtaaacggtactacggngtacggaggaaccgaggtaccgaacgggaaccgggaacgggggtaccgtacgtaccgttagttacgttttcggtttaaccggcggtccgtacggttccggttacgggcgggtaacctagggtaccggtacccgttacccttacggtaccctaccgtaccgtttacccgacccggttaacccgtaccggtttaccaacgggtttaccgtacggggtaaacggtacgtacgggttaaccggacgtttacttaacggtttaaccttaccgggttacgttacccgggaaccgggttacgggttaacggggttaccgtttcggggttttaaacggtttcggggttttaacggggtttccgggggttacggggtaacccggggacgtaaacccgggttccgggttaccggttaacccggggttccgttaacgggtcccggttaaccggtaaccgggtcccggttaacccggtcccggttacccggtccccggg

SEQ ID NO: 218265 - DNA, 838 bp, Homo sapiens
  misc_feature: GYAE6OF02HBB6T.19.28.C06.1.454.CMB.1.raw
tcagtactctcgtgcacgaccggtgctcgatttagagctcacgtattgggtttggggagagctctggggagtctgcaccatggcttggaccccactcctcttcctcacccctcctcctccactgcacagggtctctcctcccagcttgtgctgactcaactccgccctctcgcctctcgtccctcccgtggggacgcccgtcggtacaacgctcatctgccacttctaggacgcgtaggtcgggacaccgagaccaaaccgtcaccgactcggactacgtcggacctacgtaccgaacgccgacggacaacgaccgaaggaacgggaaccgggtcccgttacggttacgttagacggtaacggtaacgttaacgaggtagacggtaggaccgtacgacccgaacggaaccggggaacgggggtaccgtaccgtccgtaggttacgtttaccggttttacggacggtaccgtacgtccgttacgggtcgggtcgtacggtagtcccgtaccgtacccaccgtaacgtcccgtccctaccggtaccgtccccgtacgtaaccggtccgggtaaaggttcggtaacggtacggacggttccgttaacgttaacctttaaccgtcggtaccggtaccgaaccggggttacgggtcccgggttaacgtttcggggtttacgtttacggggttcggggttttaacccggggttaggggaaccggggtaccggtaacggtaaccggttccgggttaaacccggttacccggtttaacccgtaaccgggttaccggtaaacccggttacccggttacccgggtacccgtttcccccgggtaccccg

SEQ ID NO: 218266 - DNA, 765 bp, Homo sapiens
  misc_feature: GYAE6OF02JXVS7.19.28.C06.1.454.CMB.1.raw
  modified_base (197)..(197): a, c, t, g, unknown or other
  misc_feature (197)..(197): n is a, c, g, or t
  modified_base (397)..(397): a, c, t, g, unknown or other
  misc_feature (397)..(397): n is a, c, g, or t
tcagtactctcgtgcacgaccggtgctcgatttagagctcacgtattgggtttggggagagctctggggagtctgcaccatggcttggaccccactcctcttcctcaccctcctcctccactgcacaggtcctctctccagcttgtcgcctgactacaatccgccctctcgccctcgtcgcccgtcccgtagggacnccgttccggacaacgtccttcacttcctcggtacctacctcgtggacgccgtagtcgggaccaacgtaccgacaaaccttccgaccacgttccggcctaagccggtctacgtcaaacggtccacggacacgacgaacggaccggaaccgtacccggttacggttactgaagtacggtaacgttaacgtaggtacggtagnggaccaaccgacccgaaccggaacgggtaacgggggtaacgtaccgtcccgttaggtaccggttttacggttttacggacgggttaccgcgtccggttcggtagggccttaggacgtccgtcctcccgtaacacgccgtcctccgtaacgccctaccggtaacgtcgtacggtaggtaccgtagtaaccgccgttgttaacgttacgtttcgtaccggtaaccgtcccgggttaccggggtagtaacccggtttggtttaccggtaggtttacggggtccggttacggggaccggttaacgggaaacgttcggtacctcgtaaccggcgttacggacttccgacccgtacggtcccgtacccgtccgg

SEQ ID NO: 218267 - DNA, 790 bp, Homo sapiens
  misc_feature: GYAE6OF02JEHSF.19.28.C06.1.454.CMB.1.raw
tcagtactctcgtgcacgaccggtgctcgatttagagctcacgtattgggtttggggagagctctggggagtctgcaccatggcttggaccccactcctcttcctcaccctcctcctccactgcacagggtctctctcccagtcttgtgctgactcaactcgccctctcgcctctcgcctcccgtgggacgccgtcggtcaacgctcatctgctactcgtagacgcgtaggtcggaccaacacgaccaaaccgtacgccaagtccgacagtcggacactcgaagcgacgcaacgccgaaggaacggaacgggtcccgttacggtacgttgacgttaacggtaaacggttaacgaggtgacgtcggacgtacgaccgaacgaacgggaagggggaccgtactcgtacgtactttcggtttacgacggtaccacgtcgtcggtacggggctacgggacgtccgtaccgttacccgtacctaccctaaccgtacctacccgtaccgtacccgtacccggtacgttaccgtacgggaacgtcggaacgggtaccggtaccgtaacggtaacggtttaaccttaccgttacggtacggtaaccgggtaccggtacggggtaaccgtttaaggttacggttttaaaccgggtttgggttaccggggttttacgggaacggggtaacggtaaccggttaaccgggtacccggttaccgggttaaccggtttacccggtaacggtaccgtaacccggtaccccgggttaaccggtccccggttcccggtaacccccgg

SEQ ID NO: 218268 - DNA, 846 bp, Homo sapiens
  misc_feature: GYAE6OF02ITT24.19.28.C06.1.454.CMB.1.raw
tcagtactctcgtgcacgaccggtgctcgatttagagctcacgtattgggtttggggagagctctggggagtctgcaccatggcttcggaccccactcctcttcctcaccctcctcctccactcgcacgagggttcctctctccagtcttgtcgactcgactcaactccgccttctcgcctcgtcgcccgttccgtagggcgccgtacggtcaacgctcacttctcgccactctaggacgtcgacggtacggccaacgtacgaaccaaccgtacggacctacgtcggctacgtcggacacgtcgacgacacgtacgacgaccgaacgggaacgggtaaccgggtcccgttaccgggttaacgttacggtaacggtaacgttaaacgggtaacgtaacgggtacgtaacggcggtaccggaacgttacccgaaccgggtaaaacgggggaaccgggggtaaccgggtaccgttacccggttaacggttaccgggttttaaccggtttttacccggtaccggggttaccggtacggttaaccgggttcggggtaccggggtaaccggtcggtaccgggtactacccgggttacctaacccgtaaccgtaccgtaccgtaccgtacccggtaccgtaccgtaacgtttaccggaggtaaccggtgtacgacggttcgtaacgtaccgttacgtacggtacgtccgtaaccggtcgggtacgtcgtacgggttaggttcggttcgggttaccgggtttacgggaccggtacgggaaccgttcggacgttaccggtacccgtaggttaccgtacggtaccgtaccgggaccgtccggtcccgtaacccggg

SEQ ID NO: 218269 - DNA, 293 bp, Homo sapiens
  misc_feature: GYAE6OF01CGY3O.40.1.A01.1.454.CMB.1.raw
  modified_base (288)..(293): a, c, t, g, unknown or other
  misc_feature (288)..(293): n is a, c, g, or t
tcagtctagcgactcacgaccggtgctcgatttagacgtctcatcagggatcccagaccgattctctggctccagctcaggaaacacagcttccttgaccatcactgggctcaggcggaagatgaggctgactattactgtaactcccgggacaccagtggtaacagtcggggagtgttcggcggagggaccaagctgaccgtcctaggtcagcccaaggatgccccctggtcactctgttcccacctcctcagtcgctagactgagcgggctggcaaggcgcatagnnnnnn

SEQ ID NO: 218270 - DNA, 264 bp, Homo sapiens
  misc_feature: GYAE6OF01EC455.40.1.A01.1.454.CMB.1.raw
  modified_base (263)..(264): a, c, t, g, unknown or other
  misc_feature (263)..(264): n is a, c, g, or t
tcagtctagcgactcacgaccggtgctcgatttagacgtctcatcagggttcagtggaagtggatctgggacagatcctactttcaccatcagcagcctgcagccagaagatattgcgacatatttctgtcaggtgtatgaaagtctccctgttttggccaggggaccaaggtggagatcaaacgaactgtggctgcaccatctgtcttcatcttcccgccatctgaagtcgctagactgagcgggctggcaaggcgcatagnn

SEQ ID NO: 218271 - DNA, 268 bp, Homo sapiens
  misc_feature: GYAE6OF01BIE06.40.1.A01.1.454.CMB.1.raw
  modified_base (264)..(268): a, c, t, g, unknown or other
  misc_feature (264)..(268): n is a, c, g, or t
tcagtctagcgactcacgaccggtgctcgatttagacgtctcatcagggttcagtggaagtggatctgggacagatcctactttcaccatcagcagcctgcagccagaagatattgcgacatatttctgtcaggtgtatgaaagtctccctgtttttggccaggggaccaaggtggagatcaaacgaactgtggctgcaccatctgtcttcatcttcccgccatctgaagtcgctagactgagcgggctggcaaggcgcatagnnnnn

SEQ ID NO: 218272 - DNA, 301 bp, Homo sapiens
  misc_feature: GYAE6OF01CMEOK.40.1.A01.1.454.CMB.1.raw
  modified_base (297)..(301): a, c, t, g, unknown or other
  misc_feature (297)..(301): n is a, c, g, or t
tcagtctagcgactcacgaccggtgctcgatttagacgtctcatcagggcacgaccggtgctcgatttagacgtctcatcagggttcagtggaagtggatctgggacagatcctactttcaccatcagcagcctgcagccagaagatattgcgacatatttctgtcaggtgtatgaaagtctccctgttttggccaggggaccaaggtggagatcaaacgaactgtggctgcaccatctgtcttcatcttcccgcatctgaagtcgctagactgagcgggctggcaaggcgcatagnnnnn

SEQ ID NO: 218273 - DNA, 268 bp, Homo sapiens; identical to SEQ ID NO: 218271
  misc_feature: GYAE6OF01E1I0R.40.1.A01.1.454.CMB.1.raw
  modified_base (264)..(268): a, c, t, g, unknown or other
  misc_feature (264)..(268): n is a, c, g, or t

SEQ ID NO: 218274 - DNA, 303 bp, Homo sapiens
  misc_feature: GYAE6OF01DI1FP.40.1.A01.1.454.CMB.1.raw
  modified_base (299)..(303): a, c, t, g, unknown or other
  misc_feature (299)..(303): n is a, c, g, or t
tcagtctagcgactcacgaccggtgctcgatttagacgtctcatcagggcacgaccggtgctcgatttagacgtctcatcagggttcagtggaagtggatctgggacagatcctactttcaccatcagcagcctgcagccagaagatattgcgacatatttctgtcaggtgtatgaaagtctccctgttttggccaggggaccaaggtggagatcaaacgaactgtggctgcaccatctgtcttcatcttcccgccatcctgaagtcgctagactgagcgggctggcaaggcgcatagnnnnn

SEQ ID NO: 218275 - DNA, 505 bp, Homo sapiens
  misc_feature: GYAE6OF01EXILB.40.1.A01.1.454.CMB.1.raw
  modified_base (171)..(171): a, c, t, g, unknown or other
  misc_feature (171)..(171): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (352)..(353): a, c, t, g, unknown or other
  misc_feature (352)..(353): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
tcagtctagcgactcacgaccggtgctcgatttagacgtctcatcagggcacgaccggtgctcgatttagacgtctcatcagggttcagtggaagtggatctgggacagatcctactttcaccatcagcagcctgcagccagaagatattgcgacatatttctgtcaggtntatgaaagtctccctgttttggccaggggaccaaggtgagatcaaacgactgtggctgcacatctgtcttcatccttcccgcctatcgtgaacgtcgactagactaggacgtccgggcgtcggaaccgaaggtccggaccgtaaagtaacggcanacgtngcncgtagcgtcgcagcagcnngtacgtcgacgtactacgtcgtcgcgcgtacncagcgacgacncacgtancactactacnacncgtgtgactacgtacnagtanctanatcgtacgtacgacgngacgtacncgtgtgtanacgtcgtcactacgacgcacgctcgtntacg

SEQ ID NO: 218276 - DNA, 295 bp, Homo sapiens
  misc_feature: GYAE6OF01DL2ZG.40.1.A01.1.454.CMB.1.raw
  modified_base (215)..(215): a, c, t, g, unknown or other
  misc_feature (215)..(215): n is a, c, g, or t
  modified_base (288)..(295): a, c, t, g, unknown or other
  misc_feature (288)..(295): n is a, c, g, or t
tcagtctagcgactcacgaccggtgctcgatttagacgtctcatcagggttcagtggaagtggatctgggacagatcctactttcaccatcagcagcctgcagccagaagatattgcgacatatttctgtcaggtgtatgaagtctcccttgttttggccaggggaccaagggtggagatacaaacgacgtgtggctgccaccatctctcttacncttccttcccgcctataccggaagtccggtctagacgtggaggccgggcgtaggcgaacgggcgaccagtagnnnnnnnn

SEQ ID NO: 218277 - DNA, 629 bp, Homo sapiens
  misc_feature: GYAE6OF01EVBLQ.40.1.A01.1.454.CMB.1.raw
  modified_base (156)..(156): a, c, t, g, unknown or other
  misc_feature (156)..(156): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
  modified_base (484)..(484): a, c, t, g, unknown or other
  misc_feature (484)..(484): n is a, c, g, or t
tcagtctagcgactcacgaccggtgctcgatttagacgtctcatcagggatcccgagaccgattctctggctccagctcaggaaccacagcttccttgaccagtcactggggctcaggcgagactgaggctgactattacgtgtaacgtcccgganaccagtgtaacagtcggggatgttacggcggacgggaccaagtcgtggacctcctaggtcagacccaagactcgacccctggtccacgtctacggtccccaccgtcctacgagttaccgtacgttaacgacgtggtacggtaccgggtacgttacgggacaacgggcgaacaacgtaaggccaatcagcagacngtcanacgtnagtancgatacgtnacgtcacgttagatnagtacgtacgacgacgacgtacgtacgacgtacgtactactacgtactacgacgtacgacgtacgtacgtaacacgtacactaacgtagtagtanagtacgtactaacgtaagtacgtacgtaacgaacggtacgtaacgtaacgtacgttacgtaacggtacgtacgacgtacgtaacgaacgtacgtacgtacgtacgtacgacgtacgtaccgtaacgtacgtactacgtcgacgac

SEQ ID NO: 218278 - DNA, 297 bp, Homo sapiens
  misc_feature: GYAE6OF02IF8D1.40.1.A01.1.454.CMB.1.raw
  modified_base (289)..(297): a, c, t, g, unknown or other
  misc_feature (289)..(297): n is a, c, g, or t
tcagtctagcgactcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggatgccccctggtcactctgttccccgcctctcagtcgctagactgagcgggctggcaaggcgcatagnnnnnnnnn

SEQ ID NO: 218279 - DNA, 297 bp, Homo sapiens
  misc_feature: GYAE6OF02F5KPI.40.1.A01.1.454.CMB.1.raw
  modified_base (290)..(297): a, c, t, g, unknown or other
  misc_feature (290)..(297): n is a, c, g, or t
tcagtctagcgactcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggatgccccctggtcactctgttcccgccctcctcagtcgctagactgagcgggctggcaaggcgcatagnnnnnnnn

SEQ ID NO: 218280 - DNA, 266 bp, Homo sapiens
  misc_feature: GYAE6OF02IDOWG.40.1.A01.1.454.CMB.1.raw
  modified_base (261)..(266): a, c, t, g, unknown or other
  misc_feature (261)..(266): n is a, c, g, or t
tcagtctagcgactcacgaccggtgctcgatttagacgtctcatcagggttcagtggaagtggatctgggacagatcctactttcaccatcagcagcctgcagccagaagatattgcgacatatttctgtcaggtgtatgaagtctccctgtttttggccaggggaccaaggtggagatcaaacgactgtggctgcaccatctgtcttcatcttcccgcatctgaagtcgctagactgagcgggctggcaaggcgcatagnnnnnn

SEQ ID NO: 218281 - DNA, 300 bp, Homo sapiens
  misc_feature: GYAE6OF01DTHBD.18.74.G08.1.454.CMB.1.raw
  modified_base (299)..(300): a, c, t, g, unknown or other
  misc_feature (299)..(300): n is a, c, g, or t
tcagtacgagtatgcacgaccggtgctcgatttagtagctctatcagggggagctgagcagcctgagatctgacgacacggccgtatattactgtgcgagaaatttggccctgactggtgattttgacgactggggccagggaaccctggtcaccgtctcctcagcctccaccaagggcccatcggtcttcccctggcgccctgctccaggagcacctccgagagcacagcggccctgggctgcctggtcaaggactacttcccatactcgtactgagcgggctggcaaggcgcatagnn

SEQ ID NO: 218282 - DNA, 302 bp, Homo sapiens
  misc_feature: GYAE6OF01CR15Q.18.74.G08.1.454.CMB.1.raw
  modified_base (300)..(302): a, c, t, g, unknown or other
  misc_feature (300)..(302): n is a, c, g, or t
tcagtacgagtatgcacgaccggtgctcgatttagtagctctatcagggggagctgagcagcctgagatctgacgacacggccgtatattactgtgcgagaaatttggccctgactggtgattttgacgactggggccagggaaccctggtcaccgtctcctcagcctccaccaagggcccatcggtcttccccctggcgccctgctccaggagcacctccgagagcacagcggccctgggctgcctggtcaaggactacttcccatactcgtactgagcgggctggcaaggcgcatagnnn

SEQ ID NO: 218283 - DNA, 310 bp, Homo sapiens
  misc_feature: GYAE6OF01EMX9T.18.74.G08.1.454.CMB.1.raw
  modified_base (299)..(299): a, c, t, g, unknown or other
  misc_feature (299)..(299): n is a, c, g, or t
  modified_base (305)..(310): a, c, t, g, unknown or other
  misc_feature (305)..(310): n is a, c, g, or t
tcagtacgagtatgcacgaccggtgctcgatttagtagctctatcagggggagctgagcagcctgagatctgacgacacggccgtatattactgtgcgagaaatttggccctgactggtgattttgacgacgtggggccagggaaccctggtcaccgtctcctcagcctccaccaaggcccatcggtcttcccctggcgccctgctccgaggagcacctccgagagcacgagcggccctgggctgcctggtaccaaggacctacttcccatacctcgtactgagcgggctggcaaggcncatagnnnnnn

SEQ ID NO: 218284 - DNA, 384 bp, Homo sapiens
  misc_feature: GYAE6OF02IZGU2.18.74.G08.1.454.CMB.1.raw
  modified_base (310)..(314): a, c, t, g, unknown or other
  misc_feature (310)..(314): n is a, c, g, or t
  modified_base (317)..(317): a, c, t, g, unknown or other
  misc_feature (317)..(317): n is a, c, g, or t
  modified_base (320)..(384): a, c, t, g, unknown or other
  misc_feature (320)..(384): n is a, c, g, or t
tcagtacgagtatgcacgaccggtgctcgattttagtagctctatcagggggtaggctgagcagcctggacgatctgacgacacgggccgtatattactgtgcgagaaatttggccctgactggtgattttgacgactggggccagggaaccctggtcaccgtctcctcagcctccaccaagggcccatcggtcttccccctggcgccctgctccaggcgcacctccgagagcacaggcggccctgggtctgcctggtcaaggctacttcccagtacctcgtacctgagcgggctggcaaggcgcatagnnnnnagngcnnnnnnnnnnnnnnnnnnnnnnnnnnnnnnnnnnnnnnnnnnnnnnnnnnnnnnnnnnnnnnnnn

SEQ ID NO: 218285 - DNA, 297 bp, Homo sapiens
  misc_feature: GYAE6OF02HPTYU.18.74.G08.1.454.CMB.1.raw
  modified_base (274)..(274): a, c, t, g, unknown or other
  misc_feature (274)..(274): n is a, c, g, or t
  modified_base (279)..(280): a, c, t, g, unknown or other
  misc_feature (279)..(280): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (290)..(297): a, c, t, g, unknown or other
  misc_feature (290)..(297): n is a, c, g, or t
tcagtacgagtatgcacgaccggtgctcgatttagtagctctatcagggggagctgagcagcctgagatctgacgacacggccgtatattactgtgcgagaaatttggccctgactggtgattttgacgactggggccagggaaccctggtcaccgtctcctcagcctcaccaagggcccatcggtcttccccctggcgccctgctccaggagcacctcgagagcacagcggcctgggctgcctggcaaggactacttcccatactccgtatgngcggnngnagcnangnnnnnnnn

SEQ ID NO: 218286 - DNA, 249 bp, Homo sapiens
  misc_feature: GYAE6OF01D5B7J.9.53.E09.1.454.CMB.1.raw
  modified_base (247)..(249): a, c, t, g, unknown or other
  misc_feature (247)..(249): n is a, c, g, or t
tcagtgatacgtctcacgaccggtgctcgatttagagagagtgtgttgggtttggggtgtggtggtctccactcccgccttgacgaggctgattattactgctgctcatatgcagatggtgacactcccgtggtattcggcggagggaccaaggtgaccgtcctaggtcagcccaaggctgcccctcggtcactctgttcccgccctcctcagacgtatcactgagcgggctggcaaggcgcatagnnn

SEQ ID NO: 218287 - DNA, 248 bp, Homo sapiens
  misc_feature: GYAE6OF01EJG3D.9.53.E09.1.454.CMB.1.raw
  modified_base (248)..(248): a, c, t, g, unknown or other
  misc_feature (248)..(248): n is a, c, g, or t
tcagtgatacgtctcacgaccggtgctcgatttagagagagtgtgttgggtttggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccgccctcctcagacgtatcactgagcgggctggcaaggcgcatagn

SEQ ID NO: 218288 - DNA, 258 bp, Homo sapiens
  misc_feature: GYAE6OF01DE0VZ.9.53.E09.1.454.CMB.1.raw
  modified_base (247)..(258): a, c, t, g, unknown or other
  misc_feature (247)..(258): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgcccctcggtcactctgttcccgcctcctcagacgtatcactgagcgggctggcaaggcgcatagnnnnnnnnnnnn

SEQ ID NO: 218289 - DNA, 251 bp, Homo sapiens
  misc_feature: GYAE6OF01AR73X.9.53.E09.1.454.CMB.1.raw
  modified_base (249)..(251): a, c, t, g, unknown or other
  misc_feature (249)..(251): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccgccctcctcagacgtatcactgagcgggctggcaaggcgcatagnnn

SEQ ID NO: 218290 - DNA, 250 bp, Homo sapiens
  misc_feature: GYAE6OF01AEKRC.9.53.E09.1.454.CMB.1.raw
  modified_base (249)..(250): a, c, t, g, unknown or other
  misc_feature (249)..(250): n is a, c, g, or t
tcagtgatacgtctcacgaccggtgctcgatttagagagagtgtgttgggtttgggggtgtggtggtctccactcccgccttgacgaggctgattattactgctgctcatatgtagatggtgacactcccgtggtattcggcggagggaccaagctgaccgtcctaagtcagcccaaggctgccccctcggtcactctgttcccgccctcctcagacgtatcactgagcgggctggcaaggcgcatagnn

SEQ ID NO: 218291 - DNA, 509 bp, Homo sapiens
  misc_feature: GYAE6OF01BTAIH.9.53.E09.1.454.CMB.1.raw
  modified_base (442)..(442): a, c, t, g, unknown or other
  misc_feature (442)..(442): n is a, c, g, or t
  modified_base (504)..(504): a, c, t, g, unknown or other
  misc_feature (504)..(504): n is a, c, g, or t
tcagtgatacgtctcacgaccggtgctcgatttagagagagtgtgttgggtttgggggggtcacaagaggcagcgctctcgggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccanaatgtctcggaagtggaccacggtcaccgtcaggtcacgccccaaggcccaacccatcgtcnctccg

SEQ ID NO: 218292 - DNA, 413 bp, Homo sapiens
  misc_feature: GYAE6OF01ES0CK.9.53.E09.1.454.CMB.1.raw
  modified_base (410)..(413): a, c, t, g, unknown or other
  misc_feature (410)..(413): n is a, c, g, or t
tcagtgatacgtctcacgaccggtgctcgatttagagagagtgtgttgggtttgggcgtattttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatcactgagcgggctggcaaggcgcatagnnnn

SEQ ID NO: 218293 - DNA, 252 bp, Homo sapiens
  misc_feature: GYAE6OF01DKQ2O.9.53.E09.1.454.CMB.1.raw
  modified_base (249)..(252): a, c, t, g, unknown or other
  misc_feature (249)..(252): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccaccctcctcagacgtatcactgagcgggctggcaaggcgcatagnnnn

SEQ ID NO: 218294 - DNA, 256 bp, Homo sapiens
  misc_feature: GYAE6OF01DCDCB.9.53.E09.1.454.CMB.1.raw
  modified_base (247)..(256): a, c, t, g, unknown or other
  misc_feature (247)..(256): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctggtcactctgttcccacctcctcagacgtatcactgagcgggctggcaaggcgcatagnnnnnnnnnn

SEQ ID NO: 218295 - DNA, 251 bp, Homo sapiens
  misc_feature: GYAE6OF01B3P3V.9.53.E09.1.454.CMB.1.raw
  modified_base (249)..(251): a, c, t, g, unknown or other
  misc_feature (249)..(251): n is a, c, g, or t
tcagtgatacgtctcacgaccggtgctcgatttagagagagtgtgttgggtttgggggtgtggtggtctccactcccgccttgacgaggctgattattaatgctgctcatatgcagatggtgacactcccgtggtattcggcggagggaccaaggtgaccgtcctaggtcagcccaaggctgccccctcggtcactctgttcccgccctcctcagacgtatcactgagcgggctggcaaggcgcatagnnn

SEQ ID NO: 218296 - DNA, 250 bp, Homo sapiens
  misc_feature: GYAE6OF01BFFE7.9.53.E09.1.454.CMB.1.raw
  modified_base (249)..(250): a, c, t, g, unknown or other
  misc_feature (249)..(250): n is a, c, g, or t
tcagtgatacgtctcacgaccggtgctcgatttagagagagtgtgttggttgggggtgtggttgggtctccactccgccttgaccgaggctgattattactgctgctcatagtgcagatggtgacactcccgtggtattcggcggagggaccaaggtgaccgtcctaggtcagcccaaggctgcccctcggtcactctgttcccgccctcctcagacgtatcactgagcgggctggcaaggcgcatagnn

SEQ ID NO: 218297 - DNA, 287 bp, Homo sapiens
  misc_feature: GYAE6OF01BDZB6.9.53.E09.1.454.CMB.1.raw
  modified_base (256)..(287): a, c, t, g, unknown or other
  misc_feature (256)..(287): n is a, c, g, or t
tcagtgatacgtctcacgaccggtgctcgatttagagagagtgtggttgggttgggggtgtggtggtctccacctcccgccgttgacgaggctcgattattactgctgctcatatgcagatggtgacactccccgtggtattcggacggagggaccaaggtgaccgtcctaggtcagcccaaggctgcccctcggtcactcgtagttcccaccctcctcagacgtatcgactgagcgggctggcaaggcgcatagnnnnnnnnnnnnnnnnnnnnnnnnnnnnnnnn

SEQ ID NO: 218298 - DNA, 531 bp, Homo sapiens
  misc_feature: GYAE6OF01DVA8B.9.53.E09.1.454.CMB.1.raw
  modified_base (520)..(520): a, c, t, g, unknown or other
  misc_feature (520)..(520): n is a, c, g, or t
tcagtgatacgtctcacgaccggtgctcgatttagagagagtgtgttgggtttggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagccccaaactcttgctttatgatgtcagttatcggccctcaggagtttctgatcgcttctctggctccaagtctggcaccacggcctccctgaccatctctgggctccaggctgaggacgaggctgattatttctgcagctacaaaagaagtagccctctcggttgggtttcggcgggggaccaaggtcgaccgtccgtaagtcagcccaaggctgccccctcggtcacttctcgttcccnccctcctcacg

SEQ ID NO: 218299 - DNA, 279 bp, Homo sapiens
  misc_feature: GYAE6OF01B2UFX.9.53.E09.1.454.CMB.1.raw
  modified_base (253)..(279): a, c, t, g, unknown or other
  misc_feature (253)..(279): n is a, c, g, or t
tcagtgatacgtctcacgaccggtgctcgatttagagagagtgtgttgggtttggggggtgtggtggtctccactcccgccttgacgaggctgattattactgctgctcatatgcagatggtgacactcccggtggtattcgggcggagggaccaaggtgaccgtcctaggtcagcccaaggcctgccccctcggtcactctgttcccaccctcctcagacgtatcactgagcgggctggcaaggcgcatagnnnnnnnnnnnnnnnnnnnnnnnnnnn

SEQ ID NO: 218300 - DNA, 677 bp, Homo sapiens
  misc_feature: GYAE6OF01D71ZM.9.53.E09.1.454.CMB.1.raw
  modified_base (271)..(271): a, c, t, g, unknown or other
  misc_feature (271)..(271): n is a, c, g, or t
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacagatacttactnttccatcactcgtccttcgcctcgcgttagggtcactccaccctcgaccccgtaattaacggtggacacggtaacccttggtccgttccggcgaggcggtcttttccgaccgttctttactcgtttacttatgtcagtctattccgctacttctacgtaacttaccctaccagtccattccgaccctcaacacgaccaacctacccttaccacgtacggtaccttaacgaacgtaacccgccccttacccccctaacccaaacaacccgacctaaacgtaaccggtccgtaccgctccggcccgcgacgttccgttccgggtcgaccgtacggttttacgggtttacccggttcccccgttttacacgtttccccgttcccgacctacttcgtagaacggtaaccg

SEQ ID NO: 218301 - DNA, 250 bp, Homo sapiens
  misc_feature: GYAE6OF01BHJMC.9.53.E09.1.454.CMB.1.raw
  modified_base (250)..(250): a, c, t, g, unknown or other
  misc_feature (250)..(250): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctcgccccctcggtcactctgttcccaccctcctcagacgtatcactgagcgggctggcaaggcgcatagn

SEQ ID NO: 218302 - DNA, 255 bp, Homo sapiens
  misc_feature: GYAE6OF01BXCXL.9.53.E09.1.454.CMB.1.raw
  modified_base (249)..(255): a, c, t, g, unknown or other
  misc_feature (249)..(255): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgcccccctggtcactctgttcccaccctcctcagacgtatcactgagcgggctggcaaggcgcatagnnnnnnn

SEQ ID NO: 218303 - DNA, 593 bp, Homo sapiens
  misc_feature: GYAE6OF01CHX04.9.53.E09.1.454.CMB.1.raw
  modified_base (300)..(300): a, c, t, g, unknown or other
  misc_feature (300)..(300): n is a, c, g, or t
tcagtgatacgtctcacgaccggtgctcgatttagagagagtgtgttgggtttgggggggtcaacgaagaggcagcgcctctcgggacgtctccaccatggcctggctctgctgctcctcaccctcctcactcaggacacagggtcctgggccagtctgcccttgactctagcctgcctcgtgtctgggtctcctggacagtcggatcaccatctcctgcactggaaccagcagtgatggttggattatgacttgtctctggtacaacagcaccaggcaagccccaaatcactcagttangaggtcacgtaagccggcctcgagggtttctattcgcttctgtgactacaagtctgacaacacggcctacctagactaactcctcgtgggcctaccgagggcctaggaacggacgtggtactgtaatttatacgtgctgactactatactcggactagtagttggtacactaccgtcccggttaggtacgttccgggacgggtaacgggtacccgtaacggggtcggtaaccccggttccgtaagggtcccgtaacggtccccgaaagggtcccgtcccggtaaccccccggg

SEQ ID NO: 218304 - DNA, 509 bp, Homo sapiens
  misc_feature: GYAE6OF01E492G.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaaagcccccaaatcatcatttatgaggtcactaagcggccctcaggggtttctattcgcttctctggctccaaagtctgacaaacacggctccctgacaatctctgggctccaggctgaggacgaggctgattattactgctgctcatatgcagatggtgacactcccgtggtattcggcggagggaccaaaggtgaccgtccaaggtcagcccaaggctgcccccc

SEQ ID NO: 218305 - DNA, 251 bp, Homo sapiens
  misc_feature: GYAE6OF01DYDCP.9.53.E09.1.454.CMB.1.raw
  modified_base (247)..(251): a, c, t, g, unknown or other
  misc_feature (247)..(251): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctggtcactctgttcccgccctctcagacgtatcactgagcgggctggcaaggcgcatagnnnnn

SEQ ID NO: 218306 - DNA, 578 bp, Homo sapiens
  misc_feature: GYAE6OF01DIWY7.9.53.E09.1.454.CMB.1.raw
  modified_base (370)..(370): a, c, t, g, unknown or other
  misc_feature (370)..(370): n is a, c, g, or t
  modified_base (409)..(409): a, c, t, g, unknown or other
  misc_feature (409)..(409): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccaggtctggccctgactcagcctgcctccgtgtctgggtctcctggacagtcgatcaccatctcctgcactggaaccagcattgggattttaacctgtctctggtaccaacaccaccaggccaaagccccaaactcatgatttatgaagtcactaagcggcctcggggatttctgctcgcttctctgctcaagtccgtcaacacggcctcctgacatcnctggctcagactagagacgaggctactattattactgcngcctcatactgctagtttcggttccttgtttacctaagtagttagtttcgggacgggtacgggtaccgtaaggccttacgggtaacccgtcggttacgacggttcgaacggccccgtaaaggtcccgtccggtccccccgttacgggttccaacccttcgttacccccg

SEQ ID NO: 218307 - DNA, 501 bp, Homo sapiens
  misc_feature: GYAE6OF01BL3VN.9.53.E09.1.454.CMB.1.raw
  modified_base (434)..(434): a, c, t, g, unknown or other
  misc_feature (434)..(434): n is a, c, g, or t
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcgccctcagggtttctattcgcttctctggctccaagtctgacaacacggcctccctgacatctctggctcaggctgaggacgaggctgattattactgctgctcatatgcagatggtnacactcccgtggtattcggcggaggaccaaggtcgaccgtcaggtcacgcccaaggcctcgcccccg

SEQ ID NO: 218308 - DNA, 569 bp, Homo sapiens
  misc_feature: GYAE6OF01CEVP3.9.53.E09.1.454.CMB.1.raw
tcagtgatacgtctcacgaccggtgctcgatttagagagagtgtgttggggtttgggggggtcacaagaggcagcgctctcgggacgtctccaccatggcctgggctctgctgctcctcaccctctcactcaggacacaggtcctgggcccagtctgccctgactcagcctgcctcgtgtctgggtctcctggacagtcgatcaccatctcctgcactggaaccagcagtgatggttgggattatgaccttgtctcctggtaccaacagcacccaggcaaagcccccaaatcatcatttatgaggtcactaaagcggccctctaggggtttctattcgctttctctggctccaagtctgacaacacggcctcctgacatctctgggctcaggctgaggacgaggctgtattattactgctgctcataatgactagacttggtacgactaccgttcccggtaggttaacgtttccgggcgggaacggggtaacccaaaggggttcgaacccgggttccgttaacgggtccaaacgggcccccgaaaggtcccgttccggtacccccccgg

SEQ ID NO: 218309 - DNA, 619 bp, Homo sapiens
  misc_feature: GYAE6OF01DX4LW.9.53.E09.1.454.CMB.1.raw
  modified_base (202)..(202): a, c, t, g, unknown or other
  misc_feature (202)..(202): n is a, c, g, or t
tcagtgatacgtctcacgaccggtgctcgatttagagagagtgtgttggggtttggggcgtttgcctgggcctctgctggctcctccgacccttcctctacgtcaggacacagggtcctgggacccagtctgccctgactcagccttggcctcgtgtctgggttctcctggacagttcgatcaccatctctgcactggaccngcagtggatgttgggattatcgaccgttgtcctcctggtaccacacgcacccaggccaaacgccccaaatctatctatttatgagtcactaagcggccctgtaggggttttcattcggcttcgtcgtaggctccgaagtcgtagacaacgtcggaccttcctgacaattctacgtagggccttaccgaggctggacggacggagggcctagtacttacttactcgtcctgactactagtaactagcctagtacgttcggtacacctaccgttccggtaggttacgttcgggacgggtagggaacccgtaagggtccgtaccgtccgtaggtcaacgcccgtaagccgtcgcccccgtggtaccacgtccttaccgtccctaccccgttccgtaacgtacgtacgttcgcgtaaccgg

SEQ ID NO: 218310 - DNA, 532 bp, Homo sapiens
  misc_feature: GYAE6OF01AGTS4.9.53.E09.1.454.CMB.1.raw
  modified_base (228)..(228): a, c, t, g, unknown or other
  misc_feature (228)..(228): n is a, c, g, or t
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
  modified_base (411)..(411): a, c, t, g, unknown or other
  misc_feature (411)..(411): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagccaccaggacaaacgcccccaaactcatcatttangagtcactaagcgtcctcgtagggtttctattcgcttctctggctcaagtctgacaacncggcctcctagactaatctcgtgggctccgaggtctaggaggacgnggctagtattatacgtgtctgctcatatgactagtatggtacacctacgtccgtaggtacgttcgggacggtacggacaggtcgaccgtcgtacggtcacgaccgaggtcctcggtccccg

SEQ ID NO: 218311 - DNA, 583 bp, Homo sapiens
  misc_feature: GYAE6OF01A6YIS.9.53.E09.1.454.CMB.1.raw
  modified_base (306)..(306): a, c, t, g, unknown or other
  misc_feature (306)..(306): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggcaaacgcccccaaactcatcatttangagtcactaagcgcctcgagggtttctattcgcttctctgctcaagtctgacacacgcctcctgacaatctctggctcgaggctgaggacgaggctagattatactgctgctacattagtgactaggtattgggtacgaccgtaccgttcccggttagggttacgttaccggggaccgggtaaggggaacccctaaaggggttccggtaaccccggttcccgtaacgggtacccgacggtacccccgaaagggtccccgttcccggtacccccccgg

SEQ ID NO: 218312 - DNA, 517 bp, Homo sapiens
  misc_feature: GYAE6OF01BYJ43.9.53.E09.1.454.CMB.1.raw
  modified_base (510)..(510): a, c, t, g, unknown or other
  misc_feature (510)..(510): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagccccaaatcatcattatgagtcactaagcgccctcagggtttctattcgcttctctggctccaagtctgacaacacggcctcctgacaatctctgggctcaggctgaggacgaggctgattatactgctgctcatatgcagatggtgacacctccggtgtagttcgggcggagggaccaagggtcgaccgttctaggtcacgcccaaggcctcgcccccgtcggtcaccttcgtccgttccccgccctcctcgagtacgtntcgtacg

SEQ ID NO: 218313 - DNA, 618 bp, Homo sapiens
  misc_feature: GYAE6OF01ET3EP.9.53.E09.1.454.CMB.1.raw
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgcccgattaacgtgcaggaccctggtctcggcgagcggctttcaccgtctttatcgttacttatgtcagcattcgctacttctgatacctcagcatgcctcacagcacaccatttccgacctaggctttaaccacgtaaacccgcctaccccctaaccccaaaccaaaaccggaccacttaaacgccgttacgcctgacccgcctacggccttccggtgtccgtaatccgggtttttaagccccccggtttttccaccgtcctttaccccggaccctaacgttcctggtaaacg

SEQ ID NO: 218314 - DNA, 537 bp, Homo sapiens
  misc_feature: GYAE6OF01CKV7Z.9.53.E09.1.454.CMB.1.raw
  modified_base (304)..(304): a, c, t, g, unknown or other
  misc_feature (304)..(304): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgtgggattatgaccttgtctcctggtaccaacagcacccaggcaaacgcccccaaactcatcatttangaggtcactaagccggccctcgagggtttctattcgcttctctgctcaagtctgacacacgcctcctgacaatctctgggcctccgaggctggacggacgaggctagatttattactgtctgctcatatgactagatggtacgacctacgttcccgtggtagttccgggacgggtacgggtaccgaagggtcgacccgttcgacggtcacgccgaacggtccgtccgcccccg

SEQ ID NO: 218315 - DNA, 624 bp, Homo sapiens
  misc_feature: GYAE6OF01AV2VF.9.53.E09.1.454.CMB.1.raw
  modified_base (282)..(282): a, c, t, g, unknown or other
  misc_feature (282)..(282): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (403)..(403): a, c, t, g, unknown or other
  misc_feature (403)..(403): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagtgatacgtctcacgaccggtgctcgatttagagagagtgtgttgggttggggtctttggcctgggcttctgctgctcctcaccctcctcactcaggacacagggtcctggcccagtctgccctgactcagcctgcctccgtgtctgggtctcctggacagtcgatcaccatctcctgcgactggaaccagcagtcgagtgttcgggagttactgtaccttgtcctcctgggtaccaactagccacccaggacaaacgcccccaaatctatctatttangaggtcactaagcggcccctagaggggtttctagttcgtcttcgtcgtcggtctccaagtctagacaacgacgcctcctgacctactcncnggcctcgagctgagacgagctgacttatcngctcgctcatacncgactgagtcggnaccncgtcccggtgtacgtcggacggacggacgaacgggtcgtaacccggtaccgtaacgggttcgacggtaccccgaaggtcccttccccggtaccccccttcgggttacccaacccggtttcccggtaccccggtttacccccacccccggtttccgtaccgaaccgggttacccttagttcccgtaacccgg

SEQ ID NO: 218316 - DNA, 642 bp, Homo sapiens
  misc_feature: GYAE6OF01DGBWK.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctctgcactggaaccagcagtgatggttggggattatgtaccttgtctcctggtaccaacacgccaccgaggaccaaacgacccccaaactcatactattatgaggtacaactaacgccggcctcgtaggggtttctagttcgtcttctcgtggcctaccaagtctagaaccaacgaccggcctccctagaacctaacttcctcggttcgggccttaccgagggacgttaggacgggaacgaggtccttaggtaatttacttactgctgtcctacattatgactaagagtggtactaccgtaccgttcccggttaggttacggttcgggacgggtaacggggaacccgtaaggggttcccgacccggttaccgtaacggggtacccaaccgggtacccgaaaccgggtccgtccccggttaccccccggg

SEQ ID NO: 218317 - DNA, 629 bp, Homo sapiens
  misc_feature: GYAE6OF01CWNLM.9.53.E09.1.454.CMB.1.raw
  modified_base (134)..(134): a, c, t, g, unknown or other
  misc_feature (134)..(134): n is a, c, g, or t
  modified_base (278)..(278): a, c, t, g, unknown or other
  misc_feature (278)..(278): n is a, c, g, or t
  modified_base (336)..(336): a, c, t, g, unknown or other
  misc_feature (336)..(336): n is a, c, g, or t
tcagtgatacgtctcacgaccggtgctcgatttagagagagtgtgttggggtttggggctttgcctcgggctctgctgcttcctcaccctcctcactcaggacacagggtcctgggcccagtctgccctgactnagcctgcctccgtgtctgggtctcctggacagtcgatcaccatctcctgcactggaaccctagcaggttgatgttgggattatgaccttgtcgtcctgggtaccaacgagccaccaggccaaagacccccaactcatcatttangagtcattaagcggcctgagggtttctattcgcttctctggcctcagtctagacaacncggcctcctgacatcactgggctcaggctgaggacgaggtctagtattacttactgctcgctacatagtcgacagtagttgggtacgactacccgttcccgtagggttacgttcggggccgggtaagggaccgtaaagggttcggaccccggttcttaagggtaccaacggtacccgtaacgggtcccgttaccggccccccggttacgggtaccctacccggttcccgttacccggttaccccccaccccgtttcccctacgtaaccgtacccggttacctccgtaacccgg

SEQ ID NO: 218318 - DNA, 523 bp, Homo sapiens
  misc_feature: GYAE6OF01CN2ZU.9.53.E09.1.454.CMB.1.raw
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacgagggtcctgggcccagtctgccctgactcagcctgcctcgtgtctgggtctcctggacagtcatcacatctcctgcactggaaccagcagtgatgttgggattatgaccttgtctctggtaccaacagcaccaggcaaagccccaaatcatcatttangagtcatagcgcctgagggttctattcgcttcnctgctcaagtctagacacacggcctccngacaatctcgtggctcngtctagaggacgaggctagattatacngctgctcatatgctagtatggtnactaccgttccgtaggtacgttcggggacggtagggaacccgtaaggtccgtaccgtccgtaacgggttccacggcccgaaggtcctccggtcccccg

SEQ ID NO: 218319 - DNA, 512 bp, Homo sapiens
  misc_feature: GYAE6OF01BJB5P.9.53.E09.1.454.CMB.1.raw
  modified_base (305)..(305): a, c, t, g, unknown or other
  misc_feature (305)..(305): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (422)..(422): a, c, t, g, unknown or other
  misc_feature (422)..(422): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctcgtgtctgggtctctggacagtcgatcaccatctcctgcactggaaccagcagtgatggttggggattatgtaccttgtctcctggtaccaacagcaccaggacaaacgccccaaactcatcatttangagtcaactaacgcggcctcgtagggtttctattcgcttctctgctcagtctgacacncgctccngacatctcgtggctcgagtctgacggacgagctagtattatactgctgcctnatatgactagatggtacactaccgtcggtgtacgtcgggaggacggacaggtcgaccgtcgtaggtcacgccgaacgtcgtccgtccccg

SEQ ID NO: 218320 - DNA, 597 bp, Homo sapiens
  misc_feature: GYAE6OF01A3MZK.9.53.E09.1.454.CMB.1.raw
  modified_base (392)..(392): a, c, t, g, unknown or other
  misc_feature (392)..(392): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaacgcccccaaaatcatcatttatgaggtcactaagccggccctcgaggggtttctattcgcttctctggctcaagtctgacacacggcctcctgacaatctctggactccagcctgacagtgaggtcttatttattactgctagtnctatatgacgaggctaagttaactttacgttttgggttttcgggacgggtaacgggtaccgtacgggtacgaacccggttacctaaggttccgacgtcccaaggtcctccgcccccgttcggtcctaccgttccgttccgttaccccctacccgttccgtaccctaacggtacccgttactaccgtaccgtggaccggtccgggg

SEQ ID NO: 218321 - DNA, 543 bp, Homo sapiens
  misc_feature: GYAE6OF01C4UWK.9.53.E09.1.454.CMB.1.raw
  modified_base (304)..(304): a, c, t, g, unknown or other
  misc_feature (304)..(304): n is a, c, g, or t
  modified_base (438)..(438): a, c, t, g, unknown or other
  misc_feature (438)..(438): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacgagggtcctgggcccagtctgccctgactcagcctgcctccgtgtctgggtctctggacagtcgatcaccatctcctgcactggaaccagcagtgatggttgggattatgtaccttgtctcctaggtaccaacacgcacccagacaaacgccccaaactcatcattangagtcactaagcggcctgagggtttctattcgtcttctcgtcgctaccaagtctagacacgacggtccctcctagactaatcctcgtcgggcctccgaggctgaaggacggagctagtattatactgctgcctnatagtcgcgtagacgtggtcactccgttccgtggtacgtcgggcggtaacgggactaacgggtcgacccgtcgtacggtcacgccgtaactccgtcccgtccccg

SEQ ID NO: 218322 - DNA, 248 bp, Homo sapiens
  misc_feature: GYAE6OF01C1JQW.9.53.E09.1.454.CMB.1.raw
  modified_base (246)..(248): a, c, t, g, unknown or other
  misc_feature (246)..(248): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagccaaggctgccccctggtcactctgttcccgccctctcagacgtatcactgagcgggctggcaaggcgcatagnnn

SEQ ID NO: 218323 - DNA, 496 bp, Homo sapiens
  misc_feature: GYAE6OF01DUFOI.9.53.E09.1.454.CMB.1.raw
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaactaacagtgacgttggtgcttataattatgtctcctgtatcaacaacacccaggcaaacgcccccaatcattattctgatgtcaacaatcggcccccagggatttctgatcgcttctctggctccaagtctggcaacacggcctcctgaccatctctgggctcgggctgagacgaggctcactatactgcagctcatataacaaccagcgactactctgttcgttcggcggagggctagaactcgaccgtctagtcagccaagctcgcccctgtcactntcgtcccncctctcagactncntgacgg

SEQ ID NO: 218324 - DNA, 630 bp, Homo sapiens
  misc_feature: GYAE6OF01AUJA0.9.53.E09.1.454.CMB.1.raw
  modified_base (268)..(268): a, c, t, g, unknown or other
  misc_feature (268)..(268): n is a, c, g, or t
tcagtgatacgtctcacgaccggtgctcgatttagagagagtgtgttgggtttggggggggttctacgaagaggctagcgctctcgggacgtctccaccatggcctagggactctgactgcctcctcacccttcctcactcagggacacgagggtccctgggcccaggtcctgcccctgactcagcctgcctccgtgtctggggtcctccgtggacagtcgatcgaccactctcctgccactggaacctagcagtgatgttggattangaccttgtctccttgtaccaacagcaccaggacaaccgaccccgaaatcatcattatggagtcactaagccgtacctcgtagggtttctacttcgcttcgtctcggctacaagtctacgacaacacggtcctcctagacaactctcgtacgggacctccgacggtcctaggaacggacgaacggtcttacggtaacttacgtacgtcgtaccgtcgtacgttactagtagtggcgtaaggtacgtcggtaacgtacgaccgttccggtaggtacgttaccgggtacggacgggtaccgacgggttccggtaccggtaccggtacgggtaccgacgtacccggacggtccgtccggtcccccg

SEQ ID NO: 218325 - DNA, 250 bp, Homo sapiens
  misc_feature: GYAE6OF01A6JZT.9.53.E09.1.454.CMB.1.raw
  modified_base (248)..(250): a, c, t, g, unknown or other
  misc_feature (248)..(250): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctggtcactctgttcccaccctcctcagacgtatcactgagcgggctggcaaggcgcatagnnn

SEQ ID NO: 218326 - DNA, 746 bp, Homo sapiens
  misc_feature: GYAE6OF01DQSXJ.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcaccatctctgcactggaaccagcagtgagttggttggggatttatcgtacctttgtctccgttaggtaacccaacacgccacccaggaccaaaacgcccccctaaaactcaactctaatttatggaaggtccaacgtaacgccggtcccttacggtacggggttttcctagtttccgtctttcgtcgttcggacctaccgtaaagtcctagaacctaaaccgcccggtacccttccccgtagtaacctaacgttccgttccgttacgggacccttaccggaacgggtcgtacgggaacgggtaccggacgggtacgttacggttaacgtttacgtttaaccgtcgtccgttacggtaccttactaacgttacgtacgtaccgtaaggtacgttacgggtacgtacccgtaaccggttcccggttagggttaacggttccggggaacggggtaaccgggtaaccgtaacgggttccggtacccggtacgttacggtaccgaccggtaccccgaacgggtcccgtccccggtaccccccgg

SEQ ID NO: 218327 - DNA, 502 bp, Homo sapiens
  misc_feature: GYAE6OF01E3S7P.9.53.E09.1.454.CMB.1.raw
  modified_base (323)..(323): a, c, t, g, unknown or other
  misc_feature (323)..(323): n is a, c, g, or t
  modified_base (360)..(360): a, c, t, g, unknown or other
  misc_feature (360)..(360): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcacccaggcaaaagcccccaaatcatcatttatgagtcactaagcgcctnagggtttctattcgcttctctgctcaagtctgacacncgctcctgacaatctctggctcaggctgaggacgagctgattatactgctgctcaatatgctagatgtnaccnctccgtggtactcgggcggacggacaaggtcgaccgtctaggtcacgacccgaaggcctcggtcccccg

SEQ ID NO: 218328 - DNA, 572 bp, Homo sapiens
  misc_feature: GYAE6OF01BJYNX.9.53.E09.1.454.CMB.1.raw
  modified_base (228)..(228): a, c, t, g, unknown or other
  misc_feature (228)..(228): n is a, c, g, or t
  modified_base (307)..(307): a, c, t, g, unknown or other
  misc_feature (307)..(307): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttggggattatgtaccttgtctcctggtaccaacagcaccaggcaaacgccccaaactcatcatttacngagtcaactaagccgcctcgtagggtttctattcgtcttctctggctcaagtctgaacacacggcctcctgactatctcgtcgggctcgaggctggacggacgaggctagtatttacgttactgctgcttcaattatgctaagagttggtacgactccgtcccggtggttacggttccgggacgggtaacgggaccgtaagggttccgacccggttccgtacgggtaccgacggaccccgaacggtcccgtcccggtacccccgg

SEQ ID NO: 218329 - DNA, 253 bp, Homo sapiens
  misc_feature: GYAE6OF01AQP3P.9.53.E09.1.454.CMB.1.raw
  modified_base (249)..(253): a, c, t, g, unknown or other
  misc_feature (249)..(253): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccgccctcctcagacgtatcactgagcgggctggcaaggcgcatagnnnnn

SEQ ID NO: 218330 - DNA, 879 bp, Homo sapiens
  misc_feature: GYAE6OF01D0MKX.9.53.E09.1.454.CMB.1.raw
tcagtgatacgtctcacgaccggtgctcgatttagagagagtgtgttgggtttgggggctttgcctgggctctgctgctcctcaccctcctcactcaggacacgagggtcctgggcccagtctgccctgacacagcctgcctcgtgtcgtgggtcctccgtggacagtcgatcaccatctcctgcactggaaccagcagtgagtggttagggatttatcgtaccttgtcctacctaggaacccaaacgacgaccaacccgaaggaaccctaaaaaccgacccccccaaaaacttccaaacttaccgttaatttttaagtacggtaacgggttaccaaaccgttaaaacgggccccgggtacccctttacgggttaacggggggttttttaccttaacgtttccggtccttttacgttcccgttacggtaccttacccgtaaagttcctaacgtaaaccaaccgtaccggtccccttacccgtagaaacctaacgttccgtccggtacggggccttacccggaagggtactacggggaacgggtaaccggtaggtaccgttaagttaacgttttaaactttaccgtacgggtacctttacggtaccttactaaagttaacggttgaacctaagggtaattcgggtaacgtaccctaacccggtttcccgggtttagggtaaccggttacgggggacgggaaccgggtaaccggaagggttccggtaacccggttcgtaacggtccgaaccggacccggtaacggtccccgtacccggtacccccgttccggggtaaccttacccgttcccggttacccccgttaccccgacccccttacccggtaccgaaccggttaaacccgttgtacccgtaaccggg

SEQ ID NO: 218331 - DNA, 751 bp, Homo sapiens
  misc_feature: GYAE6OF01DWFD3.9.53.E09.1.454.CMB.1.raw
  modified_base (200)..(200): a, c, t, g, unknown or other
  misc_feature (200)..(200): n is a, c, g, or t
  modified_base (323)..(323): a, c, t, g, unknown or other
  misc_feature (323)..(323): n is a, c, g, or t
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacgagggtcctgggcccagtctgccctgactcagcctgcctcgtgtctgggtctcgtggacngtcgatcaccatctcctgcactggaaccagcagtgagttggttgggattatcgtaccttgtcctccgtacggtaaccaacacgccaccgacggaccaaaccgaccccaaactcatctatttanaggtagtacactaacgccggtcctcgtagggtttctagttccgtctttcttcgtcggccttaccgtaacgttccgtacgaaccgaaaccgacccgggtcccctacccgtagtaacctaacttccgtccggttcggggtccctaccggtacgggtccgttacgggaacgggtacggacggtcgttaggttaacttttacgttcgtacgtcgtcgtacttacgtaattacgttcgacgtacggtagttacgggttaccgaccgttacccggttcccgggttaggttacccgggttaccggggtaaccgggggtaacgggtaacccggttaaacggggtccccggttaaaccccgggttaccggttaaccgggtacccggaacccggtaaccccggtaacggggtccccttaccccggggttcccccccgg

SEQ ID NO: 218332 - DNA, 833 bp, Homo sapiens
  misc_feature: GYAE6OF01BJUQG.9.53.E09.1.454.CMB.1.raw
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatcctcctgcactggaaccagcagtgagttggttgggagtttatgtacctttgtcctccgtaggtaaccaacagccaacccgaggaccaaaccgccccaaactcatctatttagtgaggtcaacgtaacgccggcctcgtaggggtttctatttcgcttctcgtcggtcctaccgtaagttctacgaaccaaccgtaccggtcccttccctacgaacctaaacgttccgttccgtcggggtccttacccggaggtccgttacgggaacgggaaccggtacgggtaccttaggttaacgtttaacgtttaccgttacggtcctttacggtcctttaacccgtaagtttacgtacggtaccgtaaggtacggtttacggggttaaccgaacccgtttacccggttaccccggggtttaagggttaccggtttacgggggaccgggtaaccggggtacccggtaacggggttaccggtaccccgggttacccgtaacgggttaccccgaacggtaccccggaaacggttccccggttaccccggtacccccccggtttacgggttacccctaccccggtttcccgttcccccgggtttccccccgttaccccgttccccgttaccgaaccggtttaacccgttaccgtaccgttaacccgggg

SEQ ID NO: 218333 - DNA, 748 bp, Homo sapiens
  misc_feature: GYAE6OF01C6GFA.9.53.E09.1.454.CMB.1.raw
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacacaagtacaggatatacctgttccatcgactacgctttcggcctcgccttaggggtcactcaccctgccccgattacgttggacaggaacccttggtcttccggcgagcgggtctttcgacccgtctttatcgtttacttatgtcagcatttcgctactttctgtacttaccctccagtccactcgtacctcaaccacgcctaacctaaccctttccaaccgtacgggtccctttaaaccgaacgtaacccgtcccccttaacccccctaaaccccaaaccaaacccggtacctaaacgttaaaccgggtcccgttacccggacccttaccgggcccgacccgtaaccgggttcccgttttaccggggtacggacccgttaacggtttacggggttttaaccccggcccccccgggtttaccttttaccccgaccgttttccccccggtttacccccggtacccttaaccgttcccggttaacgggtaaaacccggg

SEQ ID NO: 218334 - DNA, 499 bp, Homo sapiens
  misc_feature: GYAE6OF01BFV8R.9.53.E09.1.454.CMB.1.raw
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaaactcatcatttatgaggtcactaagcggccctcaggggtttctattcgcttctctggctccaagtctgacaacacggcctccctgacaatctctgggctcagctgaggacgaggctgattatactgctgctcatatgcagatggtgacactcccgtgtatcggcggaggaccaagggtgaccgtctaggtcagcccaaggcctgcccccg

SEQ ID NO: 218335 - DNA, 655 bp, Homo sapiens
  misc_feature: GYAE6OF01CFVQQ.9.53.E09.1.454.CMB.1.raw
  modified_base (273)..(273): a, c, t, g, unknown or other
  misc_feature (273)..(273): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagccaaccaggaccaaacgcccccaaactcatctattangtagtcaacgtacgccggtcctgtagggtttctagttcgtcttctcgtcggctaccaagttcagacaaccgaccggcctcccgtagaacaacttccgtcgtcggcctaccgaggtcctaggacgggacgaggtctagtatttagttactgtctagccttanagtnacgtagaagtagtcggtacaccgtaccgttccggtaggtacgttcggggacgggaacgggaaccgtaagggtccgtacccggttcgtacgggtaccaccgacccggaacgtcccgtacccggtcccccgttcgggtaccttaacccggttcccttccccggtttcccccgccccttaccgtaaccgtacggtacccggttaactcccggtaaccggg

SEQ ID NO: 218336 - DNA, 547 bp, Homo sapiens
  misc_feature: GYAE6OF01CO2RV.9.53.E09.1.454.CMB.1.raw
  modified_base (291)..(291): a, c, t, g, unknown or other
  misc_feature (291)..(291): n is a, c, g, or t
  modified_base (393)..(393): a, c, t, g, unknown or other
  misc_feature (393)..(393): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcacccaggcaaaagcccccaaactcatcatttatgaggtcactaagcggccctnaggggtttctattcgcttctctggctccaagtctgacaacacggcctcctgacaatctctgggctccaggctgaggacgaggctagattattactgctgctnatatgcagatggtcgacactcccgttggtaacttcgggcggaacgggaccgaagggtcgaccgtccgtaaggtccaacggcccgaagggcctcgccccccgtcggtccacttcctcgtttcccccacccttccctacagaccgtattccgaccg

SEQ ID NO: 218337 - DNA, 599 bp, Homo sapiens
  misc_feature: GYAE6OF01C4U4X.9.53.E09.1.454.CMB.1.raw
  modified_base (407)..(407): a, c, t, g, unknown or other
  misc_feature (407)..(407): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacctttgtctcctggtaaccaacagccacccgaggaccaaaacgacccccaaactcatctatttatgaggtcactaagcggcctcgtaggggtttctattcgcttctctggctcaagtctagacaacgaccggcctcctgacaatctcgtggctcgaggctggaggacgaggtctgtattattactgtctgctnatatcgacagagtggtacgacctaccgttcccggtggttacgttcggggacgggaacgggaccgtaagggtcgaccgtcgtaggtcacggtacccgaacggccgtaccgcccccgttcggtcctaccgttcccgttcccggttcccccgccccgttacccgtaccgaggtaacccgttacgtccgtaaccgg

SEQ ID NO: 218338 - DNA, 259 bp, Homo sapiens
  misc_feature: GYAE6OF01BRUMN.9.53.E09.1.454.CMB.1.raw
  modified_base (251)..(259): a, c, t, g, unknown or other
  misc_feature (251)..(259): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctcgccccctcggtcactctcgttcccaccctcctcagacgtatcactgagcggctggacaaggcgcatagnnnnnnnnn

SEQ ID NO: 218339 - DNA, 572 bp, Homo sapiens
  misc_feature: GYAE6OF01AMTDM.9.53.E09.1.454.CMB.1.raw
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgccccaaactcatcatttatgaggtcactaagccggccctcgaggggtttctattcgtcttctctggctcaagtctgacaacacgcctcctgacaatctctcgggctccaggctgaggacgnggctgattatactgctgctnatatgcagatggtcgactaccgtccgtggtacgttcgggcggaacgggaccgaggtcgaccgtcgtacggtccgacgcccgaacggtcccgtccggtccccccgttcggtaccctaccgttcccgttaccggttccccccgccccttcccgtccgaacggtaccgttacctccgtaaccgg

SEQ ID NO: 218340 - DNA, 525 bp, Homo sapiens
  misc_feature: GYAE6OF01CB26O.9.53.E09.1.454.CMB.1.raw
  modified_base (303)..(303): a, c, t, g, unknown or other
  misc_feature (303)..(303): n is a, c, g, or t
  modified_base (364)..(364): a, c, t, g, unknown or other
  misc_feature (364)..(364): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctctgcactggaaccagcagtgatgttgggattatgaccttgtctcctggtaccaacagcacccaggcaaacgcccccaaatcatcatttangaggtcactaagcggcctcagggtttctattcgcttctctggcctccaagtctagacaacncggcctccctgaacctaatcctctcgggcctccagggcctggacggacgagcgtgtattattactgctgctcatntgcagatggtnacncgtccgtgtacgttcggacgggaggaccaagggtcgaccgtcgtaggtcacgcccaaggcctcggtcccccg

SEQ ID NO: 218341 - DNA, 568 bp, Homo sapiens
  misc_feature: GYAE6OF01A5O86.9.53.E09.1.454.CMB.1.raw
  modified_base (512)..(512): a, c, t, g, unknown or other
  misc_feature (512)..(512): n is a, c, g, or t
  modified_base (537)..(537): a, c, t, g, unknown or other
  misc_feature (537)..(537): n is a, c, g, or t
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggacccttggtcttccggcgagcgggcttttcacccgtctttatcgttacttatgtcagcattcgcacttctgatacctcagcatgcctcacacgcacaccttcacaggcttacacgacgcctcccctaccaacaacgcataacgcgtcgctcgccgcagccttcggncgtgttggtttacgcccccgttttnacttcccttcccgcctatccgtgaacgtacg

SEQ ID NO: 218342 - DNA, 259 bp, Homo sapiens
  misc_feature: GYAE6OF01AOAVW.9.53.E09.1.454.CMB.1.raw
  modified_base (255)..(259): a, c, t, g, unknown or other
  misc_feature (255)..(259): n is a, c, g, or t
tcagtgatacgtctcacgaccggtgctcgatttagagagagtgtgttgggtttgggggtgtggtggtctccactcccgccttgacggaggctgattattactgctgctcatatgcagatggtgacactcccgtggtattcggcggaggaccaaggtgacccgtccgtaggtcacgcccaaggctcgccccctcggtcactcttcgtcccaccctcctcagacgtatcactgagcgggctggacaaggcgcatagnnnnn

SEQ ID NO: 218343 - DNA, 675 bp, Homo sapiens
  misc_feature: GYAE6OF01DL85W.9.53.E09.1.454.CMB.1.raw
  modified_base (229)..(229): a, c, t, g, unknown or other
  misc_feature (229)..(229): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacgagggtcctgggcccagtctgccctgactcagcctgcctccgtgtctgggtctcctggacagtcgatcaccatctcctgcactggaaccngcagtgatgttggattatgactgtctctgtacaacagcaccaggacaaacgccccaaactcatctattatgaggtacactaacgcggcctcgtagggtttctacttcgtcttctcgtcggcctaccgaaagttctagtaaccaaaccgacccggtacccctaccccgtacgaacctaaacttccgttaccgtcggggtaccttacccggaacgggtacccgttagggaaacgggtaaccggaacgggtaccgttaggtaatttaactttaacgttcggtaccgtgtaccgttactaattagtacgactagagttggttacgaccttaccgttcccggtaggttacgttccgggacgggtaacggggaaccgtaagggtccgtaacccggttaccgttaacgggtacgacggaccccgaaacgggtcccgttcccggtaccccccgg

SEQ ID NO: 218344 - DNA, 584 bp, Homo sapiens
  misc_feature: GYAE6OF01EUQ0I.9.53.E09.1.454.CMB.1.raw
  modified_base (297)..(297): a, c, t, g, unknown or other
  misc_feature (297)..(297): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctctcactcaggacacagggtcctgggcccagtctgccctgactcagcctgcctcgtgtctgggtctcgtggacagtcgatcaccatctcctgcactggaaccagcagtgatgttgggattatgaccttgtctctggtaccaacagcaccagcaaacgccccaaatcatcattangagtcactagcggcctgtacgggtttctacttcgtcttctcgtcgtctacaagtctgacaacgacgccctcctagacaattctcgtggcctccgaggtctaggaacgggacgaggtcgtgtaatttacgttacgtgctgtctcaatactgacgtagtagtggtacgtaccgtaccgttccgggtaggttaccggtcgggaggggaacggggtacccgaaaggggttcgaaccccggttacgttacggtaccgacggacccggaaacggtccgtcccggtacccccgg

SEQ ID NO: 218345 - DNA, 250 bp, Homo sapiens
  misc_feature: GYAE6OF01DHVWY.9.53.E09.1.454.CMB.1.raw
  modified_base (249)..(250): a, c, t, g, unknown or other
  misc_feature (249)..(250): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctggtcactctcgttcccaccctcctcagacgtatcactgagcgggctggcaaggcgcatagnn

SEQ ID NO: 218346 - DNA, 574 bp, Homo sapiens
  misc_feature: GYAE6OF01C7YVB.9.53.E09.1.454.CMB.1.raw
  modified_base (236)..(236): a, c, t, g, unknown or other
  misc_feature (236)..(236): n is a, c, g, or t
  modified_base (376)..(376): a, c, t, g, unknown or other
  misc_feature (376)..(376): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacctttgtctcctggtaaccaangcacccaggcaaaacgcccccaaatcatcatttatgaggtcactaagccggccctgaggggtttctattcgtcttctctggctccaagtctgaaccaaccgaccggcctccctagactaatctcgtgggctccgaggtcnggaggacgagctgattattactgctgctacattatgctagtttcgttccttctttacaagtactagttcgggacgggaacgggaccaggtctacgccgttcgtgacgtcgacgcccgaaggtcctccggtcccccgtggtacctccgttccttccggttaccccctacccttccctaccgtaacgacgttctaacccg

SEQ ID NO: 218347 - DNA, 702 bp, Homo sapiens
  misc_feature: GYAE6OF01C1Z40.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctctgcactggaaccagcagtgatggttgggattatgtaccttgtctcctggtaccaacagcaccgaggacaaacgccccaaactcatctattatgaggtcactaagccggaccctcgtacgggtttctagttccgtcttactcgtcggccttccgaagttctagtaaccaaccgtacggtccccttaccctacgaacctaacttccgtacgttcggggacctcccgacgggtacctacgggtaacggggaaccggaacgggtccgttaggtaaattttacgttaacgttaggccgtttcgtaccttaacgtaatttacgtaggtacgtaaggtaacgttgggttaccgaacccgttaccgtttaccccggttaggggtacgtttacccggggacggggtaaacggggtacccgtaaagggtcccggtaacccggttaccgtacgggttaccaacggaccccgtaaacgggtcccgtcccggtaccccccgg

SEQ ID NO: 218348 - DNA, 666 bp, Homo sapiens
  misc_feature: GYAE6OF01EIKXW.9.53.E09.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
tcagtgatacgtctcacgaccggtgctcgatttagagagagtgtgttggggtttggggggggtcacaagaggcagcgctctccgggacgtctccacctatggcctggctctgctgctcctcaccctctcactcaggacacagggtcctggcccagtctgccctgactcagcctgcctcgtgtctggtctctggacngtcgatcacatctcctgcactggaaccngcagtgattggttggattatgtaccttgtacctaccgtaggtaacccaactacgaccaacccgaggaccaaaccgacccccaaactcgactctaatttacgtcggacggtaccaacgtaacgccggtaccctgtacgggtttctagttccgctttcgtcgtcggcctacctaagttcctacgaaccaaccgaccggtccctaccctagaacctaacttcgtacgtcgggacctcgacggtctggacggtacgtaggtctagtactttagtacgtgacttgtctacgtattacgtcgaccgtaccggaccctaacccgagtacggttcgtaccggtttaaccgggaaggttaccgggaaccctacgggtacccgtacccggttccgtaacgggtcccaacccggtaccccgaaacgtaccccctaacccgttcgtcgttaccc

SEQ ID NO: 218349 - DNA, 555 bp, Homo sapiens
  misc_feature: GYAE6OF01AX4XD.9.53.E09.1.454.CMB.1.raw
  modified_base (225)..(225): a, c, t, g, unknown or other
  misc_feature (225)..(225): n is a, c, g, or t
  modified_base (302)..(302): a, c, t, g, unknown or other
  misc_feature (302)..(302): n is a, c, g, or t
  modified_base (381)..(381): a, c, t, g, unknown or other
  misc_feature (381)..(381): n is a, c, g, or t
  modified_base (418)..(418): a, c, t, g, unknown or other
  misc_feature (418)..(418): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcacccaggcaaacgcccccaaactcatcatttangaggtcactaagcggccctcgaggggtttctattcgcttctcgtggctccaagtctgacacacggcctcctgacatctntgggctccgagtctgaggacgaggctgtattattacngctgctcgattatgactagtagttggtacgactaccgttccggttggttacgttccgggacgggacgggtacccgaagggtccggacccggtcgtacggtaccgacggacccgaacgggtccgtccggtccccccgg

SEQ ID NO: 218350 - DNA, 694 bp, Homo sapiens
  misc_feature: GYAE6OF01DO7FN.9.53.E09.1.454.CMB.1.raw
  modified_base (276)..(276): a, c, t, g, unknown or other
  misc_feature (276)..(276): n is a, c, g, or t
  modified_base (318)..(318): a, c, t, g, unknown or other
  misc_feature (318)..(318): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccagcagtgagttggttgggattatcgtacctttgtcctccgtaggtaaccaacncgaccacccaggaccaaaccgacccccaaaatcatctattangagtacacgtaacgccgacctcgtagggtttctagttccgtcttctcgtcggtcctaccgtaaagtcgttacgaacctaaacccgtacccggtcccttacccgtacgaacctaacgttccgttccggtacgggtcccttaccggacgggtacgtacgggaacgggtaaccgtagggtccttaagttaactttacgttaacgtcgtcgttcgacttacgtaattagtcgacgtaggtagttacggtacgaacccgtaccggttcccggttagggtaccgttccggggaacgggtaccgggtaaccgtaacgggtcccgtaccggttaccgacgggtccaaccggtacccggtaacggtccctaccccgggtcccccg

SEQ ID NO: 218351 - DNA, 505 bp, Homo sapiens
  misc_feature: GYAE6OF01EDG8I.9.53.E09.1.454.CMB.1.raw
  modified_base (269)..(269): a, c, t, g, unknown or other
  misc_feature (269)..(269): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaacgcccccaaactcatcatttangaggtcactaagcggccctcgaggggtttctattcgcttctctggctccaagtctgacaacacgcctcctgacaatctctgggctccgaggctaggaggacgaggctgtaatttacttactgctgctacatatgcagatggngacncgtccgtggtactcgggcggacgggacagggtcgaccgtctaggcagccagcctcgcccgtgcnctctcgtcccncctcncagctncncg

SEQ ID NO: 218352 - DNA, 613 bp, Homo sapiens
  misc_feature: GYAE6OF01C9CQ4.9.53.E09.1.454.CMB.1.raw
  modified_base (249)..(249): a, c, t, g, unknown or other
  misc_feature (249)..(249): n is a, c, g, or t
  modified_base (309)..(309): a, c, t, g, unknown or other
  misc_feature (309)..(309): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacgagggtcctgggcccagtctgccctgactcagcctgcctcgtgtctgggtctcctggacagtcgatccaccatctcctgcactggaaccagcagtgattggttgggattntgaccttgtctcctggtaccaacagcaccaggcaaacgccccaaaactcatccatttagngaggtcactaagcggccctcgtagggtttctattcgcttctctcgctcaagtctgacacgacggcctcctgactaatctctcgggctccaggctggaggacgaggctgactttatactgtctgctactaattatcgacgtagtacgttggttacggtaccaccggtttccccggttagggttaccgttaccgggccgggggaaaccgggtaacccgggtaaagggttccggaaaccccgtttaccggttacgggtacccgaacgggacccccgaaaggccccggttaccccggtcccccccggg

SEQ ID NO: 218353 - DNA, 260 bp, Homo sapiens
  misc_feature: GYAE6OF01EZ25Z.9.53.E09.1.454.CMB.1.raw
  modified_base (255)..(260): a, c, t, g, unknown or other
  misc_feature (255)..(260): n is a, c, g, or t
tcagtgatacgtctcacgaccggtgctcgatttagagagagtgtgttgggtttggggggtgtggtggtctccactcccgccttgacgaggctgattattactgctgctcatatgcagatggtgacactcccgtggtattcggcggagggaccaaggtgaccgtcctaggtcacgcccaaggctcgccccctcggtcactctcgttcccgccctcctcagacgtactcactgagccggctggcaaggcgcagtagnnnnnn

SEQ ID NO: 218354 - DNA, 581 bp, Homo sapiens
  misc_feature: GYAE6OF01BLKM1.9.53.E09.1.454.CMB.1.raw
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagccacccaggccaaacgcccccaaactcatcatttatgagtcactaagccggccctcgtaggggtttctattcgcttctctggctccaagtctgacaacacggcctcctgacaatctcgtgggcctccgaggtctaggacggacgaggctagtaatttacttactgctgctcatatgcagtatggtacgaccgtacgtcccggtggtacgttcgggacgggacgggaccgtagggtcgaccgtctacggtcaacggcccaaggtcctccgcccccgttcggtacccaccgttccgttccggttacccccgccccgttaccctccgaacgtaccgttctccgtaacgg

SEQ ID NO: 218355 - DNA, 757 bp, Homo sapiens
  misc_feature: GYAE6OF01B7G5O.9.53.E09.1.454.CMB.1.raw
  modified_base (221)..(221): a, c, t, g, unknown or other
  misc_feature (221)..(221): n is a, c, g, or t
  modified_base (311)..(311): a, c, t, g, unknown or other
  misc_feature (311)..(311): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctctcactcaggacacaggtcctgggcccagtctgccctgactcagcctgcctcgtgtctgggtctctggacagtcatcaccatctctgcactggaaccngcagtgatggttggattatcgtaccttgtctctaggtaaccaacagaccaccgaggacctaaacgtaccccaaactcagttgtaatttangaagtacaatacgccggtcctcgtcgggtccctggtactcgtcttcgtcgtcggtcctaccgtaagtctacggacctaaccgaccggtcccttccgtacggacccgttctcggtacgggtccctaccgtacggtcctaggaaccggtagttacgggaagtccgttaaggttaaacttttaacgttaaccgttcggacgttaaccgtacctttaacgaacgtttacgtcggtaacccggaaccggaacccttaacccccgaaagttaaacggtttccggttaacccggtttaacccgggggtaaacgggtacccgggttaaaccccgtaaccggggttaccccctaaccgggtttaacccccgtaagggttaaccccgaaacccgggaaaccccccgtaaaacccggggtaacccccctaaaccccccggttaacgtttacccccgg

SEQ ID NO: 218356 - DNA, 657 bp, Homo sapiens
  misc_feature: GYAE6OF01D7G9E.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgcctcctcaccctcctcactcgaggacacgagggtcctgggcccagtctcgccctgactcacgcctcgcctcgtgtcgtgggtctccgtggacagtcgactccacctattcctccgtgaccacgtacggaaccagctaggtgagttgggttggggtaattctcgtacctttcgtccttccgtacggtaaccaacgacgacccaacccgaggaccaaaccgacccccaaatcacttactaatttagacgacgtacaacgtaacgccgtccgtacggttacgggtttctacgttcgttcttcgtcgtcggcctacgtacgtctacgacaaccgccgtcctcctagactactcgtcggtcgcctacgacggtcaggacggagacgtcttagtactttacgtacgtgtctgtactagagttacgcgacgtagttacgtcgacgtaccgtccgtccgggttagtccgggttacgggacgggtaacgggtacgacggtccgtaccgttcggaccgtcggaccgtacccggacgtccctcccggtaccccgg

SEQ ID NO: 218357 - DNA, 679 bp, Homo sapiens
  misc_feature: GYAE6OF01DFZ0Q.9.53.E09.1.454.CMB.1.raw
  modified_base (199)..(199): a, c, t, g, unknown or other
  misc_feature (199)..(199): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacaggtcctgggcccagtctgccctgactcagcctgcctccgtgtctgggtctccgtggacngtcgatccacctatctcctgcactggaaccagcagtgagtggtgggattatcgacctttgtctaccgttggtaaccaacgacgcgaacccacggaccaaaaccgtcccccaaactctactctaagtttacgtagaacggtacaacgtaacgccggtccccgttagtacggggttttctaacgtttccgctttcgtcgtcggactccgtaaaggttcctacggaacctacccgaccggtccctacccgtacggtaactaactccgttaccgggtcggtcccttaccggacgggtcgtaggacgggtacggtaggccttagtactttacgttacctggttcctaggtcttactaatagttacggactaggttacgttgtaccggactaccggtcgttacggtcggttaccggacgggaacggtaacgacgggttaccgccggtaccgtaggtccacggacccgacgtccgtccgtaccccgg

SEQ ID NO: 218358 - DNA, 512 bp, Homo sapiens
  misc_feature: GYAE6OF01CD0Z7.9.53.E09.1.454.CMB.1.raw
  modified_base (305)..(305): a, c, t, g, unknown or other
  misc_feature (305)..(305): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttggggattatgaccttgtctcctggtaccaacagcaccaggcaaacgccccaaactcatcatttangaggtcactaagcggcctcgagggtttctattcgcttctctggctcaagtctgacacacgcctcctgactaatctctcgggctccgaggctggaggacgaggctgtattattacgtgctnctcatangcagatggnacncgtccgtgtctcgggacggaggacaggtcgacccgtcgtacggtcacgcccgaaggcctcgtcccccg

SEQ ID NO: 218359 - DNA, 590 bp, Homo sapiens
  misc_feature: GYAE6OF01C8MG6.9.53.E09.1.454.CMB.1.raw
  modified_base (377)..(377): a, c, t, g, unknown or other
  misc_feature (377)..(377): n is a, c, g, or t
  modified_base (423)..(423): a, c, t, g, unknown or other
  misc_feature (423)..(423): n is a, c, g, or t
  modified_base (450)..(450): a, c, t, g, unknown or other
  misc_feature (450)..(450): n is a, c, g, or t
  modified_base (471)..(471): a, c, t, g, unknown or other
  misc_feature (471)..(471): n is a, c, g, or t
  modified_base (516)..(516): a, c, t, g, unknown or other
  misc_feature (516)..(516): n is a, c, g, or t
  modified_base (528)..(528): a, c, t, g, unknown or other
  misc_feature (528)..(528): n is a, c, g, or t
  modified_base (547)..(547): a, c, t, g, unknown or other
  misc_feature (547)..(547): n is a, c, g, or t
tcagtgatacgtctcacgaccggtgctcgatttagagagagtgtgttgggtttggagtacgatttgatgttacctgatgcttagaggcttttcctggaagcagggcatttgttgcttcagcaccgtgtgcctcgtcatcacgcctcagccttgtattttccggatttgcctaggaaaaccagcctacacgacttaaaaccgggacaaccgtcgcccggccaacatacgccttctcccgtccccccttgacaagtaacacaagtacaggaatattaactgtttccatcgactacgcctttcgcctcgccttaggggcactcacctcgcccattaacgtgacagtaccttggcctcggcgagcggtctttcgacccgtntttatcgtttactatgtcagtctattcgctacttctgacttacccnctagcatcgcctcacagcactaccttnacgtacgtactacacgaaccnccctacccaaccaacaacgcaactaagcccgtacgcctacggccnacggtcttcggngacctagttcggtttaccncccgtttacgacttcccgttcccgactatctagaacgtaaccg

SEQ ID NO: 218360 - DNA, 755 bp, Homo sapiens
  misc_feature: GYAE6OF01CW8YM.9.53.E09.1.454.CMB.1.raw
tcagtgatacgtctcacgaccggtgctcgatttagagagagtgtgttgggtttgggggctttgcctgggctctgctattcctcaccctcctcactcagggcacagggtcctggacccagtctgccctgactcaacctgcctccgtgtctgggtctcctggacagtcgatcaccatctcctgcactggaaccagcagtgacattaggtattaactatgtctcctggtaccaacaactacccggacaaacgccccaaactcttgctttatgatgtctagttatccggcctcgaggtatttctgtactcgtccttctcgtcgcctaccaagttcgtcggaccacccgacggtccctccccgtacgacctactcgtacgtcgggcctccgaggtctcggaacggacggacggtcttaaggtatttactttcgtacgtacctaacggtaactaaacaaaaaaggtacgtaaccgtacccctttacggtttaccgggtttacggggttttccgggggacccggggtaaccggtaacgggtccgtaacccggttaccgtaacggttacccgaccggtaaccccggtaacgggtcccctaccccgggtaccccccgttacggttacccgaaccctttcccggttacccgttcccccccgttacccgtccccgtaacgtaccggtaacccgttaactacccgtacgttaccgggacccgggtaccgggtccgtacgggacccgtaacgggcccgacgtaaacgg

SEQ ID NO: 218361 - DNA, 688 bp, Homo sapiens
  misc_feature: GYAE6OF01CS8QO.9.53.E09.1.454.CMB.1.raw
  modified_base (245)..(245): a, c, t, g, unknown or other
  misc_feature (245)..(245): n is a, c, g, or t
  modified_base (441)..(441): a, c, t, g, unknown or other
  misc_feature (441)..(441): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtcgtgggtctccgtggacagtcgatcaccatctcctgcactggaaccagcagtgattggttgggatttatcgtaccttgtcctccgtaggtacccaacngccaacccgagggaccaaaccgacccccaaaactcatactaatttataggaggttacacgtaacggccggccctacgtaggggtttctagttccgctttccgtcgtacggtcctacgtaagttcgacgaaccaacgaccggtccctacccgtagaacctaactctacgtcggacctcgaggtctagggaggacggnggtactagtaattacttagtgtctagcttacgaattacgtacgacgtaagtagtacggtacgaccttaaccgttcccgggtaggttaaccggttcggggacgggaacgggaaccgtaacggggtacgtacccggttacggtacgtaccgaccgtacccgtaacgggcccttccggtcccccgtcgggtaccttacctccgttacccgttcccccacccttccacccgagtaccgttactccggtacg

SEQ ID NO: 218362 - DNA, 808 bp, Homo sapiens
  misc_feature: GYAE6OF01DBE9V.9.53.E09.1.454.CMB.1.raw
  modified_base (170)..(170): a, c, t, g, unknown or other
  misc_feature (170)..(170): n is a, c, g, or t
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
tcagtgatacgtctcacgaccggtgctcgatttagagagagtgtgttgggtttggggctttgcctgggctctgctgctcctcaccctcctcactcaggacacagggtcctgggcccagtctgccctgactcagcctgcctccgtgtcgtggtctctggacagtcatcacntctctgcacgtagaccngcagtgagtgtagggattancgtaccttgtcctcgtacgaaccaacgcgccaaccgaggaaccaaaaccgacccccaaatccattactagtttagcggacgtacaacgtacggccggtaccctggttaacgggtttcttacttccgtctttccgtcgtcggtaccctttaaccgaacgttccgtaacggaaacccaaacccggtccccggtcccctttacccgtaagtaaacccttaaacgttcccgttccgtaccggggtaccctaccggtacggtacccgtaagggaaccggtaacgggtaacgtccgtttaaaggttaacttttacgttaaccgtgtacccgttatacgtttactaaatacggtacgtacgtaagggttacgttcggaactaacccgttacccgggttttcccgggttaggttaccgggttacccgggggaaacggtaaccggggtaaccgttacgggtacggtaccccgttacgttacgggacgaaccccgaacgttaccggcccgttacccggtaacccccgttcgggtaaccctaccgttcccgttacccccgttaccccgacccctttcggaacgtaacccggttccgtaactcccggtaacgg

SEQ ID NO: 218363 - DNA, 615 bp, Homo sapiens
  misc_feature: GYAE6OF01CS2RD.9.53.E09.1.454.CMB.1.raw
  modified_base (131)..(131): a, c, t, g, unknown or other
  misc_feature (131)..(131): n is a, c, g, or t
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (232)..(232): a, c, t, g, unknown or other
  misc_feature (232)..(232): n is a, c, g, or t
  modified_base (330)..(330): a, c, t, g, unknown or other
  misc_feature (330)..(330): n is a, c, g, or t
  modified_base (426)..(426): a, c, t, g, unknown or other
  misc_feature (426)..(426): n is a, c, g, or t
tcagtgatacgtctcacgaccggtgctcgatttagagagagtgtgttgggtttggggctttgcctgggctctgctgctcctcaccctcctcactcaggacacagggtcctgggcccagtctgccctgactnagcctgcctcgtgtctgggtctctggacagtcgatcaacntctccgtgacactggaaccngctagtgatggttggattatcgtacttgctctaggaccaangcaccaggacctaaacgacccctaaatcatataatttatagacggtacaacgtaacgccggtaccctaggtacggggtttactacgttctcttccgtntggtcctactaagtctacgacaacgaccgtcctcctagacaactctcgtcgctcgagtcgagcggacgagactagtattattaacgcgctgactanatagtagacgagtagtggtacgacctaccgtccggttaggtaacgttcgggaacgggtaccgggaacgtaacgggtaccgtaccgtacgttaacggcaaccggaccgtaacggcccgtaccgccccgtacgtacctactccgttacccgttccccaacccttcccgaataccgtacgtactcgtaacgg

SEQ ID NO: 218364 - DNA, 792 bp, Homo sapiens
  misc_feature: GYAE6OF01C0WTO.9.53.E09.1.454.CMB.1.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacgagggtcctcgggcccagtctcgccctgactcagcctgcctccgtgtctgggtctcctggacagtcgatcaccatctcctgccacgtaggaaccagcagtgagttggttggggtattatcgtacctttgtctccgtacggtaaccaacacgccaacccgaggaccaaaaccgccccctaaaatctaatctaatttacgtagagtacgaacgtaacgccggtccctagtacgggtttactacttcgtctttctcgttcggccttacgtaacgtcctacggaaccctaaccgacccggtccccttacccgtacgaaccgtaaccgttccgtttaccggtcggggtaccttacccggaaggggtccgttaacggggaacggggtaaccggagggttccttaaggttttaactttaaaccgtttacgtccggtcttacggttacctacgtaacttaacggtccgtaacgtaaggtacgtttcgggtaaaccggtacccgttaaccccggttcccggggtttaggtacccggggttaccgggggaacccggggtaaacggggaacccgtttaaggggttacccgttaacccggtttaccggtaacggtacccggtacggaaccccggtacggtcccgttccccggggtaaccccccg

SEQ ID NO: 218365 - DNA, 564 bp, Homo sapiens
  misc_feature: GYAE6OF01BFHQP.9.53.E09.1.454.CMB.1.raw
  modified_base (226)..(226): a, c, t, g, unknown or other
  misc_feature (226)..(226): n is a, c, g, or t
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (408)..(408): a, c, t, g, unknown or other
  misc_feature (408)..(408): n is a, c, g, or t
  modified_base (436)..(436): a, c, t, g, unknown or other
  misc_feature (436)..(436): n is a, c, g, or t
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctcgtgtctggtctctggacagtcgatcaccatctcctgcactggaaccngcagtgatggttggattatgtaccttgtctcctggtaccaacngccaccaggacaaacgccccaaatcatcatttangagtcactaagccgcctcgtagggtttctattcgtcttctctggctcagtctagacacgcgcctcctgactaatctcgtcggcctccgaggtctaggacggacgnggtactggtattacttactgtctgctanattatgacgtagtagtgtacgtaccgtaccgttccggtaggttacggttccgggacggacgggtaccgaaggtcggtacccgtacgtaggtaccacggacccgtacggtcccgtccggtaccccccgg

SEQ ID NO: 218366 - DNA, 718 bp, Homo sapiens
  misc_feature: GYAE6OF01DF2MP.9.53.E09.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (533)..(533): a, c, t, g, unknown or other
  misc_feature (533)..(533): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctcgtgtctgggtctctggacagtcgatcacatctccngcacgtgaaccngcagtgagttggttaggggattatcgtaccttgtccttccgtaggtaacccaacacgtacccgaaccgacggaaccaaaaccgacccccctaaatccaattacctatttacgcgaacggtacctaacgtaacggccggtcccgttacggtacggggtttaccttagtttccggtctttccgtcgtacggtcctaaccgtaacgtctacggaacctaaaccgtaccggtcccctacccgtacgtaacctaacgttcccgtcggtacgggtacccctacggtacggacggttacggaaacggggtaacgngggtaccgttagttaacttacgtttaaccgtcgtaccgttcgacttacgtagttacgtcgaacgtaggacgttgtaccgacgttaccggtccggttaggtacggttcccggagggaaccgggtacgtacggtcccgtaccgttcggaacgtccgaacggaccgccggtcgttccccggtccccgg

SEQ ID NO: 218367 - DNA, 847 bp, Homo sapiens
  misc_feature: GYAE6OF01DHARV.9.53.E09.1.454.CMB.1.raw
  modified_base (178)..(178): a, c, t, g, unknown or other
  misc_feature (178)..(178): n is a, c, g, or t
  modified_base (201)..(201): a, c, t, g, unknown or other
  misc_feature (201)..(201): n is a, c, g, or t
tcagtgatacgtctcacgaccggtgctcgatttagagagagtgtgttgggtttggggctttgcctgggctctgctgctcctcaccctcctcactcaggacacgagggtcctgggcccagtctcgccctgactcagcctgcctcgtgtctgggtctccgtggacagtcgatccaacctntcctcctgaccacgtaggaaccngctaggtgtagttggttagggattatcgtacttgtcctacgtaggaaccaagcgaccaaccgaggaaccaaaccgacccaactacacttactatttagacgtacggtactaacgtaacggtccggtccgttacggttacggggttttaccttacgtttccggttcctttccgtaccgttacgggtacccttaaccgtaacggttaccgtaacggtaaacccgaaaccggtacccggttacccttacccgtaacgtaacctaacgttccgtaccggtacggtaccgttccggacggtacggtacgggaacgggtacggtacggtacgttacgttaagtttacgttacgtcgttcgtacgtactactaagttacgtacgtagtacggtaggttacggtaccgtaaccgttcccggttaccgggtttagggttaaccgggtccgggggaaccgggtaacgggaaccggtaacgggttaccggtaacccggttacgtaacgggtacccgaaccggaacccgtaccggtacccggttaccccgttccccggttaccggtacccgttacccgtttccccggttaccccgttaccccccgttacccgtacccgttaccggtaacgtttacccgtaaccgtcggttaacccggg

SEQ ID NO: 218368 - DNA, 618 bp, Homo sapiens
  misc_feature: GYAE6OF01CQKKI.9.53.E09.1.454.CMB.1.raw
  modified_base (192)..(192): a, c, t, g, unknown or other
  misc_feature (192)..(192): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtcctccgtggtaacccaacagccaacccgagggaccaaaaccgacccccaaaactcaatctaattttatgaggtcaactaagccggccctcgtaggggtttcttattcgtcttctctggctccaagtctagacaaccaccggcctcctagactaatcgtcgtcgggtctccgaggtcgtggaggacggaggtctaggtatttattactgtctcgctatatatgcgagagtggtacgacgtaccgttcccggttaggttacggtcgggacgggacgggaaccgtaagggtcgtaccgttcgtacggtcacggacccgaacggtccgtccgtcccccgtcgtcctaccttccgttcccgttaccccctacccttccgactacgtaaccgtcgtccgtacgg

SEQ ID NO: 218369 - DNA, 255 bp, Homo sapiens
  misc_feature: GYAE6OF01C6Z73.9.53.E09.1.454.CMB.1.raw
  modified_base (248)..(255): a, c, t, g, unknown or other
  misc_feature (248)..(255): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctggtcactctgttcccgcctcctcagacgtatcactgacgcgggctggcaaggcgcatagnnnnnnnn

SEQ ID NO: 218370 - DNA, 788 bp, Homo sapiens
  misc_feature: GYAE6OF01C11BI.9.53.E09.1.454.CMB.1.raw
  modified_base (194)..(194): a, c, t, g, unknown or other
  misc_feature (194)..(194): n is a, c, g, or t
  modified_base (238)..(238): a, c, t, g, unknown or other
  misc_feature (238)..(238): n is a, c, g, or t
tcagtgatacgtctcacgaccggtgctcgatttagagagagtgtggttgggtttgggggctttgcctgggctctgctgctcctcaccctcctcactcaggacacagggtcctgggcccagtctgccctgactcagcctgcctccgtgtctgggtctcctggacagtcgatccaccatctcctgcactggaaccngcagtgatggttgggattatcgtaccttgtctccgtagtaccancgcaccgaggaccaaaccgaccccaaactcactactaacgtttagtacggacggtacctacgtaacggccggacccgttacggttacggggttttcttaacgtttcgtcctttccgtcgtcggtcctaccgaagttccacgtaaccaaaccggcccggtacccttacccgtagaaccgtaacttcgtcgtggggtaccctccggacggtctagggacggacggtaggtccttaggttaacttaacgttacgtcgtacctcgttaccttgtaacgttaatccggtaacgtaggttacgttacgggtaccgtaacccgttcccgtttaccggggttaacggttaaccggtttcccggggaacggggtaaccgggtaaccccggtaacggggttacccgtacccgggttaccgttaaccggggttaccaaacccgggtcccgtaaccgggttccctaccccggtcccccggttaccggtccccttacggttccccttacccggtacccctaccccgttaccgtaccgaacgttacccgttagcccgtaacggg

SEQ ID NO: 218371 - DNA, 624 bp, Homo sapiens
  misc_feature: GYAE6OF01AZKZE.9.53.E09.1.454.CMB.1.raw
  modified_base (214)..(214): a, c, t, g, unknown or other
  misc_feature (214)..(214): n is a, c, g, or t
  modified_base (237)..(237): a, c, t, g, unknown or other
  misc_feature (237)..(237): n is a, c, g, or t
  modified_base (280)..(280): a, c, t, g, unknown or other
  misc_feature (280)..(280): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (416)..(416): a, c, t, g, unknown or other
  misc_feature (416)..(416): n is a, c, g, or t
  modified_base (434)..(434): a, c, t, g, unknown or other
  misc_feature (434)..(434): n is a, c, g, or t
tcagtgatacgtctcacgaccggtgctcgatttagagagagtgtgttgggtttggggcgtttggcctgggctctgctgctcctcaccctcctcactcagacacagggtcctgggcccagtctgccctgactcagcctgcctcgtgtctgggtctcgtggacagtcgatcaccatctcctgcacgtcggaaccagcagtgagtgttgggatttangtacctttgctcgtagtaccaanacgccaccaggtacaaaccgaccccaaactcatctaagtttangacggtcacgtaagccgcctcgagggtttctagttctcttcgtctgtctccagtcagacacgcgcctccacgactatcncgtggcctcgnggctaggacggacgngctggtaactttagtactgctgcttacattnacgtcaagtacgtggtanccgtaccgttcccgggttgtacggtttcgggacggtacgggaactcgggtacgtacccgttcggtacggtcaaccggacgaggtcccttaccggcccccgttcgggttcccaacgtttccccggttcccttacccccgtaaccccgtttcgtaaccctaacgttaccggttaccgcccggttaaacccgg

SEQ ID NO: 218372 - DNA, 689 bp, Homo sapiens
  misc_feature: GYAE6OF01B7K38.9.53.E09.1.454.CMB.1.raw
  modified_base (182)..(182): a, c, t, g, unknown or other
  misc_feature (182)..(182): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgtattttccggatttgcctaggaaaaccngcctacacgacgtaaaccgggacaaccgtcgcccggcaacatacgtccttcctcccgtccccccttcgacaacgtaacaaccaagtacaggtaatacttaacctcgttaccatcgactaccgtcctttcggcctcgaccgttaggggcctactccacccgtcgaccccgtattaacgtgacacggtacccttggtctccggcgaggcggtcttaccnccgtntttactcgttacttatcgtcagtcctatccgtactactttcctagtaacctacccgtaccagtctacgtccgacctacacgacgccaactaccttacactacggtccttaacgacgtaacccgtcccctaacccctaaccccaaactaaaccgacaacggtaacgtccggtaccgtaccgtccgacccgactacgtcgtttacggacctacgtacggttacggtttacccgttccccgtttaactaccttccccgttcccgacttactacggacgtaacgtaccg

SEQ ID NO: 218373 - DNA, 583 bp, Homo sapiens
  misc_feature: GYAE6OF01DK1XP.9.53.E09.1.454.CMB.1.raw
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtcccccttgcagtaacaccaagtacaggaatattaacctgttcccatcgactacgcctttcggcctcgcttaggggcactcacctgccccgattaacgttcggacaggaacccttggtcttccggcgagcgggcttttcaccgtctttactcgttactatgtcagctattcgcactttctgatacctcancatcgctcacancacacttcacagcttacgacacgcctcccctacccaacaacgacaataacgcgtaccgctgcccgcacgtcttacgggtcacgtagttgggtttaccgtcccccgtttacgacttcccgttccccggtacacttcgtgaagtaacccgg

SEQ ID NO: 218374 - DNA, 742 bp, Homo sapiens
  misc_feature: GYAE6OF01BVLFH.9.53.E09.1.454.CMB.1.raw
  modified_base (229)..(229): a, c, t, g, unknown or other
  misc_feature (229)..(229): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtcgtgggtctcctggacagtcgatcaccatctctgcacgtggaaccngcagtgagtggttagggattatgtaccttgtcctccgtacggtaaccaacgacgaccaaccccgaggaccaaaccgacccccaaactcactctaatttagtgaacggtcaacgtaacgccggtcccgttacgtacgggtttctacgttccgtctttcgtctcggtcctaccgtaacgttctacgaaccaaccgtacccggtccctaccctagaacctaacttccgtcgtcgggtacctaccgaggtccgtaggacgggtacgaggtcttagtaactttacgttacgtcgtacttcgtaccttactaacgtacgtcggaccgtaaggtacgttacgggtaccgtaacccgttacccggttcccgggttagggttaaccgggttaccggggtaaccggggtaaaccgggtaaccgggttaaacggggttacccggtaaccccggttacccggttacggggtaacccgtacccgggaaccccggtaccgggtccccgttccccgggtaccccccgg

SEQ ID NO: 218375 - DNA, 724 bp, Homo sapiens
  misc_feature: GYAE6OF01BGDTA.9.53.E09.1.454.CMB.1.raw
tcagtgatacgtctcacgaccggtgctcgatttagagagagtgtgttgggtttggggggggaaatactttctgagactcatggacctcctgcacaagaacatgaaacacctgtggttcttcctcctgctggtggcagctccagatgggtcgtgtcccaggtgcagctgcaggagtcgggcccaggactggtgaagccttcggagaccctgtccctctcctgcactgtctcgtggtgcctccatcagttacttactactggacctggatccggcacggccccggccggggaagggacgtgggaggttgggggttgggtcgtttagtttttagcgtagggtcggggaccaaccctaactacgaccgcccccttaccctacgaacggtacggtcggtacgtaccaacctagtcgtacgaagtacgaccgaccgtaccaaacgaaccagactcctaccgtggaactcgtacgaccttcgtcgtaccggacccggaccggccggaccgaccgggtccgttagttacttacgtggtcggacgtaacggtaacttaacccgaaattacgtaacgactaaacgacggtacgttacggttaaccttacgttttccgtttaggtaagttaacggtgggttacccgggggaaccgtaaaacggggtaactaaacgggttccggttaacccgtacccgttacccgtttacccgttacccgaacccggttacccccg

SEQ ID NO: 218376 - DNA, 354 bp, Homo sapiens
  misc_feature: GYAE6OF01AGH25.9.53.E09.1.454.CMB.1.raw
  modified_base (109)..(109): a, c, t, g, unknown or other
  misc_feature (109)..(109): n is a, c, g, or t
  modified_base (274)..(275): a, c, t, g, unknown or other
  misc_feature (274)..(275): n is a, c, g, or t
  modified_base (277)..(280): a, c, t, g, unknown or other
  misc_feature (277)..(280): n is a, c, g, or t
  modified_base (282)..(282): a, c, t, g, unknown or other
  misc_feature (282)..(282): n is a, c, g, or t
  modified_base (284)..(354): a, c, t, g, unknown or other
  misc_feature (284)..(354): n is a, c, g, or t
tcagtgatacgtctcacgaccggtgctcgatttagagagagtgtggttggggtttggggggtgtggtggtctccactcccgccttgacgaggtctgattattactgctncttcattatgcagatacggtgacacttcccgtggtattcgggcggagggaccctaaggtgaccgtcctaaggtcagcccaaggctgccccctggtcactctgttcccaccctccgtcagacgttatccacgtggacggccgggctgggctaagggccacatagtnncnnnngncnnnnnnnnnnnnnnnnnnnnnnnnnnnnnnnnnnnnnnnnnnnnnnnnnnnnnnnnnnnnnnnnnnnnnnn

SEQ ID NO: 218377 - DNA, 709 bp, Homo sapiens
  misc_feature: GYAE6OF01A8RYV.9.53.E09.1.454.CMB.1.raw
tcagtgatacgtctcacgaccggtgctcgatttagagagagtgtgttgggtttggggggaaatactttctgagactcatggacctcctgcacaagaacatgaaacacctgtggttcttcctcctgctggtggcagctcccagatgggtcgtgtcccaggtgcagctgcaggagtcggggcccaggactggtgaagccttcggagaccctgtccctctcctgcactgtctctggtggctccatcagtacttactactggacctggatccggcagcccgccggggaagggactgggagtgggttgggcgtagtttttagcgtagtcgggggacaccaactaccacgcccctccctacaagagtcgagtcaccagtgtcagtacgacacgtaccaaacgaacagactctccctagaacgctagaccttctgtacgaccgcccggcggaccgacgggccgttagtacgtttaccgtgtcggacgacggtacggtttaccccaaaatttacgtaacgacctaaacgtacggtaccgttacgggttaaacctacgtttttccccgtttttttaggaacttttaaggttcgggggttaaccgggggggtaaccccgtaaaagggggggtaacccctaaagggtttaccgggttaacccggttaaccccgggtttaccctttccccggttttaaccgtaaccgggttaccccccccg

SEQ ID NO: 218378 - DNA, 981 bp, Homo sapiens
  misc_feature: GYAE6OF01ENKHN.9.53.E09.1.454.CMB.1.raw
tcagtgatacgtctcacgaccggtgctcgatttagagagagtgtgttgggtttgggggatttgcctgggctctgctgctcctcaccctcctcactcaggacacagggtcctgggcccagtctgccctgactcagcctgcctcgtgtctggtctcgtggacagtcgatcaccatctcctgcacgtggaaccagcaggtgagttggttgggtagttatcgtacctttgtcctccgttaggtaacccaacgacgccaacccgtaaggaccaaaaccgacccccaaactcatcactttagtgtaggtacaaccgtaaacggccggtccccttacggtacgggggttttccttacgtttccggtcctttccgttctcgggtcctaccgtaacggttctacgaaaccaaaccgtacccgggtccccttacccgtacggtaaacctaaactttcccgttaccggttacggggtaccccgttaccggtaacgggtccgttacggggaacgggggtaaccggaacgggtacgtttaacggttaagttttaacgtttaaccgtcggtaccgtttcggtaacccttccgttaagttaactacgggaacgtacggttaagggttacgggtacccgtaacccggttaacccggtttaccccgggtttaggggttttacccggtttaccggggggacccgggggtaaaccggggggtaaacccgttaaaccggggggttacccggttaaaccccgggtttaaccccggttaacggggtttacccccggaaaccggggttaaaccccccgggtaacggggttaccccccgtttacccccgggtaccccccccggggttttaccggggttacccccttaacccgggtttttcccccggtacccccgggtttttccccccccggtaccccccccgttccgtttaacccccggtaaccggttaaacccgggtttaaccgtccccggttaaacccggggg

SEQ ID NO: 218379 - DNA, 780 bp, Homo sapiens
  misc_feature: GYAE6OF01BRSPB.9.53.E09.1.454.CMB.1.raw
  modified_base (437)..(437): a, c, t, g, unknown or other
  misc_feature (437)..(437): n is a, c, g, or t
  modified_base (768)..(768): a, c, t, g, unknown or other
  misc_feature (768)..(768): n is a, c, g, or t
tcagtgatacgtctcacgaccggtgctcgatttagagagagtgtggttgggttgggggctttgcctgggctctgctgctcctcaccctcctcactcaggacacgagggtccgtgggcccagtctcgccctgactcacgcctcgcctccgtgtctgggtctccgtggacagtcgatccacctatcctcctgcacgtacggaaccagcagtgtagttgggttggtattatcgtacctttcgtccttaccgtacggtaaccaacgacgaccaacccgtaacggaaccgaaaccgacccctaaacgtccaattactagtttagacgtacgtaccaacgtacggccggtacccgtaggttagggtttctacgtttaccgtctttacgtcgtcgtcctacgtagtacgacgaaccaccgtaccgcctacgacgactacgtcgngtcggaccgtacgaggtctagggacggacgtacggtacttagttaacttttacgtacgtacgtacgtggttaccctaagtattacgtcggaaacgttaggtacccgggttgtacccgtaaaccgttcccgggttacgggtttaaggttaccgggtaccggggaccgggtaaacggggtaacctaacgggggttcccgtaacccggttaacgccgggtactacccgggaaccggtccgtacccggttacccccgtcccgggttacgtacccctcccggtttacccttccccctaacccggtacccctcgaaacgttacccgaacggttaccnccgggtaaacgg

SEQ ID NO: 218380 - DNA, 811 bp, Homo sapiens
  misc_feature: GYAE6OF01ANPDT.9.53.E09.1.454.CMB.1.raw
  modified_base (289)..(289): a, c, t, g, unknown or other
  misc_feature (289)..(289): n is a, c, g, or t
tcagtgatacgtctcacgaccggtgctcgatttagagagagtgtgttgggtttgggggcgtttgcctgggctctcgctgctcctcaccctcctcactcaggacacagggtcctgggcccagtctgccctgactcagcctgccgtccgcgtccgggtctcctggacagtcggtcaccatctccgtgcactggaaccagcagttgagttggttagggagttatcgtaccttgtcctccgtaggtacccaacacgcaccctaggaccaaacgaccccaaactcatctattangagtacactacgcgcctgtacgggtttctgtttcgcttctctggcctacgaagttctacgacaaccgaccgcctaccgtcgactaactcgtcgtcggtcctcgacggtctaggtacggacggtaggtaccttaggtaacttttacgttaaccgttgtacccgttgtaccttacgagttaacgtacggtactaacgggttaaggtacgggtaccgtaaacccgttaaccccgggtttccgggtttacgggtttacggttcccggggggaacccgggaaaccggggttaccccggttaaagggttccccgggtaacccgggtttaccggttaaccgggttaccccgtaaccgtacccccggtaacgggttcccgtaccccggttaccccccgttacgggtaccctttacccgggttcccgtttacccccggtttcccccgaaccccccgtttacccggtaccgggtaaaccccgttacccggttaaccgtttaccccggaaccggttggggttaacccccgggg

SEQ ID NO: 218381 - DNA, 653 bp, Homo sapiens
  misc_feature: GYAE6OF01BWEJ7.9.53.E09.1.454.CMB.1.raw
  modified_base (214)..(214): a, c, t, g, unknown or other
  misc_feature (214)..(214): n is a, c, g, or t
  modified_base (637)..(653): a, c, t, g, unknown or other
  misc_feature (637)..(653): n is a, c, g, or t
tcagtgatacgtctcacgaccggtgctcgatttagagagagtgtggttggggtttggggggggtcacaagaggcagcgctctcgggacgtctccaccatggcctgggctctgctgctcctcaccctcctcactcaggacacgagggtcctgggcccagtctgccctgactcagcctgcctccgtgtcgtgggtctccgtggacagtcatcaccntcctctgcacgtggaaccagcagtgatggttaggtagttatcggtaccttggtcctccgtacggtaacccaaacgacgaccaaccccgaggaacccaaaacccgacccccccaaaatccaacttacgtaactttagtacggtacggttaccaaccgtaacgccccgggtcccgttacgggttacggggttttcgtcggttccgtcctttacgtccgtcgtccctacctaacgttcgacgacctaaacgtcccgtcctacccgttgacgtaccgaccgacccgtaaggtcccgtccccgtcccccgttccggacctacccttcccgttacccgttccccctaccccttcctaccgtaaccgtaccgttactaccctacggtcggacgggtcgggtcccgacgggacgacgggtcgaacctgagnnnnnnnnnnnnnnnnn

SEQ ID NO: 218382 - DNA, 260 bp, Homo sapiens
  misc_feature: GYAE6OF01ANOIA.9.53.E09.1.454.CMB.1.raw
  modified_base (253)..(260): a, c, t, g, unknown or other
  misc_feature (253)..(260): n is a, c, g, or t
tcagtgatacgtctcacgaccggtgctcgatttagagagagtgtgttgggtttggggggtgtggtggtctccactcccgccttgacgaggctgattattactgctgctcatatgcagatggtgacactcccgtggtattcggcggagggaccaaggtgaccgtcctaggtcagcccaaggctcgccccctcggtcactcctcgttcccgccctcctcagacgtatcactgagcgggctggacaggcgcatagnnnnnnnn

SEQ ID NO: 218383 - DNA, 920 bp, Homo sapiens
  misc_feature: GYAE6OF01CEXA1.9.53.E09.1.454.CMB.1.raw
tcagtgatacgtctcacgaccggtgctcgatttagagagagtgtgttggggtttggggggggtcacaagaggcagcgctctcgggacgtctccaccatggcctggctctgctgctcctcaccctcctcactcaggacacagggtcctgggcccagtctgccctgactcagcctgcctccgtgtctgggtctcctggacagtcgatcaccatctcctgcacgtggaaccagcagtgatggttgggattatgacttgtctcctggtaccaacacgacacccaggaccaaacgcccccaaactcactctaatttagtgaacgtcaacgtaacgccggccctacgtaggggtttactattcgtctttctcgtcggaccttccgtaaagttcctacggaacctaaaccgtacccggtccccttacccgcgtaactaacgttcccgtttaccggttccgggtaccttaccccggtaaacggggtcccgttaggggaaccggggtaaccgggtaacgggtacccgtttaaggttaaactttttaaccgttttaaccgttcgggttacccgtttacggtaccgtttaccgtaaacgtttacgttaacggtacccgttaaaggggttaaccgttttcggggtaacccgggtaccctttaacccccggggtttaccccgggggttttaacggggtttaaccggggtttaccccgggggggttaacccgggggggtaaaccgggggtttaaaccccgggggtaaaaaccgggggggttttcccccgggttaaaaccccccggggggtttacccccgggtttaaacggggtttaaacccccggggtaaacccccgggggttaaaccccccccgtaaaacggggggttcccccctttaaccccccggggggggtttaaccccccccccccggg

SEQ ID NO: 218384 - DNA, 614 bp, Homo sapiens
  misc_feature: GYAE6OF01EQA43.9.53.E09.1.454.CMB.1.raw
  modified_base (226)..(226): a, c, t, g, unknown or other
  misc_feature (226)..(226): n is a, c, g, or t
  modified_base (341)..(341): a, c, t, g, unknown or other
  misc_feature (341)..(341): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatccaccatctcctgcactggaaccngcagtgatggttgggattatgaccttgtctcctggtaccaacagcaccaggacaaacgcccccaaatcatctattatgagtcactaagcgcctactagggtttctattcgcttcnctgctcaagtctagacaacgcgcctcctgacaatctctgggctccgaggctagacgggacgacgggtctaggtaactttactttaacgtcgtcttacgccttacaagttactaggacctaaggtaattggggtacaaccgtaccgttaccccgggtaggttacgtttccggggacggggaacgggtaacccgaagggtccggtaacccggttaccgtaacgggttaccaaccgggacccccgtaaacgggtcccgtccgggtaccccccccgg

SEQ ID NO: 218385 - DNA, 574 bp, Homo sapiens
  misc_feature: GYAE6OF01BEPOR.9.53.E09.1.454.CMB.1.raw
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagaccaaacgccccccacacctcttaactttatgacggtcacgtaacgcggcccctcgtagggtttctcggtcgtcttctctgcctccaagtctggcaacacggccctccctgacaactctcgtcgggcctccgagtcctgaccgacgcgctagattacttacngacngtctcatactgctacgtttcggttaccttctttacaacgtacttacgttcgggaccggtacgggaccgtacggccgttcgacccggttcgtgacgttcgacgtcccgaaggtcctccgcccccgtacgg

SEQ ID NO: 218386 - DNA, 638 bp, Homo sapiens
  misc_feature: GYAE6OF01DLXDB.9.53.E09.1.454.CMB.1.raw
  modified_base (194)..(194): a, c, t, g, unknown or other
  misc_feature (194)..(194): n is a, c, g, or t
  modified_base (344)..(344): a, c, t, g, unknown or other
  misc_feature (344)..(344): n is a, c, g, or t
tcagtgatacgtctcacgaccggtgctcgatttagagagagtgtggttgggtttgggggctttgcctgggctctgctgctcctcaccctcctcactcaggacacagggtcctgggcccagtctgccctgactcagcctgcctccgtgtctgggtctcctggtacagtcgatcaccatctcctgcactggaaccngcagtgatgttgggattatcgaccttgtctcctggtaccaacagccaccaggccaaacgccccaatcatacattatgtagtcactaagcggccctgagggtttacagttcgcgttctcgtcggctccaagtcagacaacgacggcctccngtactaatcgtacgtggctccgaggctggagggaccgaggcgttagtacttacttacgcgtacttgcttcagttactacgcaaggtacgttacgggtacgaaccgtccgttacccggttggttacggttcgggacgggacgggaaccgtaagggtccgacccgttcgtaacggtccaaccggacccgtaagggtccctacggccccccgttggtaccctaccgttcccgtacccggtttacccccaccccgtttacccgtaccgtaccggtaaccgttccgtcccgtaaccggg

SEQ ID NO: 218387 - DNA, 659 bp, Homo sapiens
  misc_feature: GYAE6OF01EKKQW.9.53.E09.1.454.CMB.1.raw
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
tcagtgatacgtctcacgaccggtgctcgatttagagagagtgtggttggggtttggggggggtcacaagaggcagcgctctcgggacgtctccaccatggcctgggctctgctgctcctcaccctcctcactcaggacacaggggtcctgggcccagtctgccctgactcagcctgcctccgtgtctgggtctccgtggacagtcgatcaccntctctgcacgtggaaccngcagtgagttggttgggattatcgtacctttgtctccgtcggtaaccaacagaccacccgaggaccaaaccgaccccaaatcactactagtttagtcggtaggtaccaacgtaacgcccggtaccgttacggtacgggtttctacgttcgtcttcgtcgtggtcctacgaacgtctacgaaccacgaccggtccctacctagacacttctcgtcggcctacgagtcgtacggacggacgtaggtctaggttattacgtatcggtctcgactctagttactcgagtaggtttacgtcggtacggaccttcggttccggtaggttacggtccgggaacggggtaccggtaaccggtacgggttccggaaccggttaccgtacgggtccgacccggtaacccggtcggtcccgttccccggtaccccggg

SEQ ID NO: 218388 - DNA, 723 bp, Homo sapiens
  misc_feature: GYAE6OF01BPIBT.9.53.E09.1.454.CMB.1.raw
tcagtgatacgtctcacgaccggtgctcgatttagagagagtgtgttgggtttggggggaaatactttctgagactcatggacctcctgcacaagaacatgaaacacctgtggttcttcctcctgctggtggcagctcccagatgggtcgtgtcccaggtgcagctgcaggagtcgggccaggactgggtgaagccttcgggagaccctgtccctctcctgcactgtctctggtgctcatcagtacttactactggacctggactccggcacgcccggaccgggaaggactggaggtgggttgggtcgttaagtttttagcgaggtcggggaacaccgaactacacgccccgtcctacaagacgtcgagtcaaccatgtacagtacgactaacgtaccaaacgaaaccaagactcctacccgtaagaacgtctacgtaaccctcgtacggtcgaacccggccggaccggaaccgaacccgggtcgttagttacttacgtggtcgcggaacgtaaccggttaacccaaaagttaacgtaacgacctaaacgacggtaccttacgggttaaccttaacgttttaccctttttaggaaacctttaacggttacgggggtaaccggggtaacccggtaaaaacgggggtaacctaaacggtttaccggggttaccctaaacccggggttccttttaacccggttaccgtaaccggtaaccccccccg

SEQ ID NO: 218389 - DNA, 887 bp, Homo sapiens
  misc_feature: GYAE6OF01BSNEQ.9.53.E09.1.454.CMB.1.raw
  modified_base (140)..(140): a, c, t, g, unknown or other
  misc_feature (140)..(140): n is a, c, g, or t
tcagtgatacgtctcacgaccggtgctcgatttagagagagtgtgttggggtttggggggggtcacaagaggcagcgctctcgggacgtctccaccatggcctggctctgctgctcctcaccctctcactcaggacacgngggtcctgggcccagtctgccctgactcagcctgcctcgtgtcgtggtctccgtggacagtcgatcacctatctctgcagtacggaaccagcagtgtagttcggttagggtagtttacgtcgttaccgtttgttccgttaccgtacggtaaccaacgtacgacctaacccgacggaccaaaaccgacccctaaactctaactcttatttacgtaggtacgtactaaccggtaacggccgtacccgttacggttacgggtttccttacgttccgtacgttccgtcgttaccgggtcctaccgtaacgtaccgtacgaaacccgtaccgtacccggtcccttacccgtacgtaaccgttaccttacccgttccggttaccgggtacctacccgggtaaggtcccggtaagggaacgggtaaccgggtaccggtagttaacgttaacgtttacgtttaccggtcgttccgttacgttaccgtacgttaacgttagttaacggaccgttaaggttaccgggtttacgtaaccccgggttaaccgtttaacccccggggttccggggtttacggggtttaccgggtaaaccccgggggggttaccggggtaaaccgggggttaaaccccgggttacggttaaccccgggggtttaacccggtttaaccccggggttaaccggggtaaccccgaaccccgggttaaccccgggtaaccccggttccccggttaccccccgggttaccccccgg

SEQ ID NO: 218390 - DNA, 717 bp, Homo sapiens
  misc_feature: GYAE6OF01EBT6E.9.53.E09.1.454.CMB.1.raw
  modified_base (174)..(174): a, c, t, g, unknown or other
  misc_feature (174)..(174): n is a, c, g, or t
  modified_base (213)..(213): a, c, t, g, unknown or other
  misc_feature (213)..(213): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctctggacagtcgatcacctntcctcctgcactaggaaccagcagtgtagtggttagggngtttacttggtaccctttcgtccgttccctaggtacccaacgaaccgacgacccaaagggccccaaaaacgtcccccaaaactccattacatttagtcgagtacgacgtaccgcggaccggtttctaggtttctactttcgtcgttctccgtcggactcaacgtcgtacgaccgtaacccgacggacctaacctcgacacggtcctccgtagggcctcggaagggccgtagggacgtaggacgttgttactagttactttagctctagtactacgatagtacgtacgagtacgttacgggccgtagtaccgttccgggtacgggtacgggtcggaacggggtccggtaaccgtaccggtacgggtccctacggtacccgaggtccccgtaccgggtacccgtccggtcccgtccccggttacccgttacccgtccccggttccccgttacccgttacccccgtacccggttacccttaaccgtccgtaaccggtcggtacccgg

SEQ ID NO: 218391 - DNA, 796 bp, Homo sapiens
  misc_feature: GYAE6OF01A8EOM.9.53.E09.1.454.CMB.1.raw
  modified_base (266)..(266): a, c, t, g, unknown or other
  misc_feature (266)..(266): n is a, c, g, or t
tcagtgatacgtctcacgaccggtgctcgatttagagagagtgtgttgggtttgggggtcgtttgcctgggctctgctgctcctcaccctcctcactcaggacacgagggtcctgggcccagtctcgccctgactcagccgtcgccgtcggtcgtcgtcgggtctcctggacctagtcgatccaccctatccgtcctgcctacgtggaaccagcagtcgagttggttgggattagtcgtaccttggtcctccgtacggtaaccaanacgtccaccgtaggacaaaccgccccaatctatactattagcgacgacacgacgccgcccttcgtacgggttttctagttccgtctttacgtcgtcggtctaccgtacgtcctacgaaccaaccgtccggtcccttccgtacgaaccgtaacttccgtacggtcggggacctaccggacggtacctacggggacgggaaccggtagggttaccttacggttactttaacggtttacgtccggacgttcggtactacgtacgttaacgttacggacttaagggtaacggttgggtaccgtaacccgtacccggttcgggtttacggttaccgggttaccggggaaccggggtaacggggtaccggttaacggggtccggttaccccggttacggttacgggtacccgaccggtacccggtaccgggtacctaccccgggtacccccgttacggggtcccttaccggttcccggttaccccgtcccccgtaccttacccgttactacccgggtaccttaccgtccgtacccg

SEQ ID NO: 218392 - DNA, 262 bp, Homo sapiens
  misc_feature: GYAE6OF01CI3MH.9.53.E09.1.454.CMB.1.raw
  modified_base (256)..(262): a, c, t, g, unknown or other
  misc_feature (256)..(262): n is a, c, g, or t
tcagtgatacgtctcacgaccggtgctcgatttagagagagtgtgttgggtttggggggtgtggtggtctccactcccgccttgacgaggctgattattactgctgctcatatgcagatggtgacactcccgtggtattcggcggagggaccaaggtgaccgtcctaggtcagcccaaggctcgccccctggtcactctcgttcccaccctcctcagacgtatcacgtgacgcgggtctggacaaggcgacatagnnnnnnn

SEQ ID NO: 218393 - DNA, 777 bp, Homo sapiens
  misc_feature: GYAE6OF01BRN9C.9.53.E09.1.454.CMB.1.raw
  modified_base (250)..(250): a, c, t, g, unknown or other
  misc_feature (250)..(250): n is a, c, g, or t
tcagtgatacgtctcacgaccggtgctcgatttagagagagtgtgttggggtttggggggggtcacaagaggcagcgctctcgggacgtctccaccatggcctgggctctgctgctcctcaccctctcactcgaggacacgagggtcctgggcccagtctcgccctgactcacgcctcgcctcgtgtcgtcggtcctcgtggactacgtcgactaccacctacttcctcctgacctaacgtacggaaccngtacgtaggtgtagttgggttaggtattaacgtcgttaacctttcggtccttccggtaacggtaaccaacgacgaccgaaaccgtaacggaacccaaacccgtacccctaaaactctaacttacttaatttacggtacggtaacgtacctaaaccggtacggcccggttaccgttacggttacgggtttactacgttcgttccttcgtcgtacggtacctacgtacgtacgtaacgaaccgtaccgtaccggtccttacgaactaactacgttccgtcggtacggcccttacggaggtcaacgggacggtaccgtaggtaccttagttacttagtcgctcttaagccgttataacgtagtaccgaagtacggtacgtcggtaacctaccggttacgggtaccggttaggtaccgggttaaccggggaccgggtaaaccggtagttaaacccggggttcccgtaaccggtacggttaccggacccgaaacccggttacggaaccccgttccggtcccccggtaaccgg

SEQ ID NO: 218394 - DNA, 748 bp, Homo sapiens
  misc_feature: GYAE6OF01DL3IH.9.53.E09.1.454.CMB.1.raw
  modified_base (434)..(434): a, c, t, g, unknown or other
  misc_feature (434)..(434): n is a, c, g, or t
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagtcctttgtatttttccggtattttgacctaggaaaaccagcctacacgacttaaaaccgggacaaccggtccgcccggaccaacactacgtccttcctcccgtccccccttcgccaagtaaccaccaagtacaaggtaatacttaacctcgttccatcgactaccgtccgttcgcctcgtccgttagggcactccaccctcgaccccgtattacgtgacgacggtacccttggtcgtccggcgaggtcggtctttaccgccgtctttatcgtttactatcgtacngtactctcgctactttctagtactacctctacgactactccgtacctacaacgacgacctaaccttaccgtactacgtaggttacccttaacgaacgtaacccgtacccccttacccccctaaaccaaacaaccggtacaaacggttaacgtacccgtccgtacctccgggcctaccgtaccggttccgtttcgggtacgaactttaccgggtttacccgggttttacccgttccccccggttttaaccttccgtttacccccggttaccccgtacgttaaccgtttacccggtaagggttaaacgttaacccg

SEQ ID NO: 218395 - DNA, 718 bp, Homo sapiens
  misc_feature: GYAE6OF01ENXH8.9.53.E09.1.454.CMB.1.raw
  modified_base (234)..(234): a, c, t, g, unknown or other
  misc_feature (234)..(234): n is a, c, g, or t
tcagtgatacgtctcacgaccggtgctcgatttagagagagtgtggttggggtttgggggggggtcacaagaggcagcgctctcgggacgtctccaccatggcctgggctctgctgctcctcaccctcctcactcaggacacaggggtcctgggcccagtctgccctgactcagcctgcctccgtgtcgtgggtctcctggacagtcgatcaccatctcctgcacgtggaaccngcagtgattggttggggatttatgtacctttgtccttaccgtacggtaaccaaacgacgaccaacccgacggaccaaaaccgaccccccaaaactccaattactaatttagtaggaacggtcctaacgtaacggcccggtacccgttacggttacggggttttactacgttccgtactttctacgtcggtacctaccgtaagttcctagaaccaaaccgacccggtcccctacccgtacgaacctaacgtccgtcgtcgggtacctcggacggtcgtaggacgggacgacggtcttagtaactttacttacgtgtctcgctctaatagtcgacgtaggtacgttcgggtaactaccgtaccggttccggttaggttacggttacgggggacgggtaacgggtaacccggtaagggtccgtaacccggttaccgtaacgggtccgaaccggtacccggtaacgggtcccgtcccggtacccccgg

SEQ ID NO: 218396 - DNA, 649 bp, Homo sapiens
  misc_feature: GYAE6OF01EXLE8.9.53.E09.1.454.CMB.1.raw
  modified_base (205)..(205): a, c, t, g, unknown or other
  misc_feature (205)..(205): n is a, c, g, or t
tcagtgatacgtctcacgaccggtgctcgatttagagagagtgtgttgggtttggggggtcacaagaggcagcgctctcgggacgtctccaccatggcctggctctgctgctcctcaccctcctcactcaggacacagggtcctgggcccagtctgccctgactcagcctgcctcgtgtctggtctcctggacagtcgatcaccntctcctgccactggaaccagcagtgattggttggattatgacttgttctcctggtaaccaacacgcacccgaggaccaaacgacccccaaactcattctatttagtgaggtactactaagccggtacctcgtagggtttctacgttcgactttctagtcggtcctaccgaagttcctagaacctaaccgaccggtccctaccctacgaactaacgttcctcggttaccgggcctaccggacgggtcgttaggacgggaacgtcggtacttgtaactttacgttacgtgtcgtctctactatacgtcgcgtaagtcgtaggtacacccgtaccggtccggttacggttacggtcgggtacgggaacgggtaccgtaacggggtccgtaacccggttccgtaacggtcccgacggaccccgtaacgggccctaccggtccccccgg

SEQ ID NO: 218397 - DNA, 882 bp, Homo sapiens
  misc_feature: GYAE6OF01DUEGC.9.53.E09.1.454.CMB.1.raw
  modified_base (243)..(243): a, c, t, g, unknown or other
  misc_feature (243)..(243): n is a, c, g, or t
tcagtgatacgtctcacgaccggtgctcgatttagagagagtgtgttggggtttggggggggtcacaagaggcagcgctctcgggacgtctccaccatggcctggctctgctgctcctcaccctcctcactcaggacgcagggtcctcgggcccagtctcgccctgactcacgtcctcgcctccgtgtctgtcgtctccgtggacagtcgatccaacctatcctcctgaccactcggaaaccngtactagttcgggttacttttacctgtcctccgtacgtacccaacacccgaacccacggtaccaaacccgtaccccaaactctaatagttaactttagacgtaacgtccgtaaacgtaaccggccggtcccggttacgggttactttcgtcgtcgttccgtccgtttccgttacgtccggtaccttacccggtaaaccgttccctaaccgtaacccggtcccgtccccgtttaacccgtaacggtaaaccccttaagtccggttccggtaccggtacccgttaacgaccgggtacgtaacgggaaccgggacggtacgtaccctttaattaacgttttacgttaaccgttgtaccgttactaaccgttaagttaacgtacgttaagggttaacggtttaaggtttacgggtttcgggttaccgggtacggggtaccggggtaacggtaaacccggttacggttccggtaaccgggttaaccccggttcgttaaacccgggtaccctaaacccggggtaccccgtaccggggttaccccgtcccccggttacccccggtttaccgggtttaacccccttcccgggttttacccccgttaccccccggtttccccccggttcgttaaccccccggtaacgg

SEQ ID NO: 218398 - DNA, 759 bp, Homo sapiens
  misc_feature: GYAE6OF01EDK17.9.53.E09.1.454.CMB.1.raw
  modified_base (234)..(234): a, c, t, g, unknown or other
  misc_feature (234)..(234): n is a, c, g, or t
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacgagggtcctgggcccagtctgccctgactcagcctgcctccgtgtctgggtctcgtggacagtcatcaccatcctcctgctacgtacggaaccngtcagtgtagttggttagggtattatgtaccttgtctaccgtacggtaaccaacacgacccaaccgacggaaccaaacccgaccccctaaactacctaacttacttaagtttagtacggtaacgtacctaacgtaaccggtcccggtacccgttacggttacggggtttacctacgttcgtctttcctcgtcgtcctacctaacgtccgtacgaacccaccggtaccggtccccttaccgtacgtaactaacgttccgtcggtaccgggtacctccggtacgggtcgtacgggaacggacggtacgtcttagttaactttacgtaccgtcgtctcgtacgtaactacgtacgttacgacggtacgtacggtacggtaccgaccggttaccgtacccgggttagggttaccgggtaccggggtacgggtaaccgggtaaccggtacggggttaccgttacccggttaccggtaacgggtacccgaacccggtaccggtaaccggtccccgttacccggtcccccgg

SEQ ID NO: 218399 - DNA, 669 bp, Homo sapiens
  misc_feature: GYAE6OF01B0XWU.9.53.E09.1.454.CMB.1.raw
  modified_base (162)..(162): a, c, t, g, unknown or other
  misc_feature (162)..(162): n is a, c, g, or t
  modified_base (191)..(191): a, c, t, g, unknown or other
  misc_feature (191)..(191): n is a, c, g, or t
  modified_base (212)..(212): a, c, t, g, unknown or other
  misc_feature (212)..(212): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctggtctcctggacngtcgatcaccatctcctgcactggaaccngcagtgattggttgggattangtaccttgtctccgtagtaaccaacagccaaccgaggaccaaacgaccccaaactcatactattagtgacgtacaacgtacgcgcctacgtaggtttctacgttcgtcttctcgtcgctacagtctacgaactaaccgacggccctaccgagaacaacgtctcgtcggctacgagctaggaggacgaggtctagtattatacgtgctacgtactacgtactagtcgacgtaagtagtcggtacgtaccgtacgttacccggtaggttaccgttcggggaacgggtaacgggtaaccggtaacgggttccgaaccgttacgtaacgggtaccgaccgtacccgtaacggtcccgtcccgtacccccggttacggttaccctaacccgttcccgttaccccgttaacccccaccccgtttacccgtaccgtaacgtaacccgttacgtaccgtaacggg

SEQ ID NO: 218400 - DNA, 666 bp, Homo sapiens
  misc_feature: GYAE6OF01B75MA.9.53.E09.1.454.CMB.1.raw
  modified_base (227)..(227): a, c, t, g, unknown or other
  misc_feature (227)..(227): n is a, c, g, or t
  modified_base (324)..(324): a, c, t, g, unknown or other
  misc_feature (324)..(324): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtcctgccctgactcagcctgcctccgtgtctgggtctcctggacagtcgatcacatctctgcactggaaccngcagtgagtggttgggattatcgtaccttgtctccgtaggtaacccaacacgaccaaccgaggaccaaaacgcccccaaaactcaatactatttagngacgtacactaagccgcctcgtaggttctatctcttctcgtgctacacgtctacgacacgcgtcctcctagactatccgtgtacggctccgagtcgtaggacgggacgtaggtcgttagttactttacgttacgtcgtcctgtaccttacgtaacttagtacggtacgtaaggttacgttcggtaacgtacccttaacccgggttcccggttacgggttaccgttaccggggggaacgggtaaccggggtaacggtaaccggggttacggtaccccgttaaccgggtacggtaccggtaccggtaaccccgaacggttcccgttacccggttaccccccggg

SEQ ID NO: 218401 - DNA, 687 bp, Homo sapiens
  misc_feature: GYAE6OF01CGSUR.9.53.E09.1.454.CMB.1.raw
  modified_base (141)..(141): a, c, t, g, unknown or other
  misc_feature (141)..(141): n is a, c, g, or t
  modified_base (216)..(216): a, c, t, g, unknown or other
  misc_feature (216)..(216): n is a, c, g, or t
tcagtgatacgtctcacgaccggtgctcgatttagagagagtgtggttggggtttggggggggtcacaagaggcagcgctctcgggacgtctccaccatggcctgggctctgctgctcctcaccctctcactcagacacgngggtcctgggccctgtctcgccctgactcagcctgcctccgtgtctgggtctcctggacagtcgactccaacctntcctcctgctacgtcgacccacactgaagtgtggctaatacttaccgttcgtctcgtagtactacaaccaccgaccaagaaccgaaccaccccactacgttacttaaacgttgtacggacggtacaacgttaacggcccgtcccgttacggtagggttttccgtcgggttcctctttccgtcctcggtacccttacgtaacgtcgtacggtaccaacgtcccggtccctaccgtacgaacctactccgtcggtcggtcctcgtacggtccgacggacgacggtcgtagtattacgttacgtacgacgtactctatacgtatcgtacgttacgtttacgttccttacgttacgtaagtactacgggttcggaccgggtacggaccggtacgtccgtaccggtccggtaccgtcggaccgtaccggacgtacccggaacggtccccgtaaccgttccccggtacccgttcccg

SEQ ID NO: 218402 - DNA, 821 bp, Homo sapiens
  misc_feature: GYAE6OF01EQDBR.9.53.E09.1.454.CMB.1.raw
  modified_base (245)..(245): a, c, t, g, unknown or other
  misc_feature (245)..(245): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgtcctgactcagcctgcctcgtgtctgggtctctggacagtcgatcaccattctcctgcactggaccagcagtgagttggttggagtttatcgtacctttgtccttccgtacggtaaccaacncgaccaacccgaggaccaaaccgaccccaactctatactatttagcgaggtacaacgtaacggccggtacccttcggttacgggttttcttacgtttccggttctttccgttccgtcggtacccgttaccgtaacgttacgtaaccgaaccgaaacccggtcccggtaccccttccggtaactaacgtaacttccgttacggtccgggtccctaccggacgggtacgtacgggaacgggtaccggtaggttctaggttaacttttacgttacgtcggttctacggtccttagtattacggtgtacgtagttacggttacggtaccgttaccgtacccggtttccgggttacgggttaccgggttccggggaacgggtaacggggtaaccggtaaccgggttccggttaacccggtccggttaacggccgtaacccggaacccggacggttccccgtacccccgggttacccccggttacccggttacccttaccccggttcccgttaccccccggttacccccctaccccggttacccgtaccgtaacccggttacgtttacccgacgttaccggg

SEQ ID NO: 218403 - DNA, 753 bp, Homo sapiens
  misc_feature: GYAE6OF01AL7MY.9.53.E09.1.454.CMB.1.raw
  modified_base (184)..(184): a, c, t, g, unknown or other
  misc_feature (184)..(184): n is a, c, g, or t
  modified_base (372)..(372): a, c, t, g, unknown or other
  misc_feature (372)..(372): n is a, c, g, or t
tcagtgatacgtctcacgaccggtgctcgatttagagagagtgtgttgggtttggggtacgatttgatgttacctgatgcttagaggcttttcctggaagcagggcatttgttgcttcagcaccgtagtcgcctcgtcatcacgcctcagtccttgtattttccggatttgcctaggaaaaccngcctacacgacttaaaccgggacaaccgtccgcccggccaacatacgccttcctcccgtcccccttgcacgtaacaccaagtacaaggtaatacttaacctgttacccatcgactacgtccttcgcctcgccttagggtccactccaccctgcccgattaacggtgacacgtaccttggtcctccggngacgtcggtcttttccacccgttctttacttccgttaacttagtgtcacgtctacttccgcttacttctacgtaactaccctccaatctactcgccctacaccgacgacctaacctaccttaccaaccgtacgggtaccttaaccgaaccgtaaaccccgtccctaacccccccgtaaacccaaaccgtaaaccgaccgtaaacgtaaccggtcccgttaccgtacccgtccggtacccgtaccgtacggtccgtttaccgggtacgtaccgttaacggtttccgggtttaacccggttcccccgttttcgtacccgtttacccccgttccccgtaacccttaccgttacccgttaacggtaaccgttaacccgttaaccg

SEQ ID NO: 218404 - DNA, 650 bp, Homo sapiens
  misc_feature: GYAE6OF01BEJ60.9.53.E09.1.454.CMB.1.raw
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
tcagtgatacgtctcacgaccggtgctcgatttagagagagtgtggttggggtttggggggggtcacaagaggcagcgctctcgggacgtctccaccatggccctgggctctgctgcttcctcaccctctcactcaggacacagggtcctgggcccagtctgccctgactcagcctgcctccgtgtctgggtctccgtggacagtcgatcaccntctctgcactggaaccngcagtgatggttggattatgaccttcgtcctccgtacggtaccaacngccaccgaggccaacgccccaaatcatctatttncgaggtacacgtaacgcgtaccgtcgtacgggttctacttcgcttcgcgtggtcctacaaggttctgaaccgtacgacggtcctcccgtagtacgtaacttcgtaccggtcggcctaccggacggtacgtacgggtaaggtacccggtagggtacctacggttaagtttaacgtttacgtcggtcttcgacccttcgtaacgtaggtccgacgtaagtcgttcggtagacccgtaccgttcgtacggttccgtaccgggtcgggaacggtacccgtaagggtccgtacccggttactaccgggtcacggtaccccggacgtccgtccccgtaccccgg

SEQ ID NO: 218405 - DNA, 673 bp, Homo sapiens
  misc_feature: GYAE6OF01BQF1L.9.53.E09.1.454.CMB.1.raw
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
tcagtgatacgtctcacgaccggtgctcgatttagagagagtgtgttggggtttggggggggtcacaagaggcagcgctctcgggacgtctccaccatggcctggctctgctgctcctcaccctctcactcaggacacagggtcctgggcccagtctgccctgactcagcctgcctcgtgtctggtctccgtggacagtcgatcaccatcgtctgcactggaaccngcgagtntagtggttagggattagtcgtaccttgtcctcgtacggtaaccaacacgccaaccgacggaccaaaccgacccctaaactcactactaagtttagagtacgtaccaacgtaacgccggtccttacggttacgggtttctacgtttcctacgtttcgtcgttcggtacctacgtaacgtcttacgaacctaaacggtcccggtaccttacccgtacggtaacctaacgttccgttggttaccggccttaccgacggtcgtaggacggacggtacggtactagttacttaagttccgtacgtactacgtactacgtatacgtacgacgtaccgactaaccaaggtactcggtacggtacggtacggtacggtacccgtcgtcccgtaaccgtccgtacgtacgacccgtaccgaacccggaaccctaccctagtcctacccg

SEQ ID NO: 218406 - DNA, 731 bp, Homo sapiens
  misc_feature: GYAE6OF01EL3UT.9.53.E09.1.454.CMB.1.raw
  modified_base (211)..(211): a, c, t, g, unknown or other
  misc_feature (211)..(211): n is a, c, g, or t
  modified_base (414)..(414): a, c, t, g, unknown or other
  misc_feature (414)..(414): n is a, c, g, or t
  modified_base (584)..(584): a, c, t, g, unknown or other
  misc_feature (584)..(584): n is a, c, g, or t
  modified_base (599)..(599): a, c, t, g, unknown or other
  misc_feature (599)..(599): n is a, c, g, or t
tcagtgatacgtctcacgaccggtgctcgatttagagagagtgtgttgggtttggcgtatttttagcagtgggacacccaactacagcccctccctcaagagtcgatcaccatgtcagtagacacgtaccaagaaccagatctccctggaagctgacctctgtgaccgcgcggacacggccgtgtattactgtgcgagagttacccaaatntagcaaaccagcgtggtactagtttccttttgatagtggtacgggccaaaggggtactaagttggtccaccggttcttcgttcgaacgcccttacccgaacccgtaagggcccctaagttcccggttacctttaccccccgtgggccctcccgtcggtcctccgaagggtccgacgtaacccgttcggaagacgtccaaccgnggtcccggaccccgttgggggacccttcggacccgttaggggtaaccgaaaacgggtaccctttaccttacccggaaggttaaaccccgttagtaccgaacgttacgggacgggtcccggggacttaccggggaccgtaaacggggtcccggaacctaacggttaagggngtacgagtcgacggngagtacgacgacgacgtacacgcgtacgacggcgacgacgacgtacgtcgacggcgtccgtacgtccgtaccgtcccgtacccgtcgtccgttacgacgtaccgtaacgacgtaaccgaccgtcgtacgtcg

SEQ ID NO: 218407 - DNA, 766 bp, Homo sapiens
  misc_feature: GYAE6OF01DAB1S.9.53.E09.1.454.CMB.1.raw
  modified_base (499)..(499): a, c, t, g, unknown or other
  misc_feature (499)..(499): n is a, c, g, or t
tcagtgatacgtctcacgaccggtgctcgatttagagagagtgtgttggggtttggggggggtcacaagaggcagcgctctcgggacgtctccacatggcctgggctctgctgcctccctccaccctcctcactcaggacacgagggtcctgggcccagtctcgccctgactcagcctcgccctccgtgtcgtgggttcctccgtggacagtcgactccaaccattcctcctgccacgtacggaacccagacgtaggttgtagttgggttacgggtagtttacgtcgtacctttcgtccttaccgtacggtaaccaacacgccaacccgaggaaccaaaacccgaccccctaaatctaacttcgtaattttacgaggacggttaccaacgtaacggtcccgtacccgtaggttacgggttttctagttccgttcgttccgttcgtacggtccctaacgtagttccgtaaccgaaccgaaccggtccgccccttaccgtntaaacctacgttacttccgggtcggtacctaccggagggtcccgtaagggaacggaaccggtggtacgttaagtacgtttaactcgtagtcctgtactatacttacgtacggctaaggtacgttcggtaccgtaccgttaccggttaccgggttaggtaaccgggttcgggggacggtaaaccgggtacggtacgggtaccgttacccggtacggtaccggtaccgaccggtaacccgtaccgggtcccgttccccggtaccccggg

SEQ ID NO: 218408 - DNA, 836 bp, Homo sapiens
  misc_feature: GYAE6OF01DZ8QM.9.53.E09.1.454.CMB.1.raw
  modified_base (220)..(220): a, c, t, g, unknown or other
  misc_feature (220)..(220): n is a, c, g, or t
tcagtgatacgtctcacgaccggtgctcgatttagagagagtgtggttggggtttggggggggtcacaagaggcagcgctcgtcgggacgtctccacatggcctggctctgctgctcctcacctctcactcagacacgagggtcctcgggcccagtctcgcctgactcacgcctcgccctcggtgtcgtgggttcctcgtggactagtcgactccacctnttccgtcctgacgtacgtacggaacctgcgtaggtgtaggttgggttagggtattacgtccttaccgtttcgtccgttaccgtacggtaacccaaacgccgacccaaccgacggtaacccaaacccccgtacccctaaatcctagttacttaagtttacggacgtaaccgttaccgtaacgtaccgggtcccggttaccgtttacggggtttacggttttaccctacggttccgttccgtttcgtaccggtacgtccctaagtactccgtaacgacctaaccggccgtccctacgacactcgttccgtcggccggtaccgtaccggtacggtacggtacgggaaccgggtagttacgtacggtttaagttaaccgttttagttaccggtcggtaccgtatttacctaggtttaaacgtacggtaccggaaggttacggttaccggttaacgggtacccgttaccggtacccgggtttccgggttaggggttacccggtaccggggggaccgggtaaacccggggttaaccggaccgggtttaacccggtacccgttaccggtaaccggtacggtaaacccgtcccgggtaacgtccccccggttccggtaccccgg

SEQ ID NO: 218409 - DNA, 621 bp, Homo sapiens
  misc_feature: GYAE6OF01EID98.9.53.E09.1.454.CMB.1.raw
  modified_base (284)..(284): a, c, t, g, unknown or other
  misc_feature (284)..(284): n is a, c, g, or t
  modified_base (383)..(383): a, c, t, g, unknown or other
  misc_feature (383)..(383): n is a, c, g, or t
tcagtgatacgtctcacgaccggtgctcgatttagagagagtgtgttgggtttggggctttgcctgggctctgctgctcctcaccctcctcactcaggacacagggtcctgggcccagtctgccctgactcagcctgcctccgtgtctgggtctcctggacagtcgatcaccatctcctgcacgtaggaccagcaggtgagtgttgggagttatcgtacctttgtcctccgtaggtaccaacacgccaacccgagaccaaaccgccccaaactcatctatttanagacgtacactaacggccgcctcggtacgggtttctagttcgcttcgtctcgtcctcgtaagtctagaccacgcgccctcctgacatctcgtcgctcgnggcgtagaggacgacgctagtattattacgtgctgctactagtatcggacagtagtcggtacgtacctaccggttccggtaggttacggtcggggaacgggtaacgggacgtacgggttccgtaaccggtacgtacgggaccctacggacccgacggtacccgtccgtcccccggtcgtacctcccgttccttcccgttccccaccccgttccacgtacgtaccttcgtcgtaccggg

SEQ ID NO: 218410 - DNA, 750 bp, Homo sapiens
  misc_feature: GYAE6OF01C9Y7A.9.53.E09.1.454.CMB.1.raw
  modified_base (212)..(212): a, c, t, g, unknown or other
  misc_feature (212)..(212): n is a, c, g, or t
  modified_base (501)..(501): a, c, t, g, unknown or other
  misc_feature (501)..(501): n is a, c, g, or t
tcagtgatacgtctcacgaccggtgctcgatttagagagagtgtggttggggtttggggggggtcacaagaggcagcgctctcgggacgtctccacatggcctggctctgctgctcctcaccctcctcactcaggacacgagggtcctgggcccagtctgccctgactcagcctgcctccgtgtctggtctacgtggacagtcatccacctntctcctgcctaacgtacggaaccaggctaggtggtaagttcgggttaggggtattacgttacgttaccgtttcgttccgtaccgttaacggtaacccaaaccgacgacccaaccccgaacggaccaaaaccccggaaccccctaaaactacctaaactaccttaagttttacgacggtacgttaaccgaaccgtaacgcccggtaccctcggtaacgggtttcttcgttccgtctttccgtacttcgtacctacctaagttacataacgaccgtacgtcccttaccganacgttactcgtaccgtcggtaacctcgacggtcgtacgggaacggtacgaggtacttacgttaattacggttacctcggtctacgtacgttactaagtttcgtagtagtaacggtgtacgtcggtaccgtaccggttacggtttacggaccgttagggggaccggtacgggtaaaccggacggttcccgttaaaccgtccgtaacgggttcccaacggtacccgtaaccgggccttcccggtacccccg

SEQ ID NO: 218411 - DNA, 695 bp, Homo sapiens
  misc_feature: GYAE6OF01CYQ0V.9.53.E09.1.454.CMB.1.raw
  modified_base (232)..(232): a, c, t, g, unknown or other
  misc_feature (232)..(232): n is a, c, g, or t
  modified_base (281)..(281): a, c, t, g, unknown or other
  misc_feature (281)..(281): n is a, c, g, or t
tcagtgatacgtctcacgaccggtgctcgatttagagagagtgtgttggggtttggggggggtcacaagaggcagcgctctcgggacgtctccacatggcctgggctctgctgctcctcaccctcctcactcaggacacgagggtcctgggcccagtctgccctgactcagcctgcctccgtgtctgggtctcctggacagtcgatcaccatcctcctgcacgtcggaaccngcagtgagttggtgggtattatcgtaccttgtcctccgtaggtaccaanacgccaacccgacggaccaaacccgaccccctaaacgtctatactatttagcggacggtacacgtaacggtccggccccgttagtacgggtttcagtttccgcttctcgtcgctacgaagtctaacgacaaccgcggtccctcctagactactcgtcgtcgggtcctaccggaggtacgtagggaacggacggtagggtaccttaggtaaattttactacgtacgtcgtgtacctacttagtagtaggtacacggttgtaggttaaccgacttccgggttcccggttaagtaccgggttaccggggacggggtaaaccgggtaacggaacggggtttcccgtaacccggttaccggttacggttaaccggacccgggttaacccgaccgggtcccgttccccggtaccccccgg

SEQ ID NO: 218412 - DNA, 760 bp, Homo sapiens
  misc_feature: GYAE6OF01AWHJ2.9.53.E09.1.454.CMB.1.raw
  modified_base (318)..(318): a, c, t, g, unknown or other
  misc_feature (318)..(318): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatccaccatcctcctgccactggaaccagcagtgatggttgggattatgtaccttgtcttcctggtaacccaacacgccacccaggaccaaaccgcccccaaactcactcatttangagtcactaacgccggccctcgtaggggtttcctagtttcgtctttctcgtcggcctaccaagttctacgaaccgtaaaccgacccggtccccttaccccgtacgaaccctaactttccgtcccgttcggggtccctacccgacgggtccgttacgggacggggtaacccggagggtaccgttaggttaagttttaaccgtttaacccgttcggtacccgttcgtaccccgtttataacgtttacgtacggtaccgtaaggttaacggttcgggttaaccgacccgttacccgttacccggggttggttaccggtttaccgggggaccggggtaaaccggggtacccggtaacgggttcccggaaccccggtttacccggtaccgggtaccgaccggtaaccccggtaaccgggttccccgtcccccggttacccccccggg

SEQ ID NO: 218413 - DNA, 613 bp, Homo sapiens
  misc_feature: GYAE6OF01AMVZE.9.53.E09.1.454.CMB.1.raw
  modified_base (338)..(338): a, c, t, g, unknown or other
  misc_feature (338)..(338): n is a, c, g, or t
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
  modified_base (480)..(480): a, c, t, g, unknown or other
  misc_feature (480)..(480): n is a, c, g, or t
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacgagggtcctgggcccagtcctgccctagactcagcctgcctccgtgtcgtgggtctcgtggactagtcgatcacctatcctcctgctacgtggaaccagcagtgagttggttggtattgtcgtacttgtcctccgtacggtaaccaacgacgaccaccgaacggaccaaacccgtaccccaactcgtactactattangtacgtcacgtacgccgtcgtcgttaggttactagttcctcttcgtctcgtctacgtagtcgtacactaaccgcgtccctcgacgtacacgtctcgcggtctacgngtcgtaggacgagtacgtnttagtacttacgttcgngttcgtgtacctatagtactgacgtagtagtcggtacacctcggtccggttagttaccggtacgggacgggtaacggtacggacggttccggccgtcgttacggaccacggaccgcggtccgtccccgtacgg

SEQ ID NO: 218414 - DNA, 856 bp, Homo sapiens
  misc_feature: GYAE6OF01BG18A.9.53.E09.1.454.CMB.1.raw
  modified_base (191)..(191): a, c, t, g, unknown or other
  misc_feature (191)..(191): n is a, c, g, or t
tcagtgatacgtctcacgaccggtgctcgatttagagagagtgtgttgggtttggggctttgcctgggctctgctgctcctcaccctcctcactcaggacacagggtcctggcccagtctgccctgactcagcctgcctcgtgtctgggtctcctggacagtcgatcaccatctcctgccacgtggaaccngcagtgagtggttgggattatgtacctttgtcctccgtaggaaccaacgagcccaaccgaggaccaaaccgaccccaaactcaacttactaatttacgtaggacgtactaacgtaacggtccggtaccccgttacggttacgggggttttaccttacggttttccggtacctttaccgtcgtccgggtaccttaccgtaaggttcccgttacgggaaccctaaaccgtcccgggtccccttacccggttaacgaaccgtaaacgttcccgttcccggttaacggggtccccttcccggtaaaccggtttaccgtacccgggaaaccgggtaacccgggtaacgggttacccgttaaggtttaaccgttttaaacgtttaccgtttccgggaccttacgggtaactacccggttaatttacggttacggtacccggttttaaggttttccggtttttacccctaacgtttttaacggaaacttttaacggtttaaccggttccggggaaaccggggttaacggtaacccggtaacggtccggttacgtaacccgttgtacggtacgtccgaacgtacccgtaccgcccggtacccgtcccgttcgtccggtaaccttcctaccccgtaccctacccggttaccctacgtaacgtccgtaagtaccg

SEQ ID NO: 218415 - DNA, 831 bp, Homo sapiens
  misc_feature: GYAE6OF01BIJ08.9.53.E09.1.454.CMB.1.raw
  modified_base (210)..(210): a, c, t, g, unknown or other
  misc_feature (210)..(210): n is a, c, g, or t
  modified_base (233)..(233): a, c, t, g, unknown or other
  misc_feature (233)..(233): n is a, c, g, or t
  modified_base (553)..(553): a, c, t, g, unknown or other
  misc_feature (553)..(553): n is a, c, g, or t
  modified_base (709)..(709): a, c, t, g, unknown or other
  misc_feature (709)..(709): n is a, c, g, or t
tcagtgatacgtctcacgaccggtgctcgatttagagagagtgtggttgggttgggggggtcacaagaggcagcgctcgtcgggacgtcctccaccatcggcctggctctgctcgctcctcaccctctcactcgacgacacgcggtcctcggccagtctacgccctagactcgacgtcctcgcccgtccgtagtcgtcggtcccttacgnggaactcgtacgactacaacctnttcctacgtgtaccacgtacggaaacctgactaggtagtatttagggtaggtacttacgtaccgtaccttcgtaccgttaccgtaacggtaaaccaaccgtaccgaaccgaacccggaacggaaccccgtaaaacccgtacccctaagtctaaacgttacgtaaactttcggaacggtaggtaaccctaaacggccccgggttccgtaccgggtttacggttttaacgttacctcgttaccggtatttaacccggggactttaccggaaaccgttttaaccggtacggtacccttaaaacgtacccccggggtaaacccncccgggtttaaccgtaaacgttaaactacccggttcgttccgggtaaccgtacccgtacgtacgggtaacgttacgggaacgttacggaacgtttacgtaacgtttcgtaaccgttacgtacgtcgtcttaggacctaggttactacgagtaacgngttaaccgcgtactaaccggtcgttcggtacgggttacgaaccgggtacggtaacgcccggaagttacccggtaactgggacctaaaccggccgtaacgacccggttccgaccgtttaaccg

SEQ ID NO: 218416 - DNA, 719 bp, Homo sapiens
  misc_feature: GYAE6OF01AX4M6.9.53.E09.1.454.CMB.1.raw
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacgagggtcctgggcccagtctgccctgactcacgcctgcctccgtgtctgggtctccgtggacagtcgatcaccattcctcctgcacgtaggaacccngcaggtnagttggttggatttatcgtaccgttggttcctccgtcggtaaccaacacgaccaaccgaggaccaaaaccgacccccaaatcagttacctaatttagcggtacggtacaaccgtaacgcccgggtaccttacggtacgggttttactacgttccgtactttccgtcgtcggtacctaccgtaaacgttcgtaacgaaccgtaacccgtacccggtccctacccgtagtaaccaagtttccgtcggtcggtaccctcggacgtccggtaaggacgggacccgtagggttacctaaggtttaactttaccgttacgtcgtcctacgtacttacgtaacttcgacgtaaccgtaggtagtacggttaccaaccggttcccggttcggtacggtttcggtaccgggggacggtaacgggtacccgtacgggacccgttccggtaccacggtccaccgtaccgacgtcccggtccgtaccccgg

SEQ ID NO: 218417 - DNA, 722 bp, Homo sapiens
  misc_feature: GYAE6OF01C67JL.9.53.E09.1.454.CMB.1.raw
  modified_base (131)..(131): a, c, t, g, unknown or other
  misc_feature (131)..(131): n is a, c, g, or t
tcagtgatacgtctcacgaccggtgctcgatttagagagagtgtgttgggtttgggggggaaatactttctgagactcatggaccctcctgcaacaagaacatgaaacacctgtgttcttcctctgctggnggcagctccagagtgggtcgtgtccaggtgcagctgcgaggacgtcgggcccaggactggtgaacgccgttcggacgccctcgtccctctcctgctactgtctcgtggtcgctccatcaagttacttacgtacgtcgaccgtggacgtccggcgaccgcccgggacggggaacggcgtaggtagggtggggttcgggtacgtttagttttacggcggtacggtacgggaacctaccgtaacctaccgacccgtcccctaccgtacgaacggtacgtacgtacgtaccgaccgtagttacgtcgtaacgtaacgaaccgaccgtaaccgaaacgaacccgtaagtacctcctacccggtagtaaccgtacgtacgtaccgtcgtacgtacccggaccgcccggacggaccggtaaccgggtcgttacgtacgttacgtcggtaacgaccggtaacgtaaccgttaccaaaatcgtaacgaccgtaacgagttaccgtacgttacttacgtttacttagagttacgtacgggagggaaccgtacgggtactaagttccgtaccgttaccgttactccgttacgccgtaccccg

SEQ ID NO: 218418 - DNA, 692 bp, Homo sapiens
  misc_feature: GYAE6OF01BVHZ1.9.53.E09.1.454.CMB.1.raw
  modified_base (368)..(368): a, c, t, g, unknown or other
  misc_feature (368)..(368): n is a, c, g, or t
tcagtgatacgtctcacgaccggtgctcgatttagagagagtgtgttgggtttggagtacgatttgatgttacctgatgcttagaggtcttttcctggaagcagggcatttgttgcttcagcaccgtagtgcctcgtcatcacgcctcacgtccttgtattttccggattttgacctaggaaaaccagcctacacgacttaaaccggacaccgtcgcccgacaacatacgccttcctccctcccccttgcagtaacaccaagtacagaatacttacctcgttccatcgactacgccttcgcctcgcgttagggcactccaccctcgcccgtaattaccgtggacctacggtaccgttggtcgtccggngtacgcgggttctttccgacccgttctttacttcgtttaacttatcgtacagacgtcttccgcttaaccgtttctacgtaaccttaccctcagtctaacgtccgaccttaccacacgtaccgaccttacccttcctaaccgtcggtaaccttaacgaccgtaaccgtaccccctacccctaaacccaactaacgaactacgtaacgccgtacgccgtacgaccgcgtacgtccttcggacgtacgttacgttccggtttacccttcccggtttcctaccgtttcccctccccgtaccttatacccgttaaaggtaccgttaacg

SEQ ID NO: 218419 - DNA, 853 bp, Homo sapiens
  misc_feature: GYAE6OF01ALTY1.9.53.E09.1.454.CMB.1.raw
  modified_base (178)..(178): a, c, t, g, unknown or other
  misc_feature (178)..(178): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctcgccctgactcagcctcgccctcgtgtcgtgggtctccgtggacagtcatccaccntcctccgtgcacgtaggaaccagcgtagtgtagttgggttacggggtatttacgtacgttaccgtttcgtccgttaccgtacggtaacccaacgacgacccgaacccgaacggaacccaaaaccccgaccccctaaaactctaacttactaagttttacgtacggtaacgtaccgaaccgtaaccggccccggtaccccgttagggtttaaccggggttttcttaaccgtccgttcctttccgtccgtacggtaccttaccgtaacgttctaacggaacccaaccgtacccggtaccctaccgaacgtaaacctacgttcccggtacggtccgggtaccctaccgggacggttacggtacgggaacgggtacggtacggttactttacgttaactttcgttacggtccgtctacgtacctaacgagttactcggagtagtcggtacggtaccgtaacccgttccgggttaccggttagggttacgggacccggggtaagggtaacccggtaacgggttacccggaccgggtttacccggtacggtaacggtacccgtaaccggaccccggttacggtaccccgccccgggttaccccgttaccggtccttaaccccggttcccgttaccccgtccccacccgtttacaaccgtacgttcacccgtcggtaccggg

SEQ ID NO: 218420 - DNA, 694 bp, Homo sapiens
  misc_feature: GYAE6OF01EDA7F.9.53.E09.1.454.CMB.1.raw
  modified_base (213)..(213): a, c, t, g, unknown or other
  misc_feature (213)..(213): n is a, c, g, or t
tcagtgatacgtctcacgaccggtgctcgatttagagagagtgtgttgggtttggggggggtcacaagaggcagcgctctcgggacgtctaccacatggcctgggctctgctgcctcctcaccctcctcactcaggacacgagggtcctgggcccagtctgccctgactcagcctgcctcgtgtcgtgggtctcctggacagtcgatccaccntcctcctgcacgtcggaaccagctagtgtacgttggttaggggtatttactcgtaccgttgttcctccgtacgtaaccaacgtcgaccacccgaaggaccaaaccgtaccccaatcacttactattagagacgtacaacgtacgcgtccgtagttaacgggtttctacgtctcttcgtcgtgtcctacgtagtcgtacaacgtaccgtccgtcctaccctagtaacctagttcctcggtccggtcctaggtaccggtgaaacgggaggtaccggtacggttactaggttaacttaacgttcggtcgtaacttcggtactacgttaagtaacgtccggtagtacgttacggtcggtacaccccgttacggtaccggttaggttaccgggtacgggaccgggtaacgttaaccgggaacgttccggaacccgtttaggaccgtaactacccggaaccggttaactcccggcccggtaacccgg

SEQ ID NO: 218421 - DNA, 758 bp, Homo sapiens
  misc_feature: GYAE6OF01A9MWB.9.53.E09.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
tcagtgatacgtctcacgaccggtgctcgatttagagagagtgtgttggggtttgggggggtcacaagaggcagcgctctcgggactctccacgatggcctggctctgctgctcctcaccctcctcactcaaggacacagggtcctgggcccagtctgaccctgactcgacgtcctggccctacgtgtcgtggtcctcgnggactaggtcaatcgacctagtcctcgngactacgtacggaaccngtacgtagtgattgggttaggtattatcgtacttgtcctcgtacgtacaancgaccaccgtaacggaccaaaccgtaccccaatcgatactagtttagacgacggtactaaccgtaacggccgtaccgttacgggttaacgggttttaccttacgttccgttacgtttccgtaccgttacggtacccttaacggtaaacggttaccgttaacaaaccccgaaaccggttaccccggtacccgttacccagtaaacctaacgtttccggtaccggtcgggtacctaccggtacggttaccggaggtaacggcggtaacgtacgtagtttaactttaacgtctacgtacgtactactatagtcctaggactagttacgtacggtactaccggtccgttaacggttcggtaacggttacggggccggtaaaccgggtaccgggtaacggtttccgaaccggtaccggttacgaccgttaccgggaacccgtcgggtaccctcccccgggttacccc

SEQ ID NO: 218422 - DNA, 813 bp, Homo sapiens
  misc_feature: GYAE6OF01ATKX1.9.53.E09.1.454.CMB.1.raw
  modified_base (739)..(739): a, c, t, g, unknown or other
  misc_feature (739)..(739): n is a, c, g, or t
tcagtgatacgtctcacgaccggtgctcgatttagagagagtgtgttgggtttgggggggaaatactttctgagactcatggacctcctgcacaagaacatgaaacacctgtggttcttcctcctgctggtggcagctcccagatgggtctgtcccaggtgcagctgacgtaggaggtccgggaccccaggtaccgtgggtacgaacgtcccgtttacgggaacgtaccccgtgttccccctcttcccgtgacctacgttcggtccttccgttggggtacggtcccttaccgacgttaccgtaacggtttaactttaccgttaccggtacggtaacccgttacgggtaaccgtcccggaccgaccggggacccccggggtaaccgggggaagggtaccgtgggggtacgggtttgggggtttcggggtacgttttaaggttttaacggccggtaaggggttaccggggaacctaacccgtaaaccgtaccgtacccgtcccccctaccgtacgaaacggtacggtccgaccgttaccacctacgttaggtacggtacgttaacgaccgtaacccggttaacaaacggtaaacccacgtacgtacccgtacccgtagaacggtcctacgtacctcggttcggtcccgacccgtcggacggccgtacgggtcgtagtacgttacgcggtcgaggtaacgtactaacctaagtacacgtaccagcgtacttagtacccgttntcgttagactagggttcgggagacggtaaacggtacgaagttccgtaaccggcttacgcgttcgacccgtcccg

SEQ ID NO: 218423 - DNA, 901 bp, Homo sapiens
  misc_feature: GYAE6OF01A3Z1C.9.53.E09.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
tcagtgatacgtctcacgaccggtgctcgatttagagagagtgtgttgggtttggggggggtcacaagaggcagcgctcgtcgggacgtctccaccatggcctggctctgctgctcctcaccctctcactcgaggacacgagggtcctgggcccaggtctgccccgtgacctcagcctcgccgtcgtgtcgtgggtcctcgtggacngtcgatccaccgtatcctcctgacctacgtacggaaccnggctaggtgtagttcgggttaggggtatttacgtcgttaccgttcgtccgtaccgttacggtaaaccaaaccgtacgacccgaacccgtacgggaaccaaaacccggaccccccaaaattcctaacttaccgttaaagttttaacgccgggtaaccggtaaccgtaaccgtaaaccgggtccccggtaccccggttacgggtttaaccgggttttacctaaccggttttccggttcccgtttaccgtaccgtaccggggtaaccttaacccggtaacgttaccggttaaccgaacccgtaaacccggtaccccggttaccccgtaccccgttaaacgggaccttaaacccttccgggttacccggtacccgggtacccgttaaccggtacgggtacccggtaggggtaaccggtaaccgggtacgtaccgtttaagttaaccggttttacttaccgggtccttacggttcctaaccgttacctaagttaccgggtagaccggtaaggttacgggttacggttccgtaaccggtaccggttaccgggttcggttaacggtaccgggggacgtaccggggtacgtacgggtacccgttacgttaccggtaccgtaccgtaaccgacccggtaccgtaccggtcccccgttacccggg

SEQ ID NO: 218424 - DNA, 769 bp, Homo sapiens
  misc_feature: GYAE6OF01ALE28.9.53.E09.1.454.CMB.1.raw
  modified_base (586)..(586): a, c, t, g, unknown or other
  misc_feature (586)..(586): n is a, c, g, or t
tcagtgatacgtctcacgaccggtgctcgatttagagagagtgtgttgggtttgggggtcacaagaggcagcgctctcgggacgtctccaccatggcctggctctgctgctcctcaccctcctcactcaggacacagggtcctgggcccagtctgccctgactcagcctgcctccgtgtctgggtcctcgtggacagtcgatcaccatcctcctgccacgtggaaccagcgagtcgagttcggtttgggaagttagtcggtacctttgtccgttaccgtaggtaacccaaccgtacgacccgaaccccgaaggacccaaaaccggacccccctaaaactcctaagtctaattttacgacgtaacggtacctaaccgtaacggcccggttaccctacggttacggggttttacctactttaccgtctttccgtccgtacggtccctaacccgtaacggttccacgtaaaccgacccgtacccgtccctacccgtacgaacctacttccggtaccgtcggggtcctaccggtacggtcccgtagggacgggaccggtacggtcttagtatttacgttacgcgtacgtntacctacgtatacgtcgagtacgtacgtggtaccgaccgtaccggtttcccggtaggttacggtaccgggtaccgggtaaaccgggtaccgggaaacgggtttcccggtaacccgggtacccgggttaaccgtccggtaacccggaccccggaccggtttccccggacccggttccccccggg

SEQ ID NO: 218425 - DNA, 800 bp, Homo sapiens
  misc_feature: GYAE6OF01BSCYY.9.53.E09.1.454.CMB.1.raw
tcagtgatacgtctcacgaccggtgctcgatttagagagagtgtgttgggtttgggggaaatactttctgagactcatggacctcctgcacaagaacatgaaacacctgtggttcatcctcctcctggtggcagcctcccagatgggtcctgtcccaggtgcggctgcgaggacggtcgggcccaagggtactaggtgaacgtcccttacgaaccacggtccccttcgtaccccttcaacccgtgcctaccttggtccttcgtgggtcctacctcctatcgaggtacggggttcggttaccgttacctaccgtcgggtaccttgggacgttcccgggacacggtcccggaccgggtacgtaaacggggtacctagggtaagttaacttaggtttacggaacgtaaagttccgtaaggtcgaccggagggtacgggaacccctctacgtacctaacccgaaccccgttcccacgaaacggtacgtacgagtaccgaacgtcgacttcggtacaaggttcccgaaccctacccggtaacccgtaacggaacccttacgggtttcccctaccggtagtaacccgtagggttacgtaagtttacggtacgtaccggacccggcgtaacgaacgaccgtaccggtcgttaagttctacgtggtggacggacgtacggtacggttacccgtttaggttaccggacttaacgtacgttaaacgttaaacccgtcgttaaccggtaccggttcgacgggttaccgttcgggacccggggacgtaacggggtaacctacgggtaccccg

SEQ ID NO: 218426 - DNA, 783 bp, Homo sapiens
  misc_feature: GYAE6OF01ET50B.9.53.E09.1.454.CMB.1.raw
  modified_base (238)..(238): a, c, t, g, unknown or other
  misc_feature (238)..(238): n is a, c, g, or t
  modified_base (276)..(276): a, c, t, g, unknown or other
  misc_feature (276)..(276): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtcgtgggtctcctggacagtcgatcaccatctcctgcactggaaccagcagtgatggttgggattatgtaccttgtctcctaggtaccaacngccaacccaggacaaaccgccccaaactcatcatttangagtcactacgccgcctcgtagggtttctacttcgtcttctctgcctacagtctagacaacgcgtccctctagaactactctcgtcggcctaccgaggcgtacggacgggacggtaggtcttaggttaactttacgttaccgttcgtacttcgtaccctttacgtaacttacgttcgaccgtaggtacgttacgggtacgtaacccgttacccggttcccggggtttacgggttaaccgggtttaccgggggaccgggggtaaaccgggggtaaacccggtaacgggggtttaccccgggtaaccccgggtttacccggtttaacggggtaccgaacccggggtaacccccggaaaccgggttcccggttacccccggtcccccccgggtttcgggttacccccgtttaacccgtttccccgtttacccccggtttacccccccgttacccccgtttacccggttaccggaacccgttacccgggttacctcccccgggttaaacgg

SEQ ID NO: 218427 - DNA, 787 bp, Homo sapiens
  misc_feature: GYAE6OF01AGNZK.9.53.E09.1.454.CMB.1.raw
  modified_base (265)..(265): a, c, t, g, unknown or other
  misc_feature (265)..(265): n is a, c, g, or t
  modified_base (584)..(584): a, c, t, g, unknown or other
  misc_feature (584)..(584): n is a, c, g, or t
tcagtgatacgtctcacgaccggtgctcgatttagagagagtgtgttgggtttggggggggtcacaagaggcagcgctcgtcgggacgtctccaccatggcctgggctctgctgcctcctcaccctcctcacggtcaggacacgacgggtcctcgggcccagtcctgcccctgactcagcctgccctccgtgtcgtcgggtcctccgtggactagtcgactccaacctacgttccttaccgtgacctaaccggtacggaaacccnggtacctaaggttggtaggtttaggggtttaggggtaagtttacgtacggttacccgtttgttcccgtacccgttacggtaacccaaacgaccgacccgtaacccgaacggaacccaaaacccggacccccctaaactctaactaccttaagtttacgtacggtaacgtaccaaccggtaccgtcccggtacccgttacggtacgggttttctacgttccgttccttcgtccgtacgtccctaacgtacttccgtacgaacccgtaccgtacccgtccctacccgagtactacgtccgtcggtaccggtccgtaccggnggtaccgtagggaccggacggtagttcgtacgttacttacgttccgtagtcccgtagtccttagtaatggtacgtacgtaggttcgtacgtccgtacccgtcgttaccggtaggttaccggtaccgggacggtaccgggtacgtacggtaccgtacccggttacgacgtacgacccggtaccggactccggtcccccgtccgg

SEQ ID NO: 218428 - DNA, 811 bp, Homo sapiens
  misc_feature: GYAE6OF01C6DWX.9.53.E09.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (290)..(290): a, c, t, g, unknown or other
  misc_feature (290)..(290): n is a, c, g, or t
tcagtgatacgtctcacgaccggtgctcgatttagagagagtgtgttggggtttggggggggtcacaagaggcagcgctcgtcgggacgtctccaccatggcctgggctctgctgctcctcaccctctcactcaggacacgagggtcctgggcccagtcctgccctgactcacgcctgcctcgtgtctgggtcctcgtggacngtcatcaccatctcngctacgaggaacctgcagtcgtagttgggttgggtattagtcgtacctttgtcctccgtacggtaaccaacncgaccaccgaacggacaaaccccgtacccaaactcatactatttacgagtacgtacacgtaacggcccgtaccgttcggtacggggtttactacgttccgttacttcgtcgtcggtaccctacgtaagttccgaacgaacccaaccggtacccggtaccccttacccgtacgtaaccgtacgtttacccttccgggtacccgggtcccttacgggacggtaccgtacgggaacgggaaccgtagggtctaacggtttaagtttaccttaacgtcgttaccgtacgttacgttaacaaagttcgtaaccgtaggttaacggtggttaacggttaaccgtacccgggtaacccggttttaccgggtaacggttaccgggggtaccggggaaacccgggggtaaacccgggtaacgttaacccggggggtttacccgtccccggtttaaaccgggaccggtacccggtaaaccggcccccgggttaaaccgggtcccccgttcccccgggttaaaccccccggg

SEQ ID NO: 218429 - DNA, 661 bp, Homo sapiens
  misc_feature: GYAE6OF01CG1EH.9.53.E09.1.454.CMB.1.raw
  modified_base (184)..(184): a, c, t, g, unknown or other
  misc_feature (184)..(184): n is a, c, g, or t
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
  modified_base (400)..(400): a, c, t, g, unknown or other
  misc_feature (400)..(400): n is a, c, g, or t
  modified_base (520)..(520): a, c, t, g, unknown or other
  misc_feature (520)..(520): n is a, c, g, or t
tcagtgatacgtctcacgaccggtgctcgatttagagagagtgtgttgggtttgggggggtcacaagaggcagcgctcgtcgggacgtctccaccatggcctggctctgctgctcctcaccctctcactcaggacacgagggtcctgggcccagtctcgccctgactcacgcctgcctccggtntcgtcggtcctccgtggactagtcgactcaccntcgtcngctacgtacggaaccngtcagtgtagtggttagggaacttntcgtacttgctcgtaggaacaacgcgaccaccgaggaccaaaccaccccaaacgtcactactacgtttagacggtacggttacaacgaaccggtcccggtcccgttacggttacgggtttactgttccgtctttcncgttcgctaccgtaagtctacgtaacgaaccgccgtcctaccgtacgactacttcgtcgtacggtccgtacgtcggtcgtaacgggacggtacgaggtaccttaagttactttacttcgngtctacgtacctaatcgtatacgactaaggtcgttcggtacgtaccgttccggttcggtaggttcgacgggtacggtacggtaaccgtgggtacccaccgggttcacggtacgacgtaccgagtcccgtcccggttcccgg

SEQ ID NO: 218430 - DNA, 635 bp, Homo sapiens
  misc_feature: GYAE6OF01ALXLS.9.53.E09.1.454.CMB.1.raw
  modified_base (132)..(132): a, c, t, g, unknown or other
  misc_feature (132)..(132): n is a, c, g, or t
  modified_base (336)..(336): a, c, t, g, unknown or other
  misc_feature (336)..(336): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
  modified_base (509)..(509): a, c, t, g, unknown or other
  misc_feature (509)..(509): n is a, c, g, or t
  modified_base (618)..(618): a, c, t, g, unknown or other
  misc_feature (618)..(618): n is a, c, g, or t
tcagtgatacgtctcacgaccggtgctcgatttagagagagtgtgttggggtttggggggggtcacaagaggcagcgctctcgggacgtctccaccatggcctgggctctgctgctcctcaccctctcactnaggacacagggtcctgggcccagtctcgccctgactcacgcctcgcctcgtgtcgtggtctccgtggacaggtcatcaccatcctctgcacgtaggaaccagcagtgtagttgggttcggtattgtaccgtacctttgtcctccgttacggtaaccaacgcgacccaccgaacgaccaaaccccacccaattcatactattagngactacacgtcgccgtccgttagtggtttcncttctccttncgtcgtacctacgtagtcacgaacncccgtacccgtccttacgagtaacctacgtcgtccgtacgggcctaacggcggtaccgtagggaccggtagtacggtacttagttacttactctacgccttgacctntacgtaacgctaagtaccggtgtaccgtaacaccgtccggtacggtttggccgtacggggacgtacggacggttacggccggtacctaggtaccgacgcgtaacccggntcccggtccccgtaccg

SEQ ID NO: 218431 - DNA, 835 bp, Homo sapiens
  misc_feature: GYAE6OF01B7Q78.9.53.E09.1.454.CMB.1.raw
  modified_base (218)..(218): a, c, t, g, unknown or other
  misc_feature (218)..(218): n is a, c, g, or t
tcagtgatacgtctcacgaccggtgctcgatttagagagagtgtgttgggtttgggggtcacaagaggcagcgctctcgggacgtctccaccatggcctggctctgctgctcctcaccctcctcactcaggacacagggtcctgggcccagtctgccctgactcagcctgtcctcgtgtcgtgggtctccgtaggaccagtcgatcacctatctcgtncacgtaggaacctagctagtgtagtgggttaggtagttacgtcgtaccttggtccttaccgtacggtaaacccaacacgaccaacccgaaggtaacccaaaacccgacccccctaaaaatacctaacgttactaagttttacgtacgggtaacggtaacctaaccggtaaacggtccccggtaccccgtttacgggtaaggggttttacccttaagttccgttacctttcgtcgtacgggttacctacctaggttctaacaaccgaactacccggtccttacccttaaggaacctaacgttccgtacggtcggtactaccgaggtcgtagaacggtacgagtccttagtaacgtttactacgtcggtactacggtactactaagttactaacggtacgtaaggttacgttaccgggtaacggttacccgtaacccgttaccgggggtttaaacggttacccgggtttaacgggggaaacccggggtaaacccgggggttaacccgggaaaccggggtttaccccggttaacccggttaaacccggttacgggttaaccccggaaacggtacccccgggtaaacggtccccgggttacccccggttaacccccccggg

SEQ ID NO: 218432 - DNA, 801 bp, Homo sapiens
  misc_feature: GYAE6OF01D1SP3.9.53.E09.1.454.CMB.1.raw
  modified_base (70)..(70): a, c, t, g, unknown or other
  misc_feature (70)..(70): n is a, c, g, or t
  modified_base (142)..(142): a, c, t, g, unknown or other
  misc_feature (142)..(142): n is a, c, g, or t
  modified_base (705)..(705): a, c, t, g, unknown or other
  misc_feature (705)..(705): n is a, c, g, or t
  modified_base (713)..(713): a, c, t, g, unknown or other
  misc_feature (713)..(713): n is a, c, g, or t
  modified_base (730)..(730): a, c, t, g, unknown or other
  misc_feature (730)..(730): n is a, c, g, or t
  modified_base (738)..(738): a, c, t, g, unknown or other
  misc_feature (738)..(738): n is a, c, g, or t
tcagtgatacgtctcacgaccggtgctcgatttagagagagtgtgttgggtttggggggaaatactttcngagactcatggacctcctgcacaagaacatgaaacacctgtggttcttcctcctgctggtgcagcctccagngtgggtcgtcgtcccgaggtgcagctgcgaggcgtccgggcccgaggctggtagaacgtcccgttcggacctcccttcgtcccctctcctgacctcgttcgttcgtcgttgggtcgacctcctagttactaacgtttaccttaccgtaccgtcggtaccctacgggaccgtcccggaccgacccggcccccggggaagggggtaaacgggtccggtaggggttggggttccgggggtttagggttaccgtttttaaggtttttacgggacgggttaggggtaccggggaaaccctaaccccgtaacgttaaccccgacccgtcccccccgttactaaccggtaacggtccggtaccgtacgtcccaaaccgtggttacgtaacgaacgttaaccgaaccgtaacccgtaacccgaaacgtaaccgtacttaacccttcccgtacgtacgaccttacgtcccgtaccgttcgtccggtacccgacccggccggtaaccggacccggtcggttaccgtagttaactcggtcgacgtacggtaactacgtaacgtaatagtaaccnctaacggnttaccgtgttaaccttntttcgtanagttggcggtaaccggagtacggtaattggtacctccgtaccttgccgtaccgcccgtaaccc

SEQ ID NO: 218433 - DNA, 687 bp, Homo sapiens
  misc_feature: GYAE6OF01BK93T.9.53.E09.1.454.CMB.1.raw
  modified_base (180)..(180): a, c, t, g, unknown or other
  misc_feature (180)..(180): n is a, c, g, or t
  modified_base (185)..(185): a, c, t, g, unknown or other
  misc_feature (185)..(185): n is a, c, g, or t
  modified_base (246)..(246): a, c, t, g, unknown or other
  misc_feature (246)..(246): n is a, c, g, or t
  modified_base (357)..(357): a, c, t, g, unknown or other
  misc_feature (357)..(357): n is a, c, g, or t
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
  modified_base (583)..(583): a, c, t, g, unknown or other
  misc_feature (583)..(583): n is a, c, g, or t
tcagtgatacgtctcacgaccggtgctcgatttagagagagtgtggttggggtttggggggggtcaacaagaggcagcgctcgtcgggacgtctccaccatggcctggctctgctgccttccctcctaccctcctcactcgaggacacgtacgggtccgtcggcccagtcctcgtccctnactcncgtccgtcgtccttcgtgtcgtcggtctccgtggactagtcgactaccaactcgtctccgngtacctacgtacgaacctgctagtgtagttcggtaggtatcgttcttacgttgtcccttacgacggtaaccactacgccgaaccgaaccgaccaaaccgtacccaaacgtntacctcttagttacaggtacgcgtaaccgtacggcccgttacgttacgttacgttntttacgctttccgtatccgtcncgtaacgttgaacctcgacgaccgtctacgtatactccgtagtccggttccaccgtccgcgggtacgacggtacggaaggtacgttatacgttacgtttacctcgttacgtcgtccgttaccattactggaacgtcgtagtcggtacncgtaccgtaccgtcggttaggtccggtaccgggaacgtccggtaacgtcgggaaccgtttcggagtccgtaaggcccctaggtaccctcccggtcccgtacccg

SEQ ID NO: 218434 - DNA, 821 bp, Homo sapiens
  misc_feature: GYAE6OF01A9LRS.9.53.E09.1.454.CMB.1.raw
  modified_base (231)..(231): a, c, t, g, unknown or other
  misc_feature (231)..(231): n is a, c, g, or t
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacgagggtcctgggcccagtctgccctgactcagcctgcctccgtgtcgtggtactcgtcgtacgacgtcgtacgtactaccactcttcctcncgactacggaaccgaacgcgacgtagtagtaggtttgggtaggttactacgttacccgtttacggttccgttcccgttacggtaaacccgaacctaacgacccggaacccccgaaaacggaaccgaaaaccccgaaacccccgtaaacccctaactacgtttaccgtttaaccgttttaaaggtttacggaaccggtaaacgttaaaccctaacgggtaaacccccgggtcccggtttacccggttagggggttttaccggtttccacggtttaccctaccttttccgttaccggtttcgaaccggtttacccaaacgggtttcgtacggaaacccaacgtaaccccgggtcccctccttaacaccgtactcgttaccggcggtccggttaccgtcggtagacgggtacggtacgtaccgtacctaacttacgtaccgtcgactaacggcttaacgtaactaaccttaaacgaacccgtaacggacctacgtacgttcgttacggttcgggttaacggtcgggaacggtcgtaacgtacggtacgtaccgacgttacggacaccggcgaaccgtcgcccgtcccgtaccg

SEQ ID NO: 218435 - DNA, 1013 bp, Homo sapiens
  misc_feature: GYAE6OF01ANXQP.9.53.E09.1.454.CMB.1.raw
tcagtgatacgtctcacgaccggtgctcgatttagagagagtgtggtttggggtttgggggggtcaacaagaggcagcgctcgtcgggacgtctccaccagtcggcctgggctctgctgcctcctacctaccctcctacactcgacggacgtcgacggtccgtcgggccctagtccgtcgccctgactcgcgtccgtcgcctcgtgtcgtcgtccgtctcgacgtaacgtcgtacgactaccacctcgtccctcgtacgaccgtaaccggtaccggaaccgtacgtacggtttacggttttacgggtttaaccgtttttaccgtccgttacccgttacccgttaacccgaaacccaaacccgtaaccccggaaacccgaaccgtaaccccgaaaacccgtacccctaaactcgtattaccgtttaattagacggtactaccgaacggtaccggtccggttaccggttcgttacttggtccgttcgtaccttcgttcgtcgttccgtaccttacctaccgtacgaccgtaccggtccctacctaccgtaacgtaaccgttacgttccggtcccgggtaccgtaccgtaacgtacggtaccggtacggtaaccgggtacgttaccgttacgtttaacccggtttagtttaacccgtttccggttaacgtttcccgttacttaaaccgttaaacgtttaacgggtttaaccggttagggttttaaacgggtttaacgggttttaccggggttaccgggggttttaacccgggggttaaccggggtaaccgggttaaaccggtaaaccggttacccgggttaccggttaacccggtacccggggttaccgtttaaacccggaccccggttaaccccggttcccggggtaaaccccgtttcccccggggtacccccgttaccccggtttacccggtttaccccgtttcccccggttttaaccccctttacccccccgggtttaaacccttccccccggtttaaccggttaaacccggg

SEQ ID NO: 218436 - DNA, 906 bp, Homo sapiens
  misc_feature: GYAE6OF01E5KSA.9.53.E09.1.454.CMB.1.raw
  modified_base (188)..(188): a, c, t, g, unknown or other
  misc_feature (188)..(188): n is a, c, g, or t
tcagtgatacgtctcacgaccggtgctcgatttagagagagtgtgttgggtttggggctttgcctgggctctgctgctcctccaccctcctcactcaggacacgagggtcctgggcccagtcctcgccctgacctcacgcctcgcctccgtgtcgtcgggtcctccgtaggacagtcgatccaacctntcctcctgacctacgtacggaaccagactagttgtagttgggttagggtattactcggtacctttcgtcctaccgtacgaaccaacaccgaccgaacccgacggaacccaaaccccgaccccctaaacttctaacgtttacttaacgtttagaccggtacggtaccgtaaccggttaccggtccccggtacccgtttagggttaccgggttttaccttacgtttccgttccttcgtccgtacgtacctaaccgtacgtactacgaaccctaccgcccgtacctccgtaagtaccctacgtccgtcggaccggtccgacgacggtacggacggtacggacgtcgtacgttacgtttaactttacgcctacggtaccttagtaccctagttacgtaccgtaggtaacgtacgggtttcggtaccggtaccccggttaccgtttacccggggttacgggtttaaccgggttacggggaacccgggggtaacgggaaaccgggttaccccggttacgggggttaaacccccgttaccgggtttaccccgaacgggttacccccggaacccgttacccggggtacccgtttcccccccgtccccggttacccccgggttacccgttaacccctttccccggttaccccgttacccccccgttaccccgttaacccgttcccggtaagttaacccccggtacgttcccgacgggttacccgggg

SEQ ID NO: 218437 - DNA, 689 bp, Homo sapiens
  misc_feature: GYAE6OF01B7DER.9.53.E09.1.454.CMB.1.raw
  modified_base (198)..(198): a, c, t, g, unknown or other
  misc_feature (198)..(198): n is a, c, g, or t
  modified_base (283)..(283): a, c, t, g, unknown or other
  misc_feature (283)..(283): n is a, c, g, or t
  modified_base (385)..(385): a, c, t, g, unknown or other
  misc_feature (385)..(385): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacgagggtcctgggcccaggtctgccctgactcagcctgcctcgtgtccgtgggtctccgnggactagtcgactcaacctatctccctgccaacgtggaaccagcagtgagtggttggacgttatgtacttgtctcgtgtaaccancgaccaccgaggacaaaccgccctaaacgctaagtctaatttgacgtacgtacgaccgtaacgtcccgtaccgtggtaacgggtttctacttccgtacttcncgtggacctacaagtctagacacncgtcctactnactactcgtcgcggtactaccgnggtcgaggaggtacgcggtacttacgttaacttaacgttcgtcgtacgttacctacgttactaacgttagtaccggagttaacggtacgttacgggttaaccgtaccgttaccgggttacccggttgggtttaaaccggcggggaaccgggtaaacggggaacccggttacgggtccggtacccggttacccggtaggttaccccgaaccggtaacccgggtccgtaccccgtacccgggtcccccg

SEQ ID NO: 218438 - DNA, 513 bp, Homo sapiens
  misc_feature: GYAE6OF02JDH9D.9.53.E09.1.454.CMB.1.raw
  modified_base (401)..(401): a, c, t, g, unknown or other
  misc_feature (401)..(401): n is a, c, g, or t
  modified_base (436)..(436): a, c, t, g, unknown or other
  misc_feature (436)..(436): n is a, c, g, or t
  modified_base (458)..(458): a, c, t, g, unknown or other
  misc_feature (458)..(458): n is a, c, g, or t
tcagtgatacgtctcacgaccggtgctcgatttagagagagtgtgttgggtttggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaatcatcatttatgaggtcactaagcggccctcaggggtttctattcgcttctctggctccaagtctgacaacacggcctccctgacaatctctgggctccaggctgagacgaggctgatattactgctgctcatatgcagatggtnacactcccgtggtattcggcggagggaccaaggtnaccgtctaggtcagccaaggcngcccctggtccacgtcctcgttccccgcccgtccttcgacgtacggtactctacg

SEQ ID NO: 218439 - DNA, 251 bp, Homo sapiens
  misc_feature: GYAE6OF02G5QYF.9.53.E09.1.454.CMB.1.raw
  modified_base (248)..(251): a, c, t, g, unknown or other
  misc_feature (248)..(251): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcgacggagggaccaaggtgaccgtcctaggtcagcccaaggctgcccctcggtcactctgttcccaccctcctcagacgtatcactgagcgggctggcaaggcgcatagnnnn

SEQ ID NO: 218440 - DNA, 564 bp, Homo sapiens
  misc_feature: GYAE6OF02HC6ZS.9.53.E09.1.454.CMB.1.raw
  modified_base (509)..(509): a, c, t, g, unknown or other
  misc_feature (509)..(509): n is a, c, g, or t
tcagtgatacgtctcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttagggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataacgcgtcgctgccgcagcttcggngcagtcggtttacgccccgttttcactcctttcccgcctatcctagaagacgtac

SEQ ID NO: 218441 - DNA, 249 bp, Homo sapiens
  misc_feature: GYAE6OF02ISNNG.9.53.E09.1.454.CMB.1.raw
  modified_base (248)..(249): a, c, t, g, unknown or other
  misc_feature (248)..(249): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgcccctcggtcactctgttcccaccctcctcagacgtatcactgagcgggctggcaaggcgcatagnn

SEQ ID NO: 218442 - DNA, 250 bp, Homo sapiens
  misc_feature: GYAE6OF02ILDI4.9.53.E09.1.454.CMB.1.raw
  modified_base (249)..(250): a, c, t, g, unknown or other
  misc_feature (249)..(250): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccaccctcctcagacgtatcactgagcgggctggcaaggcgcatagnn

SEQ ID NO: 218443 - DNA, 251 bp, Homo sapiens
  misc_feature: GYAE6OF02G5AJ8.9.53.E09.1.454.CMB.1.raw
  modified_base (249)..(251): a, c, t, g, unknown or other
  misc_feature (249)..(251): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccaccctcctcagacgtatcactgagcgggctggcaaggcgcatagnnn

SEQ ID NO: 218444 - DNA, 252 bp, Homo sapiens
  misc_feature: GYAE6OF02JC8JP.9.53.E09.1.454.CMB.1.raw
  modified_base (244)..(252): a, c, t, g, unknown or other
  misc_feature (244)..(252): n is a, c, g, or t
tcagtgatacgtctcacgaccggtgctcgatttagagagagtgtgttggttggggtggtggtggtcgtcactccgccttgacgaggctgattattactgctgctcatatgcagatggtgacactcccgtggtattcggcggagggaccaaggtgaccgtcctaggtcagcccaaggctgcccctggtcactctgttcccaccctcctcagacgtatcactgagcgggctggcaaggcgcatagnnnnnnnnn

SEQ ID NO: 218445 - DNA, 285 bp, Homo sapiens
  misc_feature: GYAE6OF02I4BGY.9.53.E09.1.454.CMB.1.raw
  modified_base (251)..(253): a, c, t, g, unknown or other
  misc_feature (251)..(253): n is a, c, g, or t
  modified_base (255)..(285): a, c, t, g, unknown or other
  misc_feature (255)..(285): n is a, c, g, or t
tcagtgatacgtctcacgaccggtgctcgatttagagagagtgtgttggggtttgggggtgtggtggtctccactcccgccttgacgaggctgacttattactgctgctcatatgcagatggtgacatcccgtggtattcggcggagggaccaaggtgaccgtcctaggtcagccctaaaggctgcccctggtcactctgttcccaccctcctcagacgtatcactgagcggggctggcaaggcgcatagnnncnnnnnnnnnnnnnnnnnnnnnnnnnnnnnnn

SEQ ID NO: 218446 - DNA, 249 bp, Homo sapiens
  misc_feature: GYAE6OF02GUFIJ.9.53.E09.1.454.CMB.1.raw
  modified_base (248)..(249): a, c, t, g, unknown or other
  misc_feature (248)..(249): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctcggtcacctgttcccaccctcctcagacgtatcactgagcgggctggcaaggcgcatagnn

SEQ ID NO: 218447 - DNA, 505 bp, Homo sapiens
  misc_feature: GYAE6OF02GJPL2.9.53.E09.1.454.CMB.1.raw
  modified_base (433)..(433): a, c, t, g, unknown or other
  misc_feature (433)..(433): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaatcatcattatgaggtcactaagcgggccctcaggggtttctattcgcttctctggctcaagtctgacaacacggcctccctgacaatctctgggctccaggctgaggacgaggctgattattactgctgctcatatgcagatgnacactccgtggtattcggcggagggaccaagggtcgaccgttccagggtccaggcccaaggcctgtcccccg

SEQ ID NO: 218448 - DNA, 517 bp, Homo sapiens
  misc_feature: GYAE6OF02F17DG.9.53.E09.1.454.CMB.1.raw
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaatcatcatttatgaggtcactaagcggccctcaggggtttctattcgcttctctggctccaagtctgacaacacggcctcctgacaatctctgggctccaggctgaggacgaggctgatttatactgttgctcatatacaggtgtaagttagttgggtgttcgggcggagggaccaagctgaccgtctaggtcagcccaaggctcgcccctggtcactcgtcgttcccaccctcctcacgacgtatccactgacgcggtcg

SEQ ID NO: 218449 - DNA, 534 bp, Homo sapiens
  misc_feature: GYAE6OF02IQPOG.9.53.E09.1.454.CMB.1.raw
  modified_base (444)..(444): a, c, t, g, unknown or other
  misc_feature (444)..(444): n is a, c, g, or t
tcagtgatacgtctcacgaccggtgctcgatttagagagagtgtgttgggtttggggggaaatactttctgagactcatggacctcctgcacaagaacatgaaacacctgtggttcttcctcctgctggtggcagctcccagatgggtcgtgtcccaggtgcagctgcaggagtcgggcccaggactggtgaagccttcggagaccctgtccctctcctgcactgtctctggtggctccatcagtacttactactggacctggatccggcagcccgccgggaagggactggagtgggttgggcgtatttttagcagtggggacaccaactacagcccctcctcaagagtcgagtcaccatgtcagtagacacgtcaagaaccagatctccctgaagctgacctctgtgaccgccgcggacacggccgtgtattactgtgcgagngttacccaaatatagcaacagctggtacattccttttagacttagtgtgggccaagggaccaaagtcggtctaccgtctacttcagtccc

SEQ ID NO: 218450 - DNA, 250 bp, Homo sapiens; identical to SEQ ID NO: 218442
  misc_feature: GYAE6OF02HJVFR.9.53.E09.1.454.CMB.1.raw
  modified_base (249)..(250): a, c, t, g, unknown or other
  misc_feature (249)..(250): n is a, c, g, or t

SEQ ID NO: 218451 - DNA, 304 bp, Homo sapiens
  misc_feature: GYAE6OF02F60TD.9.53.E09.1.454.CMB.1.raw
  modified_base (257)..(304): a, c, t, g, unknown or other
  misc_feature (257)..(304): n is a, c, g, or t
tcagtgatacgtctcacgaccggtgctcgatttagagagagtgtgttggggtttgggggtgtggtggtcctccactcccgccttgacgaggctgattattactcgctgctcatatgcagatggtgaccacgtcccggtggtacttcggcggtagggaccaaggtgaccgtcctaggtcagcccaaggctcgcccctggtcactctgttcccgccctcctcaggacgtatcactgagcgggctggcaaggcgcatagnnnnnnnnnnnnnnnnnnnnnnnnnnnnnnnnnnnnnnnnnnnnnnnn

SEQ ID NO: 218452 - DNA, 517 bp, Homo sapiens
  misc_feature: GYAE6OF02FH28V.9.53.E09.1.454.CMB.1.raw
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcgtgcactggaacgaatagcgacattggtggctctaatcatgtctcctggtactataacagtccaggcaaagccccaaactcataattatgatgtctttagacggcctcagggatttcttctcggttgtctggctccaagtctgggaacacggcctccctgaccatctctggacttcagcctgaggacgagggtgattacttctgcagttcagattcagtaaacttccctcgttgggtgttcggcggtagggaccagtgctgaccgtctgagtcagcccaagctcgcccctgtcactctcgttcccaccctcctcacgacgtactcactcgacgcggtcg

SEQ ID NO: 218453 - DNA, 262 bp, Homo sapiens
  misc_feature: GYAE6OF02G0HK6.9.53.E09.1.454.CMB.1.raw
  modified_base (250)..(262): a, c, t, g, unknown or other
  misc_feature (250)..(262): n is a, c, g, or t
tcagtgatacgtctcacgaccggtgctcgatttagagagagtgtggttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccgccctcctcagacgtatcactgagcgggctggcaaggcgcatagnnnnnnnnnnnnn

SEQ ID NO: 218454 - DNA, 540 bp, Homo sapiens
  misc_feature: GYAE6OF02I05N0.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcacccaggcaaagccccaaactcatcatttatgaggtcactaagccggccctcaggggtttctattcgcttctctggctccaagtctgacaacacggcctccctgacaatctctgggctcgaggctgatgacgaggctgattattactgctgctcattatgcagattggtcgacaccgtcccggtggttacgttcgggcgggaacgggaccgaagggttcgacccggttaccgtacggttccacggaccccgaaggtccctacccgg

SEQ ID NO: 218455 - DNA, 251 bp, Homo sapiens; identical to SEQ ID NO: 218443
  misc_feature: GYAE6OF02G0DQ8.9.53.E09.1.454.CMB.1.raw
  modified_base (249)..(251): a, c, t, g, unknown or other
  misc_feature (249)..(251): n is a, c, g, or t

SEQ ID NO: 218456 - DNA, 517 bp, Homo sapiens
  misc_feature: GYAE6OF02JGXSQ.9.53.E09.1.454.CMB.1.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (394)..(394): a, c, t, g, unknown or other
  misc_feature (394)..(394): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagtgatacgtctcacgaccggtgctcgatttagagagagtgtgttgggtttggggggtcgacgaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggactttangaccttgtctccgtggtaccaacagcaccagcaaagccccaaatcatcatttatgagtcactaagcgcctcgaggggtttctatcgcttctctggctcaagtctgacaacncgcctcctgacatctntggctccagctgagacngctgatttatactgctgctcattaatgcaagcgttagntaacnccgttcgaggttcgtcgggcggtaacgggacgtaggtacgaccgttcgtacggtcacgacccgagtccgtccgtaccccg

SEQ ID NO: 218457 - DNA, 250 bp, Homo sapiens
  misc_feature: GYAE6OF02HB5DF.9.53.E09.1.454.CMB.1.raw
  modified_base (249)..(250): a, c, t, g, unknown or other
  misc_feature (249)..(250): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccgccctcctcagacgtatcactgagcgggctggcaaggcgcatagnn

SEQ ID NO: 218458 - DNA, 526 bp, Homo sapiens
  misc_feature: GYAE6OF02FJDJS.9.53.E09.1.454.CMB.1.raw
  modified_base (305)..(305): a, c, t, g, unknown or other
  misc_feature (305)..(305): n is a, c, g, or t
  modified_base (387)..(387): a, c, t, g, unknown or other
  misc_feature (387)..(387): n is a, c, g, or t
  modified_base (408)..(408): a, c, t, g, unknown or other
  misc_feature (408)..(408): n is a, c, g, or t
  modified_base (521)..(521): a, c, t, g, unknown or other
  misc_feature (521)..(521): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcattatgaggtcactaagcggccctcaggggttttctattcgnttctctggctcccaaagtctgacaacacggccctcctgacaatctctgggctccaggctgaggacgaggctgatttattacngctgctcatatgcagatggtnactactcccgtggtacgttcgggcgagggaccaagggtcgacccgttctagtcacgcccgaaggcctcgcccctggtccacgttctcgttccccgcctcctcgagaccgttanctacg

SEQ ID NO: 218459 - DNA, 253 bp, Homo sapiens
  misc_feature: GYAE6OF02IW59K.9.53.E09.1.454.CMB.1.raw
  modified_base (248)..(253): a, c, t, g, unknown or other
  misc_feature (248)..(253): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctggtcactctgttcccaccctcctcagacgtatcactgagcgggctggcaaggcgcatagnnnnnn

SEQ ID NO: 218460 - DNA, 256 bp, Homo sapiens
  misc_feature: GYAE6OF02JW2HI.9.53.E09.1.454.CMB.1.raw
  modified_base (248)..(256): a, c, t, g, unknown or other
  misc_feature (248)..(256): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctggtcactctgttcccaccctcctcagacgtatcactgagcgggctggcaaggcgcatagnnnnnnnnn

SEQ ID NO: 218461 - DNA, 595 bp, Homo sapiens
  misc_feature: GYAE6OF02JPCPJ.9.53.E09.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
tcagtgatacgtctcacgaccggtgctcgatttagagagagtgtgttgggtttggggggggtcacgaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgtacttgtctcctggtaccaacagcacccaggcaaacgccccaaatcatcaattngaggtcactaagcggcctcgtaggggtttctattcgcttctctgctcagtcagacaacacgcctcctgactatctctgggcctcgagtctacgacgacgacggtcctaggtaactttacttaccgttgacctagtccttacgtattacgtcgtacgttagtttccggtttaccttctttaacgaagtacgtttacgtcggtacgggacgggtaaccgtagggtaccttacggtacccgttaccgttacggtaacggtcccgtacggaccccgtaaggtcccgttccccggg

SEQ ID NO: 218462 - DNA, 559 bp, Homo sapiens
  misc_feature: GYAE6OF02GRQVG.9.53.E09.1.454.CMB.1.raw
  modified_base (530)..(530): a, c, t, g, unknown or other
  misc_feature (530)..(530): n is a, c, g, or t
tcagtgatacgtctcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcggcttttcacccgctttatcgttacttatgtcagcattcgctacttctgatacctccagcatgcctcacagcacaccttcacaggcttacagaacgcctcccacccaacacgcatagcgtcgctgccgcagcttcggcgctagtcggtttacgccccgtttnacttccttcccgcactctgacgtacgtac

SEQ ID NO: 218463 - DNA, 535 bp, Homo sapiens
  misc_feature: GYAE6OF02GQSD9.9.53.E09.1.454.CMB.1.raw
  modified_base (301)..(301): a, c, t, g, unknown or other
  misc_feature (301)..(301): n is a, c, g, or t
  modified_base (425)..(425): a, c, t, g, unknown or other
  misc_feature (425)..(425): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcaccaggcaaacgccccaaatcatcatttangagtcactaagcgcctcgagggtttctattcgcttctctgctcaagtctgacacacggcctcctgacaatctctgggctcgaggctaggaggacgaggctagtattattactgctgctcgatangacagtagtggtacactaccgttccgtggttacgttcgggacgggtaacgggtaccaagggtcgacccgttcgtacggtccacggaccccgaaggtcctccgtacccccg

SEQ ID NO: 218464 - DNA, 574 bp, Homo sapiens
  misc_feature: GYAE6OF02FXS3C.9.53.E09.1.454.CMB.1.raw
  modified_base (472)..(472): a, c, t, g, unknown or other
  misc_feature (472)..(472): n is a, c, g, or t
  modified_base (522)..(522): a, c, t, g, unknown or other
  misc_feature (522)..(522): n is a, c, g, or t
  modified_base (545)..(545): a, c, t, g, unknown or other
  misc_feature (545)..(545): n is a, c, g, or t
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctcccgtccccccttcgcagtaacaccaagtacaggaatattaacctgtttcccatcgactacgcctttcggcctcgccttaggggtcactcaccctgccccgattaacgtggacaggaacccttggtcttccggcgagcgggcttttcacccgtctttatcgtttacttatgtcagcattcgctacttctgataccctccagcatcgcctcacagccacaccttcacaggcttacagaaccncctcccctacccaacaacgcaataacgcgtcgctcgccgcagccttcggncgtatcggtttacgccccgtttnacgttccttcccgcctatcctagagtacg

SEQ ID NO: 218465 - DNA, 603 bp, Homo sapiens
  misc_feature: GYAE6OF02GY03F.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgaactggaaccagcagtgatggttgggattatgaccttgtctcctggtaccaacagcaccaggacaaacgccccaaactcatctattatgagtcactaagcgcctgtagggtttctattcgcttctctgctaccaagtctagaacaacgaccgtccctccctagaactaagtcctcgtcgggtcctaccgaggtcgtggacggacgaggctagtattaattacgtgtctgtctatatatgactagtagtggtcgaacctacggtcccgttaggttacgttcgggtacgggaacgggtaaccgtaagggttcgtaacccggttaccggttaacgggttaccgaccggtacccggaacgggtcccgttacccggtcccccgttaccggg

SEQ ID NO: 218466 - DNA, 588 bp, Homo sapiens
  misc_feature: GYAE6OF02G4B1O.9.53.E09.1.454.CMB.1.raw
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (586)..(587): a, c, t, g, unknown or other
  misc_feature (586)..(587): n is a, c, g, or t
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggacccacactgatattggcattataaccttgtctctggtatcaacaacgccagacaaacgccccaacactacttaaatttatgacggtacaactaacgcggcctacgtaggggtttctcggtcgtcttctcgtcgcctacaagtcgtggacaacgaccggtccctcccgtagacgtcacgacccaaagggcctaccggccccccgttacggtcctaccgtttccgttccggttcccccgtaccccttccctacgaaccgtaccttactaccgacgtaggacggccggggccgtacgggacgaaacggggtccaaccgtaagtacgcactcgncncncgcgacncnctcgacncncacncncannc

SEQ ID NO: 218467 - DNA, 542 bp, Homo sapiens
  misc_feature: GYAE6OF02IRO04.9.53.E09.1.454.CMB.1.raw
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacacgcaccaggcaaacgcccccaaactcactctatttatgaggtcactaacgcggccctcgtaggggtttctatcgcttctctggctcagtctnacacncgcctccngacatctctggcncgagctgacgacgagctgattattacgtnctgctnattagtcgctagntggtacgactaccgtccgtaggttacgttcggacgggacgggtaaccgtaagggtacgaccgttaccgtacggtccgaccggccgaacggtccgtccgtcccccgg

SEQ ID NO: 218468 - DNA, 699 bp, Homo sapiens
  misc_feature: GYAE6OF02HED9U.9.53.E09.1.454.CMB.1.raw
  modified_base (192)..(192): a, c, t, g, unknown or other
  misc_feature (192)..(192): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccngcagtgagtggttgggagttatcgtacctttgtcctccgtacggtaaccaacacgccacccgaggaccaaaaccgaccccaaacctacactctattatgagtacactacgcggcccgtcgtacgggtttctacgttcgtcttcgttcgtcggtaaaaaaaaaaaccgtccgtaacgtcgtacgacgaaccgaccggtccctcccgtacgtaacctaactcgtcgtcggtcgtccgacggtacgtaggtacggacggacggtacgtagtagtttacgttacgtacgtcgtcgtcgtacgtacgtacgtgtacgtagtagttcggtacgtaccgtaccgttaccggttacggtacggttcgggtacgggtacgggaaccggtaacggtacggtaccgtaccgtacggtacgacgaccgacggtccgtccgtccccggtccgtccgtaccgttccgttcccgttaccccgtacccgttacccgtaccgtaccgtaccgtacgtacgtacg

SEQ ID NO: 218469 - DNA, 555 bp, Homo sapiens
  misc_feature: GYAE6OF02HH1SG.9.53.E09.1.454.CMB.1.raw
  modified_base (367)..(367): a, c, t, g, unknown or other
  misc_feature (367)..(367): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggccaaagcccccaaactcatcatttatgaggtcaactaagcgccctgaggggtttctattcgctttctctggctccaagtctgacaacncgcctcctgacaatctctcggctccgaggctgacggacgaggctggtaattattactgctgcttcatatgacagtagttggtgactaccgttcccgttggtacttcgggacgggacgggaaccgtaacgggtcgaacccgtttccgtaaggtccaacggtaccccgaagggtccctacggtccccccg

SEQ ID NO: 218470 - DNA, 658 bp, Homo sapiens
  misc_feature: GYAE6OF02IXX16.9.53.E09.1.454.CMB.1.raw
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (282)..(282): a, c, t, g, unknown or other
  misc_feature (282)..(282): n is a, c, g, or t
  modified_base (590)..(590): a, c, t, g, unknown or other
  misc_feature (590)..(590): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgattggtgggattnctacgttgtcctcgtggtaccaacgngccaaccgnggaanaaacccgaaccccaactacactctaatttanaggtacggtcaacgtaagccggcccctaggttacggggtttacttacgttccgttccttccggtttccgtacggtccctaaccgtaacgtttcgtacgaaccaaaaccggccggtaccccttaccgtcgaaacctaacttccttcggtcgggtccctacggacgtcgtaggacggaacggacgcgtagtatttaacttacgtcgtcgtcgtcctacaattagtcgacgaagtagtgtacgactaccgtccggtgtacgtcgggagggacgaacgaggtacgtacctagtacgacgaccgacgacgtcnccgtccccgtcggtaccacgttccgtccgttaccccacccttcctaccgaagtacgttacgtactacg

SEQ ID NO: 218471 - DNA, 280 bp, Homo sapiens
  misc_feature: GYAE6OF02HZWON.9.53.E09.1.454.CMB.1.raw
  modified_base (245)..(245): a, c, t, g, unknown or other
  misc_feature (245)..(245): n is a, c, g, or t
  modified_base (252)..(280): a, c, t, g, unknown or other
  misc_feature (252)..(280): n is a, c, g, or t
tcagtgatacgtctcacgaccggtgctcgatttagagagagtgtgttgggtttggggggtgtggtggtctccactccgccttgacgaggctgattattactgctgctcatatgcaggatggtgacactcccgtggtattcggcggagggaccaaggtgaccgtcctaggtcagcccaaggctcgccccctggtccactctcgttcccaccctcctcagacgtatcactgagcggctggcaaggcncagtagnnnnnnnnnnnnnnnnnnnnnnnnnnnnn

SEQ ID NO: 218472 - DNA, 563 bp, Homo sapiens
  misc_feature: GYAE6OF02IVIRE.9.53.E09.1.454.CMB.1.raw
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagccacccaggcaaacgccccaaactcatctatttangaggtcactaagcggccctcgaggggtttctggtcncttcnctcgcctcaagtctacggaaacacggccctcctagaactagtctcgtgggctcgagtctgacgacgaggtctgtattagtactgcagtctcatatgctagtttcgttccttctttacaagtacgttacgttcgggacgggtagggacccgtaggccgttacggacccgttccgtgtacggtccaccggacccctaagggtcctcccgtacccccgg

SEQ ID NO: 218473 - DNA, 584 bp, Homo sapiens
  misc_feature: GYAE6OF02GU66I.9.53.E09.1.454.CMB.1.raw
  modified_base (363)..(363): a, c, t, g, unknown or other
  misc_feature (363)..(363): n is a, c, g, or t
  modified_base (502)..(502): a, c, t, g, unknown or other
  misc_feature (502)..(502): n is a, c, g, or t
tcagtgatacgtctcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgttggacaggaacccttggtcttccggngagcgggtcttttcaccgtctttatcgttactatgtcagctattcgctacttctgactaccctccagcatcgcctcacagcacaccttcacagcttacagaacgcctccctaccaacacgcaatacgcgtcgctcgccncacgcgttcggtcgctagttcggtttaaccgccccgtttacacttccgttccccgactacttccgtacgtacgtacgtaacg

SEQ ID NO: 218474 - DNA, 519 bp, Homo sapiens
  misc_feature: GYAE6OF02JHT4I.9.53.E09.1.454.CMB.1.raw
  modified_base (304)..(304): a, c, t, g, unknown or other
  misc_feature (304)..(304): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (433)..(433): a, c, t, g, unknown or other
  misc_feature (433)..(433): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaactcatcatttangaggtcactaagcggccctcgaggggtttctattcgcttctctggctcaagtctnacacacgcctcctgacatctcnggctccagctgaggacgaggctgattattacngctgctcntatgcagatgtnacacgttcccgtggttagttcgggcgggtacggaccgtaagggtcgaccgtccgtaggtccgagtcccgaaggtcctcgtcccccg

SEQ ID NO: 218475 - DNA, 534 bp, Homo sapiens
  misc_feature: GYAE6OF02IKEKA.9.53.E09.1.454.CMB.1.raw
  modified_base (405)..(405): a, c, t, g, unknown or other
  misc_feature (405)..(405): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcaccaggcaaacgcccccaaactcatcatttatgaggtcactaagcggccctcaggggtttctattcgcttctctggctcaagtctgacaacacggcctcctgacaatctctgggctccaggctgaggacgaggctgattattactgctgctacatatgcagattggtnacactcccgtggtagttcggcgggagggacaagggtgaccgtccgtaggtcacgcccgaaggctacggcccccgtcggtccacgtccttcgttaccccacccgttcctccacggaccttactctaaccg

SEQ ID NO: 218476 - DNA, 539 bp, Homo sapiens
  misc_feature: GYAE6OF02GC36S.9.53.E09.1.454.CMB.1.raw
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (419)..(419): a, c, t, g, unknown or other
  misc_feature (419)..(419): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaactcatcatttatgaggtcactaagcggccctcaggggttctattcgcttctctgctccaagtctgacacncggcctccngacatctctggctcagctgagacgagctgattattactgctgctcatangcagtagtgtagactacgtcccgtaggtacgttccgggacgggacgggtaccgaacgggtcgtaacccggtccgtaacggttccgaacggtaccccgaacgggtcctccggtccccccgg

SEQ ID NO: 218477 - DNA, 512 bp, Homo sapiens
  misc_feature: GYAE6OF02FHM7S.9.53.E09.1.454.CMB.1.raw
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
  modified_base (465)..(465): a, c, t, g, unknown or other
  misc_feature (465)..(465): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggccaaacgcccccaaatcatcatttatgaggtcactaagcggccctcaggggtttctattcgcttctctggctccaagtctgacaacacggcctcctgacaatctctgggctccgaggctgaggacgaggctgatttattactgctgctnatatgcagntggtnacncgtccgtggtacttcgggcggaggaccaaggtgaccgtcgtaggtcagccaggcncgccccgtggccactctcgtcccaccctctcacgtacgtactctacg

SEQ ID NO: 218478 - DNA, 538 bp, Homo sapiens
  misc_feature: GYAE6OF02HM7C5.9.53.E09.1.454.CMB.1.raw
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (532)..(532): a, c, t, g, unknown or other
  misc_feature (532)..(532): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgcccccaaatcatcatttangagtcactaagcggccctnaggggtttctattcgcttctctggctcaagtctgacacacgcctcctgacatctctgggctcaggctggaggacgaggctgtattagttactgctgctcatatgcagagttggtcactaccgtcccgtggtacgttcgggcgggacgggaccgaagggtcgaccgtcgtacggcacgcccgaaggcctccgcccccgtcggtcctactcctaccgttccccacccttcctacgtacgacgtacnctacgg

SEQ ID NO: 218479 - DNA, 522 bp, Homo sapiens
  misc_feature: GYAE6OF02HQYI2.9.53.E09.1.454.CMB.1.raw
  modified_base (392)..(392): a, c, t, g, unknown or other
  misc_feature (392)..(392): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggcctcaggggtttcattcgcttctctggctccaagtctgacaacacggcctcctgacaatctctgggctccaggctgaggacgaggctgattattactgctgctcatangcagatggtgactactcccgtggttattcggcgggacgggaccgaaggtcgaccgtccgtaggtcaacgcccaaggcctcggccccctggtccactcctcgttcccacccttccncacgactntcctacg

SEQ ID NO: 218480 - DNA, 167 bp, Homo sapiens
  misc_feature: GYAE6OF02JIIYI.9.53.E09.1.454.CMB.1.raw
  modified_base (164)..(167): a, c, t, g, unknown or other
  misc_feature (164)..(167): n is a, c, g, or t
tcagtgatacgtctcacgaccggtgctcgatttagagagagtgtgttgggtttgggggtgtggtggtctccactcccgccttgacggggctgctatctgcccctcggtcactctgttcccaccctcctcagacgatcactgagcgggctggcaaggcgcatagnnnn

SEQ ID NO: 218481 - DNA, 573 bp, Homo sapiens
  misc_feature: GYAE6OF02GJR6U.9.53.E09.1.454.CMB.1.raw
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
  modified_base (433)..(433): a, c, t, g, unknown or other
  misc_feature (433)..(433): n is a, c, g, or t
tcagtgatacgtctcacgaccggtgctcgatttagagagagtgtgttggggtttgggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggacaaacgccccaaactcatcatttangaggtcactaagcgcctcgagggtttctattcgcttctctggctcagtctagacaacncggcctcctagacaatctcgtcggctccgaggctggacggacggaggctagtatttattacgtgctnctcatatgctaggtttcgttccttctttacaaagtagttacgttccgggacgggaacgggtaccgaacgggtccgttaccggtacccgttccgttaggaccggttaccgaaccggtacccggaacgggtcctaccccggg

SEQ ID NO: 218482 - DNA, 254 bp, Homo sapiens
  misc_feature: GYAE6OF02FIMLS.9.53.E09.1.454.CMB.1.raw
  modified_base (249)..(254): a, c, t, g, unknown or other
  misc_feature (249)..(254): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccgccctcctcagacgtatcactgagcgggctggcaaggcgcatagnnnnnn

SEQ ID NO: 218483 - DNA, 509 bp, Homo sapiens
  misc_feature: GYAE6OF02FXGK8.9.53.E09.1.454.CMB.1.raw
  modified_base (403)..(403): a, c, t, g, unknown or other
  misc_feature (403)..(403): n is a, c, g, or t
  modified_base (504)..(504): a, c, t, g, unknown or other
  misc_feature (504)..(504): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgcccccaaactcatcatttatgaggtcactaagcggccctcaggggtttctattcgcttctctggctccaagtctgacaacacggcctcctgacaatctctgggctcaggctgaggacgaggctgattatactgctgctcatatgcagatggtnacactcccgtggtattcggcggaggaccaaggtcgaccgttctaggtcagcccaggctcgcccccgtggtcacctctcgttcccgcctcctccagactacnctacg

SEQ ID NO: 218484 - DNA, 569 bp, Homo sapiens
  misc_feature: GYAE6OF02HRA9E.9.53.E09.1.454.CMB.1.raw
  modified_base (269)..(269): a, c, t, g, unknown or other
  misc_feature (269)..(269): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgccccaaactcatcatttangagtcactaagcggccctcgagggtttctattcgcttctctggcctcaagtctagacaacacggcctcctgacaatctcgtgggcctccgaggctaggaggacgaggcgtgtaatttattactgactgactcatagtgacgagtagtggtcaacgtaccgtccggttggtacgttcgggcgggtaacgggaccaagggtcgtacccgtcgtagggtccacggacccaacggtcctccggtcccccgtggtccctaccgtcttcccggttcccctcccgtcctcgacgtaactctcgtacg

SEQ ID NO: 218485 - DNA, 616 bp, Homo sapiens
  misc_feature: GYAE6OF02J0UXO.9.53.E09.1.454.CMB.1.raw
  modified_base (229)..(229): a, c, t, g, unknown or other
  misc_feature (229)..(229): n is a, c, g, or t
  modified_base (512)..(512): a, c, t, g, unknown or other
  misc_feature (512)..(512): n is a, c, g, or t
  modified_base (525)..(525): a, c, t, g, unknown or other
  misc_feature (525)..(525): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactggaaccngcagtgatgttgggattatgaccttgtctcctggtaccaacagtccaccaggaccaaacgcccccaaatcatctattatggagtcacgtaagccggaccctcgtaggggtttctagtttcgactttcctctacgggtccttaccgaaaggttccttagaaccctaaacgtaccgggtccccttccccgtagtaaccctaaacttccgttccgtcggggtacccttccgaacgggtcctagggacggacgtacggtcaggttatttatactgactgcttcatancgacagtagtgtnaccgtacgtccgtaggttactcgggtcggaacgggtaacctagggtccgtaccgtgtaacggtcgaaccgccgaggtccgccgtaccccgg

SEQ ID NO: 218486 - DNA, 556 bp, Homo sapiens
  misc_feature: GYAE6OF02HT3ZQ.9.53.E09.1.454.CMB.1.raw
  modified_base (445)..(445): a, c, t, g, unknown or other
  misc_feature (445)..(445): n is a, c, g, or t
tcagtgatacgtctcacgaccggtgctcgatttagagagagtgtgttggggtttgggggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccagcagtgatggttgggattatgaccttgtctcctggtaccaacagcacccaggacaaacgcccccaaactcatctatttatgagtcactagcgccctcgtaggggtttctattcgcttctctggtctccaagtctagacaacgaccggcctccctagactaatctcgtgggcctcgaggtctggacggacggaggctagtatttattactgctgctnattatgacagtagtgtacgactaccgtccgtaggtacgttcgggcgggaacggaccgtaggtcgacccgtcgtacggtacgacgacccgaacggtccgtccgtacccccgg

SEQ ID NO: 218487 - DNA, 530 bp, Homo sapiens
  misc_feature: GYAE6OF02HE7LA.9.53.E09.1.454.CMB.1.raw
  modified_base (302)..(302): a, c, t, g, unknown or other
  misc_feature (302)..(302): n is a, c, g, or t
  modified_base (381)..(381): a, c, t, g, unknown or other
  misc_feature (381)..(381): n is a, c, g, or t
  modified_base (424)..(424): a, c, t, g, unknown or other
  misc_feature (424)..(424): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgccccaaactcatcatttangaggtcactaagcggccctcgtaggggtttctattcgcttctctggctcaagtctgacaacacgcctcctgacatctcnggctcgaggctgaggacgaggctagtatttattactgctgctnatatgcagtatggtgacctacgttcccggtgtacgttcgggacggaacgggaacctagggtcgaccgttcgtacggtccgacgacccgaaggtcctccgtcccccg

SEQ ID NO: 218488 - DNA, 521 bp, Homo sapiens
  misc_feature: GYAE6OF02IG017.9.53.E09.1.454.CMB.1.raw
  modified_base (267)..(267): a, c, t, g, unknown or other
  misc_feature (267)..(267): n is a, c, g, or t
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacngcacccaggcaaagcccccaaatcatcatttangaggtcactaagcgccctcaggggtttctattcgcttctctggctcaagtctgacaacncgcctccngacatctctggctcaggctgagacgagctgatttattctgctgctcattatgcgagagtggtcgactccgttccggttgtacgttcgggcggaacgggaccgtagggtcgacccgttccgtaggtccgacgcccgaaggtccctacgtcccccg

SEQ ID NO: 218489 - DNA, 598 bp, Homo sapiens
  misc_feature: GYAE6OF02GAENM.9.53.E09.1.454.CMB.1.raw
  modified_base (530)..(530): a, c, t, g, unknown or other
  misc_feature (530)..(530): n is a, c, g, or t
tcagtgatacgtctcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgtttcccatcgactacgcctttcggcctcgccttaggggtcactcaccctgccccgattaacgttggacaggaacccttggtcttccggcgagcgggcttttcgacccgtctttactcgttacttatcgtcagcattcgcacttctgactacctccagccatcgcctcacacgcacaccttcacacggtcttaacacgaacgtcctacccctaccaaccaacgcaactaacgcgtcgctcgcccgcacgcttcggtcnctagttcggtttacgccccgtttacaccttccttccccggcctacgtcctcggtaacgtacgttaacg

SEQ ID NO: 218490 - DNA, 542 bp, Homo sapiens
  misc_feature: GYAE6OF02FIKEF.9.53.E09.1.454.CMB.1.raw
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcaccaggcaaagcccccaaactcatgatttangaagtcactaagcggccctggggatttcngctcgcttctctggctccaagtccgtacaacacgcctccctagacaatctctgggctccgaggctggaggacgaggctgattattacngccactcatgacngcagcctgaagtaagtgtaggtattcgggaggtagggtaaccaagccgtacggtaacccgtccgttaaggtaccgaccggtacccgaagggtccttaccggtccccccg

SEQ ID NO: 218491 - DNA, 575 bp, Homo sapiens
  misc_feature: GYAE6OF02HZVA0.9.53.E09.1.454.CMB.1.raw
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgatttttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgttggacaggaaccctttggtcttccggcgagcgggcttttcacccgctttatcgttacttatgtcagcattcgcacttctgatacctccagcatgcctcacagcaacaccttcacaggcttacagaaccgctcccctaacccaacaaccgcataacgcgtcgctcgccgcagccgttcggtgcagttcggtttacgccccgttttcacttccgttcccgcctacgtctgaacgtaccg

SEQ ID NO: 218492 - DNA, 629 bp, Homo sapiens
  misc_feature: GYAE6OF02HA9AC.9.53.E09.1.454.CMB.1.raw
  modified_base (310)..(310): a, c, t, g, unknown or other
  misc_feature (310)..(310): n is a, c, g, or t
  modified_base (386)..(386): a, c, t, g, unknown or other
  misc_feature (386)..(386): n is a, c, g, or t
  modified_base (453)..(453): a, c, t, g, unknown or other
  misc_feature (453)..(453): n is a, c, g, or t
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcacgtggaaccagcagtgatggttgggattatgtaccttgtctcctggtaccaacagccacccaggacaaacgcccccaaactcatcatttangaggtcactaagcgccctgtaggggtttctattcgctttctcgtggcctacagtctagacaacaccggtcctcctnactactctcgtggcctccgaggtctaggacggacgacggcttagtatttattacgtgtctcgtcctnaattatcgactagtagttggtacgaacctaccgttacccggttagggttacgttccggggtaccggggtaacggggtaacccgtaaggggttcccggtaacccggtttaccgttaacggggtaccctaaccgggaccccggtaaacgggtcccgttaccccggttacccccccggg

SEQ ID NO: 218493 - DNA, 726 bp, Homo sapiens
  misc_feature: GYAE6OF02JX1HA.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcacatctcctgcactgaaccagcagtgatggttgggattatgtaccgttgttcttccgtacggttaacccaacgacgccaacccaggaccaaaacgacccccaaactcaactactattatgaggtcacgtaagccgtcctcgtagggtttactattccgcttctctgtcctcgtaagtctcgtaacaacctaccggcctacccgtcgaactaactcctacgtcgggcctaccgtacggctacgggacggtaaccggaggtcccgtagttaactttacgttaacgttcgtaccttccggtacttaccgacgtttacgtacggtacgtaaacgtaggttacggtacggtaaccctaccgtttacccggttaggttaaccggtttccgggtaaccggggtaaccggggtaaacccggttaaaggggttaccccggtaacccgggtttacccggttaacgggttaacccgtaaccgggtaaccccgtaaaccggggtcccgttaccccgggttaacccccccggg

SEQ ID NO: 218494 - DNA, 716 bp, Homo sapiens
  misc_feature: GYAE6OF02FJAAT.9.53.E09.1.454.CMB.1.raw
  modified_base (284)..(284): a, c, t, g, unknown or other
  misc_feature (284)..(284): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaacncccccaaactcatcatttatgaggtcactaagcggccctcgacggggtttctagttcgcttctctaggctccaagttctagaccaaccgaccggccctccctacgaccaacttcctacgtcgggtcctacccgtagggtccttacgggaacgggtaccggaacgggccttaggtaactttaacgtttaaccgttggtacccgttggacctttaccgaacgttacgttacggacgtaacggtaagtttacggggttaccgaaacccttacccggttaccccggggttagggtttaccgttaccggggtaccggggtaaaccgggggtaacccggtaaacgggggttccggtaaccccggttacccgttaacggggttacccgtaccgggtacccccgtaacggggtcccgttacccggttacccccccccggg

SEQ ID NO: 218495 - DNA, 530 bp, Homo sapiens
  misc_feature: GYAE6OF02F7FN0.9.53.E09.1.454.CMB.1.raw
  modified_base (306)..(306): a, c, t, g, unknown or other
  misc_feature (306)..(306): n is a, c, g, or t
  modified_base (364)..(364): a, c, t, g, unknown or other
  misc_feature (364)..(364): n is a, c, g, or t
tcagtgatacgtctcacgaccggtgctcgatttagagagagtgtgttggggtttggggggggtcacaagaggcagcgctctcgggacgtctccaccatggccctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaacgcccccaaatcatcatttangaggtcactaagcgccctgaggggtttcattcgcttctctgctccaagtctgacaacncggcctcctgacatctctgggctcagctgaggacgaggctagtattattactgctgctacatatgacagattggtagacctacgttcccgtggtacttcgggacgggtacggaaccgaaggtcgaccgtcgtacggtccaaggcccaacggtcctccggtcccccg

SEQ ID NO: 218496 - DNA, 755 bp, Homo sapiens
  misc_feature: GYAE6OF02F1VHI.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtccgtgggtctccgtggacagtcgatcacctatcctcctgcacgtggaaccagcagtgagttggttagggattatcgtaccttgtcctccgtacggtaacccaaccgacccacccgacggaccaaaccgaccccaaactcatgtatttagtagaacgtacaacgtacgccggtcctcggtcgggtcctgacgtcgtcttctcgtcgctacgtacgtcgtggaccaacgacccgtcccttaccgtacggtacccgttccgtcggtccgggtccctaccggagggtccgtacgggaccgtagtcgggtacggtcgttaggttaacttttacgtttaccgtcgtacgtacgtccgttactagttacgtaccggtaccggaaccgggtacccccaaacccgtaaaccgttacgtttacgggttacccgggtttaacggggtaaccgggtaccggggtaaccccggtaccggggttaccccgttaaccccggttacccgggttaacggttaccccgaaccgggtacccccggtaaacccgggacccccctaacccccggtacgttacccggtaacccc

SEQ ID NO: 218497 - DNA, 673 bp, Homo sapiens
  misc_feature: GYAE6OF02HD502.9.53.E09.1.454.CMB.1.raw
  modified_base (231)..(231): a, c, t, g, unknown or other
  misc_feature (231)..(231): n is a, c, g, or t
tcagtgatacgtctcacgaccggtgctcgatttagagagagtgtggttggggtttggggggggtcacaagaggcagcgctctcgggacgtctccaccatggcctgggctctgctgcttcctccaccctcctcactcaggacacagggtcctgggcccagtctgccctgactcagcctgcctccgtgtctgggtctcctggacagtcatcaccatctcctgcactggaaccngcagtgatggtggattatgaccttgtctcctgtaccaacacgcaccaggcaaacgccccaaatcatcattgtgagtcactacgccgcctacgtacgggttctatcgcttctcgtgcctacaacgtctacgaccaacgccggcccttcctagactaagtcgtcgtcggcctaccgacggcgtggaacggtacgtaggtccgtagttatttaacttacgttgtcgttcgcttacctaagttacgtcgacgtaggtagttcgggtacgaaccgtacccgtttccggtacggtttacggttacccggggtacccggggtaagggtaaaccccgggtaagggttaacccggtaacccccgggttttaccggttaacccgggttacccggttaaccccgggaacccccggttaaccgggtcccccgttacccggttaccccccccggg

SEQ ID NO: 218498 - DNA, 509 bp, Homo sapiens
  misc_feature: GYAE6OF02FG1N1.9.53.E09.1.454.CMB.1.raw
  modified_base (402)..(402): a, c, t, g, unknown or other
  misc_feature (402)..(402): n is a, c, g, or t
  modified_base (487)..(487): a, c, t, g, unknown or other
  misc_feature (487)..(487): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaatcatcattatgaggtcactaagcggccctcaggggtttcattcgcttctctggctccaagtctgacaacacggcctccctgacaatctctgggctccaggctgaggacgaggctgattatactgctgctcatatgcaggcaccanaatgtcttcggaagttgggaccacggtccaccgtcctagtcacgcccaaggcccaacccatcgtacactctcgtccccgccctcncagtaccgtatccacgtgacgg

SEQ ID NO: 218499 - DNA, 556 bp, Homo sapiens
  misc_feature: GYAE6OF02I10CF.9.53.E09.1.454.CMB.1.raw
  modified_base (305)..(305): a, c, t, g, unknown or other
  misc_feature (305)..(305): n is a, c, g, or t
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggacaaacgcccccaaactcatctatttangaggtcaactaagccggcctcgtaggggtttctattcgcttctctcggctcaagtctgacaacncgcctcctgacatcncgtggctccgagctgacggacgaggtctaggtaatttacttactgctgcctacatatgacagtagtgtacgactaccgtccggttaggttacgttcgggacgggaacgggaccgaacgggtcgacccggttcgtacggtacacggtacccgaggtcctcccggtacccccgg

SEQ ID NO: 218500 - DNA, 566 bp, Homo sapiens
  misc_feature: GYAE6OF02H1RZN.9.53.E09.1.454.CMB.1.raw
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (425)..(425): a, c, t, g, unknown or other
  misc_feature (425)..(425): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctctgcactgaacagcagtgatgtgggattatgaccttgtctcctggtaccaacagcacccaggacaaaacgacccccaaactcatcatttangagtacactaagccgcctgagggtttctatcgtcttctctcgctcagtctgacacncgctccngacatcncgtggctcaggctaggacgacgagctagtactttattacgcgtactcgccttanaagttatcgataaggtagtcggtacgaacctaccgtcccggttaggttacgtccgggacgggaacgggtaaccgtaacgggtaccgtacccgtaccggtacggtccgaaccgtacccgaacggtctacccggtacccccgg

SEQ ID NO: 218501 - DNA, 608 bp, Homo sapiens
  misc_feature: GYAE6OF02HJQPB.9.53.E09.1.454.CMB.1.raw
  modified_base (423)..(423): a, c, t, g, unknown or other
  misc_feature (423)..(423): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacctttgtctccgtggtaaccaacagcacccaggacaaacgcccccaaactcatcatttatgaggtcactaagcggccctcgtaggggtttctattcgcttctctcggtctccaagtctgacaaccacggcctcctagacaatctctcgggctccgaggctggaggacggagctgtatttatactgctgctctatatgacagagtaggtnacctacgtcccgttggttacgttcgggacgggtaacgggaccgtaacgggtcggtaacccggtaccgttacgggtacaccggaccgtaacggccgtaccggtccccgtcgggtcctaccgttccttcccggtttacccctaccccgttcccgtaccgtaacggtacccgttacgtaccgtaacgg

SEQ ID NO: 218502 - DNA, 252 bp, Homo sapiens; identical to SEQ ID NO: 218293
  misc_feature: GYAE6OF02HUWUT.9.53.E09.1.454.CMB.1.raw
  modified_base (249)..(252): a, c, t, g, unknown or other
  misc_feature (249)..(252): n is a, c, g, or t

SEQ ID NO: 218503 - DNA, 614 bp, Homo sapiens
  misc_feature: GYAE6OF02HI7PH.9.53.E09.1.454.CMB.1.raw
  modified_base (309)..(309): a, c, t, g, unknown or other
  misc_feature (309)..(309): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatccacatctcctgcactggaaccagcagtgatggttggagttatgaccttgtctcgtggtaaccaacagcaccctaggacaaacgccccaaacgtcatcatttancgagtcacgtaacgcgccttgacgggtttctattcgtcttctactcggtctacctaagtcgtagaccaacgtccggaccttccctagaacctaattctacgtcggcttccgagtcgtaggaggtcgaaggtctggtaactttagttactcgtctgacctactagtaactgtactaggtacgttaggtactaacgtcccgttaccggtagttacggttacggaccgggtaacgggaccgttaagggtccgtacccgttacgtaccggtcgaacccggaccgtacggtaccgttcccgtacccccgg

SEQ ID NO: 218504 - DNA, 593 bp, Homo sapiens
  misc_feature: GYAE6OF02GKMTS.9.53.E09.1.454.CMB.1.raw
  modified_base (335)..(335): a, c, t, g, unknown or other
  misc_feature (335)..(335): n is a, c, g, or t
  modified_base (388)..(388): a, c, t, g, unknown or other
  misc_feature (388)..(388): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaatcatcatttatgagtcactaagccggcctcaggggtttctattcgcttctctgctccaagtctgacaacacgcctccngacatctctgggctcaggctgaggacgaggctgattattactgctgctcatangcagtatggtcgactacctcccggtggttacgttcgggacggtaacgggacccgaaagggttcgaacccgttcgttaacgggtccaacggtccccgaaagggtccctccggtaccccccggttcgggttcctaacccgttccgtccgtttacccccgaaccccttcccgttaccgaaccggtaaccgtttactacccgtaaccgg

SEQ ID NO: 218505 - DNA, 539 bp, Homo sapiens
  misc_feature: GYAE6OF02HTT16.9.53.E09.1.454.CMB.1.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (295)..(295): a, c, t, g, unknown or other
  misc_feature (295)..(295): n is a, c, g, or t
  modified_base (373)..(373): a, c, t, g, unknown or other
  misc_feature (373)..(373): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctggtctcctggacagtcgatcacatctcngcactggaaccngcagtgatgttgggattatgaccttgtctctggtaccaacagcaccaggcaaacgccccaaatcatcattangagtcactaagcgcctcgtagggtttctattcgcttctctggctccaagtctagacaacgacgcctactgacatctcnggctcagctagaggtacgaggctagtatttattacgtcgactgctcatagtcgcgagagttcggagtactaccgttcccggttgtacgttcgggccggtaagggacctaagggtcgaccgtccgttaggtacctaccggacccgaacggtcctcccggtacccccg

SEQ ID NO: 218506 - DNA, 599 bp, Homo sapiens
  misc_feature: GYAE6OF02GNMAN.9.53.E09.1.454.CMB.1.raw
  modified_base (435)..(435): a, c, t, g, unknown or other
  misc_feature (435)..(435): n is a, c, g, or t
  modified_base (592)..(592): a, c, t, g, unknown or other
  misc_feature (592)..(592): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtcctcctggtaaccaacacgccacccgaggaccaaacgacccccaaactcatctatttatgagtcaactaagccggccctcgtaggggtttctacgttcgtcttctcgtcggcctaccgaacgtctagaccaaccgaccggtcctccctagaacctaatctcgtcggcctcgacggcgtggacggacggaggtctgtacttattacgtgctgtcctntagtatcgacgagtacgttggtactaccgtaccgttcccggtaggttacgtcgggacgggtacggaccgtaggtccgtaccgtcgtacggtcacgaccgagcctccgccccgtggtcctcgtccgtccgttcccgcccttccgtcgacgtcgttacncgtacgg

SEQ ID NO: 218507 - DNA, 726 bp, Homo sapiens
  misc_feature: GYAE6OF02IL3N5.9.53.E09.1.454.CMB.1.raw
  modified_base (198)..(198): a, c, t, g, unknown or other
  misc_feature (198)..(198): n is a, c, g, or t
  modified_base (359)..(359): a, c, t, g, unknown or other
  misc_feature (359)..(359): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtnatggttggagttatgacctttgcttcgtggtaaccaacagccaaccaggacaaaccgccccaaactacatacatttatgacgtacaacaagccggccctacgtagggttttctacgtttcgtcttcctcgtcgctcctaagtctcgacaactacgcctccncgacaactctacgtcggctacgaggtctacgaggacggtaacggctacggtaatttacttacgtgtctaggtcctatacgtagtgtacaggtaacgtcgggtacgaaccgttaccgttacccggttaggttaacgggtttccggggaccgggggtaaaccgggttaacccggtaaacggggttcccggttaaacccggttacccggttaaccggtacgtaaacccgggtaccgtaaaccgggtccgtttaaccccggtcccccggttcccggtttaacccgcgttttaaccccgttcccggtttaccccctacccccgttaccgttaaccgaaccgggtttaacttacccggttaccttaacccggg

SEQ ID NO: 218508 - DNA, 557 bp, Homo sapiens
  misc_feature: GYAE6OF02GHP3O.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcattgggagttttaacctgtctcctggtaccaacaccacccaggcaaagcccccaaaactcatgatttatgaagtcactaagcggccctcggggatttctgctcgcttctctggctccaagtccgtcaacacggcctccctgacaatctctggctccagctgaggacaggctcgattattactgttgtctcattatacaggtgtaaggtagttagggtgtttcggagggacgggaccaaagctagaccgtacgtagtcgagcccgaaggcctcggtccccctcggtccaccttccgttcggttcccccgcccgttacctccgtaacgg

SEQ ID NO: 218509 - DNA, 529 bp, Homo sapiens
  misc_feature: GYAE6OF02GRJH7.9.53.E09.1.454.CMB.1.raw
  modified_base (307)..(307): a, c, t, g, unknown or other
  misc_feature (307)..(307): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (423)..(423): a, c, t, g, unknown or other
  misc_feature (423)..(423): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagccacccaggcaaaacgcccccaaatcatcatttangaggtcactaagcggccctcgaggggtttctattcgcttctctggctcaagtctgacacncggcctccngacatctcnggctcngctgacggcgaggctgtattattatgctgctnatatgcagactggtacactaccgtccgtggtacgttcgggacgggacgggaccaagggtccgaccgttcgtacggtacacgacccgaaggtcctaccgtccccccg

SEQ ID NO: 218510 - DNA, 842 bp, Homo sapiens
  misc_feature: GYAE6OF02GNPRV.9.53.E09.1.454.CMB.1.raw
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctccgtaggtaccaacagccacccgaggaccaaacgacccccaaactcatctaatttagtagaggtacaacgtaacggccggtccccgttacgtacggggttttctagttccgtccttctcgtcggtcctacaagtcctagaaccaaccgaccggtccctacccgtagaacctaacgttccgttacgtacggggtcctacccggacgggtccgtagggaaacggggaaccgggtagggtacccgtttaggttaaacgttttaacgtttaaccgttggtaccgttcggtacccttacgtaaagttacgtacggtaccggtaaaggtacggtttacggggtaccgtaacccgttacccgggttaccccgggtttagggtttaacccgggtttacccgggggaccgggggtaaaaccgggggtaacccgttaaagggggttacccggtaaccccgggtttacccggtaaacgggttaccccgaaccgggtaaccccgtaaccgggttcccgttaccccgggttcccccccggttgggttaccccgtaacccgttcccggttccccggttacccccgtccccgttacccgtaccggtacgttaacccgttacgtaccgtaaccggg

SEQ ID NO: 218511 - DNA, 564 bp, Homo sapiens
  misc_feature: GYAE6OF02G1VOU.9.53.E09.1.454.CMB.1.raw
  modified_base (305)..(305): a, c, t, g, unknown or other
  misc_feature (305)..(305): n is a, c, g, or t
  modified_base (361)..(361): a, c, t, g, unknown or other
  misc_feature (361)..(361): n is a, c, g, or t
  modified_base (445)..(445): a, c, t, g, unknown or other
  misc_feature (445)..(445): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggcaaacgccccaaactcatcatttangagtcactaagcgcctgagggtttctattcgcttctctggctcaagtctgacaacncgcctcctgacatctcgtggctcgagctgaggacgaggctagtattagttactgtctgctacattagtgacagtacgttggtanacctacgttcccgttaggtacgtttcgggacgggaacgggtaaccgtaagggtccgaacccggttaccgttacgggtccgaaccggaccccggtaacggtcccgtaccggtccccccgg

SEQ ID NO: 218512 - DNA, 623 bp, Homo sapiens
  misc_feature: GYAE6OF02G4QG3.9.53.E09.1.454.CMB.1.raw
  modified_base (240)..(240): a, c, t, g, unknown or other
  misc_feature (240)..(240): n is a, c, g, or t
  modified_base (281)..(281): a, c, t, g, unknown or other
  misc_feature (281)..(281): n is a, c, g, or t
  modified_base (447)..(447): a, c, t, g, unknown or other
  misc_feature (447)..(447): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattatcgtacctttgtctccgtggtaaccaangccacccgaggacaaaaccgacccccaaactcatctattangaggtcaactaagccggtccctcgtaggggtttctattcgtccttctctcggctcctaagtctagacaacgaccggcctcctagactaacgtctcgcggtcctcgaggtcgtaggacggacgaggctagtatttacttactgactgtctactatacgtgactagtnttggtacaaccgtcctccggtaggttacggtcgggacgggacgggaaccgtaggtccgtaccgttagtacggtccgacgacccgtaacggccgtacccgcccccggtggtccctaacgttccgttcccgttacccctaccccgttccaccgtacggtaccttacgtaccgtaccgg

SEQ ID NO: 218513 - DNA, 642 bp, Homo sapiens
  misc_feature: GYAE6OF02HS7ZO.9.53.E09.1.454.CMB.1.raw
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
  modified_base (268)..(268): a, c, t, g, unknown or other
  misc_feature (268)..(268): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacgagggtcctgggcccagtctcgccctgactcagcctgcctcgtgtctggtctctggacagtcgatcacntctctgcactggaaccngcagtgatggttgggatttatgtaccttgtctcgtgtaccaacngcaccgaggacaaacgaccccaatcatctattatgagtctacgtaagccgcctcgtagggtttctagttcgtcttctcgtcgctactaagtctacgaacaacgcggtcctcctagaactactcgtcgtcggtcctaccgaggtctaggacggacgacggtactgtaactttattaccgtgtacctgtaccttacgtattacgtcgactagtacgttgggtaacgtacccgttacgttacccgggttaggttaccggttccggggtacggggtaaccgggtaaccggttacgggtaccggtaaccccggtttccgtaacgggttacccggaccggtaaccccggtaaggtccccggtacccggttaccccccggg

SEQ ID NO: 218514 - DNA, 701 bp, Homo sapiens
  misc_feature: GYAE6OF02G91XL.9.53.E09.1.454.CMB.1.raw
  modified_base (229)..(229): a, c, t, g, unknown or other
  misc_feature (229)..(229): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactaggaaccngcagtgtagtggttagggattatgtacctttgccttcctacggtaaccaactagccaacccgaggaccaaaaccgaccccccaaaactctaacttcctatttaacgtggtaacggtaccaacttaaacgggcccggtacccctaccgggttacgggggttttaccttaacgtttccgtcctttccgttcgtcgggtaccttaccgtaaacgttcttacggaaccaaaccgtaccggtccctacccgtagaacctaacgttccgtcggtcgggtcctacccgacggtcgtaggacggtacggaggtccgttagtaatttacttacgtgcttcgcttacagttagtcgactagagttacggtcgtaactccgttccggtagtttacgtccgggagggaccggtaacggtacgggtaccgacccggttacgtacggtaccgaccggaacccgacgggtcctccccggtaccccgg

SEQ ID NO: 218515 - DNA, 558 bp, Homo sapiens
  misc_feature: GYAE6OF02GWZKT.9.53.E09.1.454.CMB.1.raw
  modified_base (326)..(326): a, c, t, g, unknown or other
  misc_feature (326)..(326): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgcccccaaactcatcatttatgaggtcactaagcggccctnaggggtttctattcgcttctctggctcaagtctgacaacacggcctcctgacaatctctgggctccgaggctggaggacgacggctgtaattattacgtgctgctcatatgcagtagtgtagaccgacttcccggtaggtacgttcgggacgggaacggggaaccgtaacgggtcgtacccggttaccgtacgggtccaaccggacccgtaacggtcctcccggtccccccg

SEQ ID NO: 218516 - DNA, 736 bp, Homo sapiens
  misc_feature: GYAE6OF02FGDL3.9.53.E09.1.454.CMB.1.raw
  modified_base (179)..(179): a, c, t, g, unknown or other
  misc_feature (179)..(179): n is a, c, g, or t
  modified_base (217)..(217): a, c, t, g, unknown or other
  misc_feature (217)..(217): n is a, c, g, or t
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgattttccggatttgcctggaaaccngcctacacgcttaaaccgggcaaccgtcgcccgcaacntagccttctcccgtcccccttgcacgtaaccaccaagtacaggaacttacttaacctgtttcccatcgactacgtcctttcggccttcgccgttaggggtccactccaccctgccccgtattaacgtgacagacccttggtccttccggcgagcggtccttttccgaccgtctttatccgttacttactgtacagctattccgactactttcagactaccctcagcatcgcctcaccacgacccacctacccttacaccgtacggtaccttaaccgaacgtaacccgcccttaaccccccgtaaaccccaaaaccaaacccggtacctaaacgtaaaccggtcccggttacccgtaccgtccgccccggtaccgtaaccggttcccggttttaccgggactacccggttaacggtttacgggttttaacccccggttacccccggtttttaccaacccgttttcccccgttaccccgtaccccgttaacttacccggttacggtaaaccggttaacccg

SEQ ID NO: 218517 - DNA, 565 bp, Homo sapiens
  misc_feature: GYAE6OF02FKATW.9.53.E09.1.454.CMB.1.raw
  modified_base (426)..(426): a, c, t, g, unknown or other
  misc_feature (426)..(426): n is a, c, g, or t
tcagtgatacgtctcacgaccggtgctcgatttagagagagtgtgttgggtttgggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggcaaacgcccccaaactcatcatttatgaggtcactaagcggccctcaggggtttctattcgcttctctggctcagtctgacaacacgcctcctgacaatctctgggctccaggctgaggacgaggctagattacttacgtgtctnctcatatgcagatggtcactccgtccgttaggttacgttccgggacgggtaacgggaaccgtaacgggtcggtaacccggttaccgttaacggggtccaacgggtacccccgtaaggcccgttaccggtacccccccgg

SEQ ID NO: 218518 - DNA, 591 bp, Homo sapiens
  misc_feature: GYAE6OF02GVP05.9.53.E09.1.454.CMB.1.raw
tcagtgatacgtctcacgaccggtgctcgatttagagagagtgtgttgggtttgggggggaaatactttctgagactcatggacctcctgcacaagaacatgaaacacctgtggttcttcctcctgctggtggcagctcccagatgggtcgtgtcccaggtgcagctgcaggagtcgggcccaggactggtgaagccttcggagaccctgtccctctcctgcactgtctctggtgctccatcagtacttactactggacctggatccggcacgcccggcgggaagggactgggaggtgggttgggcgttagtttttaggcgtaggtggggaccaaccgaactacacgccccctcctcgaagacgtcgacgtcacctatgtacagtacgacacgtaccaagaaccagactcctaccctagaagctacgacctctgtacgaccgtccgcggaccaccggcgtagtacttacgtgtcgcgagacgttacccaaatacgtagacaacacgtcgtaggtaactatttccgtttagattagtggtcggggaccaagggtacaagtggtacctaccgttccttcttacgacgtacccg

SEQ ID NO: 218519 - DNA, 614 bp, Homo sapiens
  misc_feature: GYAE6OF02GJ9TK.9.53.E09.1.454.CMB.1.raw
  modified_base (239)..(239): a, c, t, g, unknown or other
  misc_feature (239)..(239): n is a, c, g, or t
  modified_base (303)..(303): a, c, t, g, unknown or other
  misc_feature (303)..(303): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctcgtgtctggtctcctggacagtcgtcacatctctgcactggaaccagcagtgactagttggncttataactatgtctcctggtaccaacacgcaccaggacaaacgtcccaaactcatgtatttanagagtacaataacgccggacctcgtcgggtccctgactctcttcgtctcggctacagtcacgacaccgcggtccctccgtcgacctctacgtcggcctacacgtactcgacgtactcggagtcgtagtactttacgttaatcgactacgtacttcaatacgttccgacgtaaccggacctaaccccgaagttaacgtacggttaccgttaccgggacggtaccgggaacccgttaccggtccctaacccggtaccgtttacggaccgtacccggaaccggtaacggaccccgttaaccccgtagtacccgg

SEQ ID NO: 218520 - DNA, 519 bp, Homo sapiens
  misc_feature: GYAE6OF02I2P5S.9.53.E09.1.454.CMB.1.raw
  modified_base (468)..(468): a, c, t, g, unknown or other
  misc_feature (468)..(468): n is a, c, g, or t
  modified_base (496)..(496): a, c, t, g, unknown or other
  misc_feature (496)..(496): n is a, c, g, or t
  modified_base (514)..(514): a, c, t, g, unknown or other
  misc_feature (514)..(514): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggccaaacgcccccaaaactcatcatttatgaggtcactaagcggccctcaggggtttctattcgcttctctggctccaagtctgacaacacggcctcctgacaatctctggctcagctgagacgagctgattattactgctgctcatatgcagagtggtgactacctccgtaggtacgttcgggacggagggaccaaggtcgaccgtcgtagtcacgccgaagcncgccccgtggtaccacgtctcgttcccnccgtctcgacgacgtacnctacg

SEQ ID NO: 218521 - DNA, 605 bp, Homo sapiens
  misc_feature: GYAE6OF02F61H6.9.53.E09.1.454.CMB.1.raw
  modified_base (479)..(479): a, c, t, g, unknown or other
  misc_feature (479)..(479): n is a, c, g, or t
  modified_base (533)..(533): a, c, t, g, unknown or other
  misc_feature (533)..(533): n is a, c, g, or t
tcagtgatacgtctcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctccgtcccccttgcagtaacaccaagtacaggaatattaacctgtttcccatcgactacgcctttcggcctcgccttaggggtcactcaccctgccccgattaacgttggacaggaacccttggtcttccggcgagcgggcttttcacccgtctttactcgttacttatcgtcagctattcgctacttctgacttaccctcagctatcgcctcacacgcactaccttcacacggcttacgacgtaaccncctacccctaaccaacaacgcaataacgcgtcgcgtcgccgcacgtcgttcggngactcgttcggttactcccccgtttctaccgtttcccgttccccgactacctacgtacgaacgtacgttacg

SEQ ID NO: 218522 - DNA, 845 bp, Homo sapiens
  misc_feature: GYAE6OF02GDITC.9.53.E09.1.454.CMB.1.raw
tcagtgatacgtctcacgaccggtgctcgatttagagagagtgtgttggggtttgggggctttgcctgggctctgctgctcctcaccctcctcactcaggacacagggtcctgggcccagtctgccctgacgtcagcctgcctccgtgtctgggtctcctggacagtcgatccaccattcctcgtgcacgtggaaccagcagtcgattggttcgggattactcgtaccgttcgtcctaccgtaggtaaccaacgtacggcctaacccgaaggacctaaaccgaccccctaaacgtcctaacttactaagttttaacgtacggaacggttacccaaaccgttaaacgcccggtaccccgttacggttaacgggggttttcctaaggtttcccgtaccgttttccgtaccggttaccgggtacccgttaccgtaaacggttccgttacggtaaccgtaaaccggtacccggtccccttaccccgtacgtaaccgtaaacttccgttaccggtcgggtacccgtacccggacggtaccgtaacggtacgggaaccggtacggtcgttaggtacgtttacttaccgtacgtcgtacgtactacgtaaagtacgtacgtaacgtaagtacggttcggtacggtaccctaccggtacccggttaggttacgttaccgggaacgggtaaccgggtaccgaaggttcccggtaccggttaccgtaacgggtccgtaaccgggcccgtaacggtccgttacccggacccccggttcggtacccgtaccgtcccgttacccgttaccccgtacccgttccgttaccgaacgtacccgtttacgaccgttaccggg

SEQ ID NO: 218523 - DNA, 653 bp, Homo sapiens
  misc_feature: GYAE6OF02IGISE.9.53.E09.1.454.CMB.1.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgtaccttgtctcctggtaccaacagcacccaggcaaacgcccccaaactcatctatttatgaggtcaactaagccggccctcgtaggggtttctattcgtcttctcgtcggctccaagtctagacaacgacggcctccctagacaatctcgtcgggcctccgaggctaggacggacggaggtcttaggtaattttacttacgtgtctgtacctctattagtcgactaagtacgttgggtacgaaccgtaccgttcccgggttaggttaccgttccggggacggggtaacggggtaacccgtaaacggggttaccggtaaccccgggttacccgttaacggggttaccgtaacccgggtaccccggtaaaccggggtcccgttaccccgggttaccccccccggg

SEQ ID NO: 218524 - DNA, 677 bp, Homo sapiens
  misc_feature: GYAE6OF02GWTO4.9.53.E09.1.454.CMB.1.raw
  modified_base (218)..(218): a, c, t, g, unknown or other
  misc_feature (218)..(218): n is a, c, g, or t
  modified_base (253)..(253): a, c, t, g, unknown or other
  misc_feature (253)..(253): n is a, c, g, or t
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
tcagtgatacgtctcacgaccggtgctcgatttagagagagtgtgttggggtttggggggggtctcgaggaggcagcgctctcgggacgtctccaccagtggcctgggctctgctattcctcaccctcctcactcagggcacgagggtcctggacccagtctgccctgactcaacctgcctcgtgtctgggtctcctggacagtcgatcacatctccngcactggaaccagcagtgactattggtaattaacntgtctccgtgtaccaacaacgtaccccgganaaacgccccaaatcttgctttangatgtcagttatcggcctnaggtagttctgtatctcttctctcggactcctaagtcgtcggccaccgtacggccctccctacgacctacttctcgttcggccttccgaggtctacggaacggaccggagtcgttaaggtattttaacgtttcgttacgacgtaacgtacgttaaaaccgaaaaaggtaaccgtaacgtccccgttagttaccgggtttcgggttttaccggggaaccgggggtaccgtaaacgggttcggtaaccccgttacgtaacgtcccgagaacccggtaacggtacctacccggtccccgtaaccggttctaaccgtccgtttcccgtaccccgtaccctccgttacgtaaccgg

SEQ ID NO: 218525 - DNA, 588 bp, Homo sapiens
  misc_feature: GYAE6OF02HHCCW.9.53.E09.1.454.CMB.1.raw
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
tcagtgatacgtctcacgaccggtgctcgatttagagagagtgtgttgggtttgggggggaaatactttctgagactcatggacctcctgcacaagaacatgaaacacctgtggttcttcctcctgctggtggcagctcccagatgggtcgtgtcccaggtgcagctgcaggagtcgggcccaggactggtgaagccttcggagaccctgtccctctcctgcactgtctctggtgactccatcagaggtggtcgttcctacgtggacctggactccggcacggtcccgccggcgaagggactggagtatagttggaacgaatctatgcaggtcggaccgcatctaaccacccgtcctanaacgngtcgagtcagcatgcagtcgacaccgtcccacgaacctacgttcctccctagactagtgtagttatacgtcgaccgccgacaacgaccgacggtccgttagttacttacgtgtgacgaggacggtaggttaccgtttagtttacggacctagtactaacgttaaacctccgtaacgtacggtcgtacggtacgtcggacgggaccggagggtacctaggtcccg

SEQ ID NO: 218526 - DNA, 633 bp, Homo sapiens
  misc_feature: GYAE6OF02GA7FB.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcagggcacagggtcctgggcccagtctgccctgactcagcctccctccgcgtccgggtctcctggacagtcggtcaccatctcctgcactggaaccagcaggtgacattggtgtctttaataacctatgttcctcctggtaccaacagccacccaggacaaacgtccccaaactcatgtatttatgagtcaataagcggccctcgtgggtccctgactcgtcttctctcgcctcaagtctgacaacgccgcctccctgaccgtctcgtcgggcctccgaggctggacgagtcggagtctgtaatttacttactcgcctagtccttacgtattacgtgaccgacgaccaaccccaacgtaacttcggttacgttaccgggaacgggttcgggaacccgtacggggtcccgtaacccggttacccggtaacgggttacccgaaccggaccccggtaaaccggacccccgtaaacccccgtaccgttacggtaccccttacccgg

SEQ ID NO: 218527 - DNA, 694 bp, Homo sapiens
  misc_feature: GYAE6OF02JCVEM.9.53.E09.1.454.CMB.1.raw
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgtaccttgtctcctggtaccaacagcaccaggacaaacgaccccaaactcatacattatgagtcactaagccgcctgtagggtttctagttcgcttctctgctacagtctgacaacncgcctcngacatcgtctacggtctccgaggtctaggacggacgtaggtccgttaggtaacttttacgttaacgtcggtcttcgtaccgtactaaacgttacgttaggacccgtaaaggtaacggttacgggttaaccgtaaacccgttaaccccgggtttacccgggttaacgggtttaccggttacccgggggaaccgggggtaacccgggggtaaacccgttaaacgggggttacccggttaacccggttaaccgggttaaccgggttacccgaacccgggtaaccccggtaaccggggttcccgtccccgggttaacccccccggg

SEQ ID NO: 218528 - DNA, 539 bp, Homo sapiens
  misc_feature: GYAE6OF02F2D60.9.53.E09.1.454.CMB.1.raw
  modified_base (291)..(291): a, c, t, g, unknown or other
  misc_feature (291)..(291): n is a, c, g, or t
  modified_base (407)..(407): a, c, t, g, unknown or other
  misc_feature (407)..(407): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcacccaggcaaacgcccccaaactcatcatttatgaggtcactaagcggccctnaggggtttctattcgcttctctggctcagtctgacaacacgcctccctgacaatctctgggctccaggctgaggacgaggctgtattagttactgctgctcatatgcagatggtanacacgtcccggtgtacgttcgggcggagggaccaagggtcgaccgtccgtaaggtccacgacccaaggctcggccccgtggtccactccgttccgttccccacccttcctacgacgtaccgttatcctaccg

SEQ ID NO: 218529 - DNA, 605 bp, Homo sapiens
  misc_feature: GYAE6OF02GV3W9.9.53.E09.1.454.CMB.1.raw
  modified_base (374)..(374): a, c, t, g, unknown or other
  misc_feature (374)..(374): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggagttatgacctttgtccttcctggtaaccaacagccaaccccgaggaccaaacgccccccaaaactccatcctatttatgaggtcactaaggccggccctcgtaggggtttctagttcgtcttctcgtggctccaagtctgacaacgcgcctcctgactaatctcnggctcaggctgaggacgagctgtattatactgctagtctcatatcgcagagtggtacgacctccgtccggttggttacgttcggggacgggtacgggaccgtaagggtccgtaccgttaccgtacggtcgacgacccgaacggcctccggtcccccgtcggtcctacccgttccgttcccgttccccgtaccccttcccgtaccgtacggtaaccttaccttcgtaaccgg

SEQ ID NO: 218530 - DNA, 610 bp, Homo sapiens
  misc_feature: GYAE6OF02HHGW7.9.53.E09.1.454.CMB.1.raw
  modified_base (415)..(415): a, c, t, g, unknown or other
  misc_feature (415)..(415): n is a, c, g, or t
  modified_base (447)..(447): a, c, t, g, unknown or other
  misc_feature (447)..(447): n is a, c, g, or t
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggcaacatagccttctccgtcccccttcgcagtaaccacaaagtacaggaatattaacctgttccatcgactacgcctttcggcctcgccttagggtcgactccaccctgccccgtattaaacgttggaacacggaacccttggtccttcggcgaggcgggtcttttccaccgtctttatcgttactatgtcagctatcgntacttctgtactacctcagtcatcgctcacancactacctcacgacgtactaacacgaaccgtcctacccctaaccaaccgtaacgaccaagtaacgccgtcgcgtcgaccgtcgtacgcgttacggtgtacgtagttcggtttaccgcccgtttactaccgttcccttaccgtccaagttcgtagaaggtaacg

SEQ ID NO: 218531 - DNA, 547 bp, Homo sapiens
  misc_feature: GYAE6OF02HL7CN.9.53.E09.1.454.CMB.1.raw
  modified_base (273)..(273): a, c, t, g, unknown or other
  misc_feature (273)..(273): n is a, c, g, or t
  modified_base (415)..(415): a, c, t, g, unknown or other
  misc_feature (415)..(415): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagccacccaggacaaacgcccccaaaatcatcatttaangagtcactaagcgcctcaggggtttctattcgcttctctggctcaagtctgacaacgacggcctacctgacaacttctcgtcgggactccgaggtctggacgacggagcgtgtatttagttactgtctgtctactatatganacgtattggtagactaccgtccgtgtacgttcggcggacggacaagggtcgaccgtcgtacggnacgccaggccncgccccgtgtccacgtcctccgttaccctccctcctacgacgtactacgtacctacg

SEQ ID NO: 218532 - DNA, 785 bp, Homo sapiens
  misc_feature: GYAE6OF02JUUPD.9.53.E09.1.454.CMB.1.raw
tcagtgatacgtctcacgaccggtgctcgatttagagagagtgtgttgggtttgggggggtcacgaagaggcagcgctctcgggacgtctccaccatggcctgggctctgctgctcctcaccctcctcactcaggacacagggtcctgggcccagtctgccctgactcagcctgccctcgtgtctgggtctccgtggacagtcgatccactatcctcctgcctacgtggaacccagcagtgagttcggttaggggactttacgtcggtacctttcggtcctccgtggttaccaacgacgtaccaacccgaggaccaaaacgtaccccccaaaactccaactaccgtaatttacgtagtacggttaccaacgttaacggcccggtacccgtaccggttacggggttttcctaacgttccgtaccttcgttccgtacggtcctacctaacgtccgtagtaacctaaccgacccggtacccttaccccgtagtaaccctaaacgttcccgttacggtaccgggtccttacccgggtaacggtccccgtagggtaacgggtaaccccggtagggtaccgttacggttaaacgttttacgtttaacgtccgtaacgttcgtaccgttactaacgtagtcgaccgtagtacgttgtaccgtactacccggttccgggttacgttacgtttccggggaccgggtaacgggtaaccggtacgggtcgtaacccggttccgtaacgggttccgaaccggtacccgtaacggttcccgtccccggtaacccccgg

SEQ ID NO: 218533 - DNA, 597 bp, Homo sapiens
  misc_feature: GYAE6OF02GGQSQ.9.53.E09.1.454.CMB.1.raw
  modified_base (216)..(216): a, c, t, g, unknown or other
  misc_feature (216)..(216): n is a, c, g, or t
  modified_base (503)..(503): a, c, t, g, unknown or other
  misc_feature (503)..(503): n is a, c, g, or t
  modified_base (513)..(513): a, c, t, g, unknown or other
  misc_feature (513)..(513): n is a, c, g, or t
tcagtgatacgtctcacgaccggtgctcgatttagagagagtgtgttgggtttgggggggaaatactttctgagactcatggacctcctgcacaagaacatgaaacacctgtggttcttcctcctgctggtggcagctcccagatgggtcgtgtcccaggtgcagctgcaggagtcgggcccaggactggtgaagccttcggagaccctgtccctntcctgcactgtctctggtgctccatcagtacttacactggacctggactccggcacggcccgaccggggaaggactgggaggtgggttgggacgttattttaggcgtaggtggggacaccgtaactacacgccccctcctacaacggagtcgagtccaacctatcgtacagtacgacacgtaccaagaaccagactcctccgtagaacgtctcgaaccctgtcgtacgacccgccggacggacgaccggtccgttagtacttacgtgtagcgagtacgtaccaaatntacactaacngtctagttactacgtttcctttagatacggtgggtacgggacctaaggactaagtcggtactaccggtctcgttcacgtacccc

SEQ ID NO: 218534 - DNA, 305 bp, Homo sapiens
  misc_feature: GYAE6OF02FIMC2.9.53.E09.1.454.CMB.1.raw
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (257)..(259): a, c, t, g, unknown or other
  misc_feature (257)..(259): n is a, c, g, or t
  modified_base (263)..(305): a, c, t, g, unknown or other
  misc_feature (263)..(305): n is a, c, g, or t
tcagtgatacgtctcacgaccggtgctcgattttagagagagtgtgttggggtttggggggggtgtggtggtctccactcccgccttgacgaggctgattattactgctgctcatatgcagatggtgaccactcccggtggtacttcgggcggagggaccaagggtgaccgtccaggtcagcccaaggcctgccccctaggtcactctgttccccaccctctcagacgtatcactgagcggcnggcaaggcnatgcnnnatannnnnnnnnnnnnnnnnnnnnnnnnnnnnnnnnnnnnnnnnnn

SEQ ID NO: 218535 - DNA, 254 bp, Homo sapiens; identical to SEQ ID NO: 218482
  misc_feature: GYAE6OF02HQ18J.9.53.E09.1.454.CMB.1.raw
  modified_base (249)..(254): a, c, t, g, unknown or other
  misc_feature (249)..(254): n is a, c, g, or t

SEQ ID NO: 218536 - DNA, 990 bp, Homo sapiens
  misc_feature: GYAE6OF02HQB36.9.53.E09.1.454.CMB.1.raw
  modified_base (207)..(207): a, c, t, g, unknown or other
  misc_feature (207)..(207): n is a, c, g, or t
  modified_base (241)..(241): a, c, t, g, unknown or other
  misc_feature (241)..(241): n is a, c, g, or t
tcagtgatacgtctcacgaccggtgctcgatttagagagagtgtgttggggtttgggggggtcacaagaggcagcgctcgtcgggacgtctccaccatggccgtgggctctgctgctcctcaccctcctcactcgaggacacgagggtcctgggcccaggtctgaccctgactcacgcctgcctcgtgtcgtgggtctccgtggacngtcgatccacctatcctctgacacgtaggaaccnggctaggtgtagttggttagggatttatacgtaccgttgtccgttccgtacggtaaccaacgacgacccgtaacccgacggaccaaaacccggacccccctaaaactacctaacgttacctaagttttacgtacggtaaaccgggtacctaaaccggttaaacccgggcccgggttaccccgtttaaccgggttaaccgggggttttaccctttaaccggtttccggttacccttttaccgttccgtaccgggttaccctaccggttaaaccggttcctaaccgggtaaccctaaacccgggtaccccggtaccccgttcccgtaacgtaaacccgttaaccgttccgttacccgggttacggggtaccccttaccgggtacgggaccggttaacgggaacggggtaaccggtacgggtaccgttaaggttaacttttaaccggtaacgttccggtacgttacgtacccgtttaacgtaagtttaaccggtaaccggtagtaaaccggggtaacgggtttaaccgggttaaccgtaaccccgggtttaacccggggttttacccggggtttagggtttaccgggggttaacccgggggaacccggggtaaacgggggttaaacccccgtaacggggggtttaaccccgggttaacccgggttaacccggtttaacccgggaaccccgggtaccccgggtaaaccccgggtaacccggtttccccggtaacccccggttaccccccgggg

SEQ ID NO: 218537 - DNA, 730 bp, Homo sapiens
  misc_feature: GYAE6OF02GLAPI.9.53.E09.1.454.CMB.1.raw
  modified_base (235)..(235): a, c, t, g, unknown or other
  misc_feature (235)..(235): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacngcacccgaggcaaacgcccccaaatcatcattatgaggtcactagcgcctcaggggtttctattcgcttctctggctcaagtctgacaacncgcctccgnacatctctacggctcgacggtctaggacggacggtagccgtagtactttaattacgttacggtctacggtctacgtaattaacgtacgtaccgtagagtttcgggtacgtaccgtacccgttacccgggttagggtttaccggtttacccgggggaccgggaaaccgggggttaaccgtaaacgggggtttaccggtaaccccgggtttaccggttaacgggtacccgtaacccgggtaaccccgtaacggggtaccccggtttcccggtacccccccggttacgggttaaccccgttacccggttcccgttttacccccggttcccccgtaccccccgtttacccggttaacccgaaccggttaacccggtttaccctacccggttaacccggg

SEQ ID NO: 218538 - DNA, 512 bp, Homo sapiens
  misc_feature: GYAE6OF02FVM42.9.53.E09.1.454.CMB.1.raw
  modified_base (373)..(373): a, c, t, g, unknown or other
  misc_feature (373)..(373): n is a, c, g, or t
  modified_base (421)..(421): a, c, t, g, unknown or other
  misc_feature (421)..(421): n is a, c, g, or t
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctcccngacatctctgggctcaggctgaggacgagctgattattactgctgctnatatgcagatggtcactactcccgtggtacgttcggcgggagggaccgaagggtcgaccgtccgtaggcacggaccaaggcctggcccccg

SEQ ID NO: 218539 - DNA, 259 bp, Homo sapiens
  misc_feature: GYAE6OF02JGL43.9.53.E09.1.454.CMB.1.raw
  modified_base (238)..(238): a, c, t, g, unknown or other
  misc_feature (238)..(238): n is a, c, g, or t
  modified_base (244)..(259): a, c, t, g, unknown or other
  misc_feature (244)..(259): n is a, c, g, or t
tcagtgatacgtctcacgaccggtgctcgatttagagagagtgtgttgggtttgggggtgtggtggtctccactcccgcttgacgaggctgattattactgctgctcatatgcagatggtgacactcccgtggtattcggcggagggaccaaggtgaccgtcctaggtcagcccaaggctcgcccctggtcactctgttcccacctctcagacgtatcactgagcggctggacaggcncatagnnnnnnnnnnnnnnnn

SEQ ID NO: 218540 - DNA, 547 bp, Homo sapiens
  misc_feature: GYAE6OF02F1C89.9.53.E09.1.454.CMB.1.raw
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggcaaacgccccaaactcatcattangagtcactaagcgcctcgtagggtttctattcgtcttctctggctcaagtctgacaacncgcctccngacatctcnggctcgagctgaggacgaggctgattattactgctgctcatatgacaggtagttggcgtactaccgttcccgttaggtacgttcgggacggtaacgggacccgtaagggtacgacccggttaccgttacgggtccaacggcccgaagggtccctccggtaccccccgg

SEQ ID NO: 218541 - DNA, 255 bp, Homo sapiens
  misc_feature: GYAE6OF02F9NWV.9.53.E09.1.454.CMB.1.raw
  modified_base (249)..(255): a, c, t, g, unknown or other
  misc_feature (249)..(255): n is a, c, g, or t
tcagtgatacgtctcacgaccggtgctcgatttagagagagtgtgttgggtttggggggtgtggtggtctccactcccgccttgacgaggctgattattactgctgctcatatgcagatggtgacactcccgtggtattcggcggagggaccaaggtgaccgtcctaggtcagcccaaggctgccccctggtcactctgttcccaccctcctcagacgtatcactgagcgggctggcaaggcgcatagnnnnnnn

SEQ ID NO: 218542 - DNA, 763 bp, Homo sapiens
  misc_feature: GYAE6OF02IXLUO.9.53.E09.1.454.CMB.1.raw
  modified_base (134)..(134): a, c, t, g, unknown or other
  misc_feature (134)..(134): n is a, c, g, or t
  modified_base (189)..(189): a, c, t, g, unknown or other
  misc_feature (189)..(189): n is a, c, g, or t
  modified_base (240)..(240): a, c, t, g, unknown or other
  misc_feature (240)..(240): n is a, c, g, or t
  modified_base (444)..(444): a, c, t, g, unknown or other
  misc_feature (444)..(444): n is a, c, g, or t
tcagtgatacgtctcacgaccggtgctcgatttagagagagtgtgttgggtttgggggcgtttggcctgggctctgctgctcctcaccctcctcactcaggacacagggtcctgggcccagtctgccctgactnagcctgcctccgtgtctgggtctccgtggactaggtcatcacatctccagctacnggaaccagcagtgatggttggagtttcagactttgatccgtaggaccaacncgacaacccagggcctaaaacgacccccaaatccatactatttagagtacggtaacagtaaacgcggtccccgtagtaacgggggtttcttaatcgtccttctcaggtcttaccaaggttactacggaacgaactaacgggcctacccgagtaacaactcggttcaggggtcctcgtacggactcggaacggacggtaccggtntaacgtactttaacgtacgtacgtacgtacgtactacgtaacgttacgtacgtaacggtacgttaacggtacgggtaccgaaccgttacccggtaccggttaacgggttacgggttacgggtaaccggggaaccgggttaaacgggtaacggggtaaccggttaacccggttaaccggttaacggtaaccggtacggtaaccgtaaccggtccgtacccggtacccggtaccggttacccgtaccggttacccgttacccggttcccggttacccgttacccggaaccgttaccggtaaccggttacctaacggtacgg

SEQ ID NO: 218543 - DNA, 606 bp, Homo sapiens
  misc_feature: GYAE6OF02JFQCU.9.53.E09.1.454.CMB.1.raw
tcagtgatacgtctcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatacgccttctccgtcccccttcgcagtaacaccaagtacaggaatattaacctgtttcccatcgactacgcctttcggcctcgccttagggtcactccacctgcccgattacgtgacaggacccttggtcttccggcgagcgggtcttttcacccgtctttatcgttacttatgtcagctattcgctacttctgactacctccagtcactcgccctcacagccactaccttcacacggtcttaacgacgaaccgtccctacccctaacccaaccaaccgcaacgtaacgccgtcgctcgccgcacgcgttacggtcgacctagtttcggtttaccgtccccgtttctacgttcccgttcccgctacgttccgtagacgtacgtac

SEQ ID NO: 218544 - DNA, 793 bp, Homo sapiens
  misc_feature: GYAE6OF02HQVTF.9.53.E09.1.454.CMB.1.raw
  modified_base (245)..(245): a, c, t, g, unknown or other
  misc_feature (245)..(245): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggatttatcgtacctttgtcctccgtcggtaaccaaacncgaccacccgagggaccaaaacgcccccctaaaactcctaatctaatttatggtacggtacaactaacggccggtcccttcggtaggggttttcctagttccgtctttcctcgtcggtcctaccgtaagtctagaaccaacaccggtccctccgtagaacctaattcctacgtcgggtcctacgacgggtctacgggaagggtaaccgggacggtcgttacggttaacttttagtttaccgttcgtcgtcgtccttactaacgttagttcgacgtaaggtaacggttcggtacgaacccttccgggttcccgttagggtttaccgttccgggggaccgggtaacggggtaaccgtaacgggtaccggttaaccgttaccgggtacggtaccggaacccggaccgtacgggtccccgtttacccggcccccgggtttaccggtacccttacccgttacccggttttaccccccgtttaccccccgttaccccgtttaacccggtacccggttaaccggttaaccccggtttacgtaccgttaacccggg

SEQ ID NO: 218545 - DNA, 251 bp, Homo sapiens
  misc_feature: GYAE6OF02GQ8R7.9.53.E09.1.454.CMB.1.raw
  modified_base (250)..(251): a, c, t, g, unknown or other
  misc_feature (250)..(251): n is a, c, g, or t
tcagtgatacgtctcacgaccggtgctcgatttagagagagtgtgttgggtttggggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccgccctcctcagacgtatcactgagcgggctggcaaggcgcatagnn

SEQ ID NO: 218546 - DNA, 727 bp, Homo sapiens
  misc_feature: GYAE6OF02GLFYN.9.53.E09.1.454.CMB.1.raw
  modified_base (230)..(230): a, c, t, g, unknown or other
  misc_feature (230)..(230): n is a, c, g, or t
tcagtgatacgtctcacgaccggtgctcgatttagagagagtgtgttgggtttgggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcacgtggaaccngcagtgattggtgggattatgaccttgtctcctggtaccaacagccaccgaggcaaaccgacccccaaactcactctaatttatagaggtctactaacggccggtccctcgtacggggtttctacttccgctttccgtctggcctccgtaagtctagaacctaaccgccgggtccctcccgtacgaactaacgtccgttacggtcgggtcctaccgacgggtcgttacgggaacgggtaccgggtaacgggtcgttagggttaaactttaacgttttaccgttacgggtccttgtccctttacgtacttaacgttcgacgtaagtaggtttacgggtaacgtacccgtaaccgtttcccgggttacgggtttacgggttacgggggaccggggtaagggtaaaccccgggtaagggttacccgggtaacccggttacggttaaccgggttccggaaccggtaccccgaacgggtcccgttcccggtacccccccggg

SEQ ID NO: 218547 - DNA, 567 bp, Homo sapiens
  misc_feature: GYAE6OF02GBXLT.9.53.E09.1.454.CMB.1.raw
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (298)..(298): a, c, t, g, unknown or other
  misc_feature (298)..(298): n is a, c, g, or t
  modified_base (444)..(444): a, c, t, g, unknown or other
  misc_feature (444)..(444): n is a, c, g, or t
tcagtgatacgtctcacgaccggtgctcgatttagagagagtgtgttgggtttggggggggtcacaagaggcagcgctctcgggacgtctccaccatggccctgggctctgctgctcctcaccctcctcactcaggacacgagggtcctgggcccagtctgccctgactcagcctgcctccgtgtctgggtctcctggacagtcgatccaccatctcctgacactggaaccagcagtgatggtggattngactgtctctgtaccanagcaccagcaaacgccccaaatcatcatttangagtcactaacgcggccctgtacggggtttctattcgctttctctggctcgaagtctgacaacaccggcctcctgacatctcgtcggctccgagctagacggacgaggctagtactttagttactgtactgtctctattacgtganagtagtgtacgaacctccgttccggtaggttcgttccgggacgggtacgggaacctaaggggtccgtacccgttaccggtaacggtcgaccggacccgtaacgggtcctcccggtacccccgg

SEQ ID NO: 218548 - DNA, 596 bp, Homo sapiens
  misc_feature: GYAE6OF02JD29R.9.53.E09.1.454.CMB.1.raw
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (588)..(588): a, c, t, g, unknown or other
  misc_feature (588)..(588): n is a, c, g, or t
tcagtgatacgtctcacgaccggtgctcgatttagagagagtgtgttgggtttgggggcgttttggcctgggctctgctgctcctcaccctcctcactcaggacacagggtcctgggcccagtctgccctgactcagcctgcctccgtgtctgggtctccgtggacagtcgatcaccatctcctgcactggaaccagcagtgatgttgggattangaccttgtctctggtaccangcaccngacaacgccccaatcatcagttangagtcatagcgcctcgtagggttcagttccgnttctcgtcggtcctacaagtctacgaccaacgaccggcctcccgtagactactctcgtcggctccgagcnggtacgacggnggctagtactttactactcgactgtctactatgtagcaagtgttcggtacgacctacgttcccggtaggtccgttcgggacggtacggaccgtaggtcggaaccgttcgtacggtccgacgtacccgaacggtccgtaccggtcccccgtacgggtcctaaccgttcctacccggtttcccctacccgttcctacgaacggtccgttacnccgtaacg

SEQ ID NO: 218549 - DNA, 709 bp, Homo sapiens
  misc_feature: GYAE6OF02JFCWC.9.53.E09.1.454.CMB.1.raw
  modified_base (275)..(275): a, c, t, g, unknown or other
  misc_feature (275)..(275): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctccgtgcactggaaccagcagtgatggttgggattatgacctttgtctccgtggtaccaacagccacccaggacaaacgcccccaaatcactcatttangacggtcaactaagccggccctcgtacggggtttcttattcgtcttctctggctcaagtctacgacaacaccggcctcctagaacaacttcgtcgtcgggctccgacggctagaggacggacggctagtaactttacttacgtcgtactcgtaccttctacttagtcgacgtaaggtagtacgggttacgaacccgttacccgttcccgggttaggttaccgggtttccggggacggggtaaccggggaccggtaacggggttacccggtacccggttaccgtaacgggttacccggaaccggtaccggtaaccgggtcccttacccgggtacccccgttcccgggttactacccggttcccgtttacccgttaccccccgttaccccgttacccgttacccgtaaccggtacccgttacttcccgtaaccggg

SEQ ID NO: 218550 - DNA, 687 bp, Homo sapiens
  misc_feature: GYAE6OF02HOQWN.9.53.E09.1.454.CMB.1.raw
  modified_base (668)..(669): a, c, t, g, unknown or other
  misc_feature (668)..(669): n is a, c, g, or t
  modified_base (674)..(687): a, c, t, g, unknown or other
  misc_feature (674)..(687): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctctgcacgtggaaccagcagtgagttggttggctattataaccttgtctcctggtatcaacacgccagacaaacgccccactactactttaattagtgtacggtacaacgtaacggcccggtacccgttacgtacggggttttccttacgggtccgttctttccgtccgttcgtaccccttaccgtaaacggttccgtacggaaccgtaaaccgtaacccggtccccttacccgttacggaacgtttacccgaacgggtaccccgtaaacgggtcccttaaccccgggtcccccccgttacgggtttacccgtaaccgtttcccgttcccggtttcccccgtcccctttacccgtacgttacccgtaaacgttaccgttaccgtaaaccggtcgggaacgggtcccggggtaccgtacggggaccgtaaacgggcccgtactaacgtaggctcganncgcgnnnnnnnnnnnnnn

SEQ ID NO: 218551 - DNA, 727 bp, Homo sapiens
  misc_feature: GYAE6OF02HIFO7.9.53.E09.1.454.CMB.1.raw
  modified_base (280)..(280): a, c, t, g, unknown or other
  misc_feature (280)..(280): n is a, c, g, or t
  modified_base (318)..(318): a, c, t, g, unknown or other
  misc_feature (318)..(318): n is a, c, g, or t
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctcgccctgactcagcctgcctccgtgtctgggtctctggacagtcatcaccatcctcctgacacgtggaaccagcagtgaattggttgggaattatggtaccttgtctctcggtaaccaacncgcacccaggacaaacgaccccaaatcactctattagngaggtcaacgtaagccggtacctcgttacggggtttacttacgttcctcttccttcgtacgtcctacgtaacgtcgtacgaacctaaaccgccggtccctaccccgtaggaacctaaacgttccgtacgttcgggtcccgtacccgaacgggtccggttaaggacgggtaaccggtagtacgttaggttaactttaacttacgtcgtacgtacgtacgttactaagttactacggtctaaggtaagtccgggttaacaccgttccgttacccggttggttaaccgggttacgggacccgggggtaagggaaacccggttaagggtacccggttaacccgggttaccgtaacggggttacccgaaccggtaaccccgggaacgggttccccctacccggttaccccccgg

SEQ ID NO: 218552 - DNA, 828 bp, Homo sapiens
  misc_feature: GYAE6OF02F3B7E.9.53.E09.1.454.CMB.1.raw
tcagtgatacgtctcacgaccggtgctcgatttagagagagtgtggttggggtttgggggctttgcctgggctctgctgctcctcaccctcctcactcaggacacagggtcctgggcccagtctgccctgactcagcctcgcctccgtgtctgggtctcctggacagtcgatcaccatctcctgcaactggaaccagcagtgatggttgggagttatgacctttgtcctccgtaggtacccaacgacgccaaccccgaggacccaaaaccgaccccccctaaaactccaattaccgtaacttttaagtcggtacggttacaaccgttaacggcccggtaccccttcgggtaacgggggttttaccttacgtttccgtcctttacctccggtcggtacctacccaaagttccgtacgaacctaaccgaccggtccccttacccgtagtaactaacttccgttaccggtcgggtaccctcggacggtacgtagggaacggacgtacggtacttaggtacttttaacgttacgtcgacgttacgtccttactagtacgtacgtaacgtagttaacggttggtaaccgtaacccgttaccgttcccgggttacgggtttacgttacccgggggacgggttaaacccgggtaccggtaaacggggttccgtaaccccggttacccggttacgggaacccgaccgtaacccccggaaggttaccccgtcccggttacccccgtacgggttacccttaaccgtttccccgttaacccgttcccccgtaccccgttacgtaacccgtacggttaaccgttcccgttagtaacccgg

SEQ ID NO: 218553 - DNA, 267 bp, Homo sapiens
  misc_feature: GYAE6OF02H8L2H.9.53.E09.1.454.CMB.1.raw
  modified_base (253)..(267): a, c, t, g, unknown or other
  misc_feature (253)..(267): n is a, c, g, or t
tcagtgatacgtctcacgaccggtgctcgatttagagagagtgtgttgggtttggggggtgtggtggtctccactcccgccttgacgaggctgattattactgctgctcatatgcagatggtgacactcccgtggtattcggcggaggaccaaggtgaccgtctaggtcagcccaaggctgccccctggtcactctgttcccaccctcctcagacgtatcactgagccgggactggacaagggtcgcaatagnnnnnnnnnnnnnnn

SEQ ID NO: 218554 - DNA, 681 bp, Homo sapiens
  misc_feature: GYAE6OF02GM57E.9.53.E09.1.454.CMB.1.raw
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
  modified_base (353)..(353): a, c, t, g, unknown or other
  misc_feature (353)..(353): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacngcacccaggaccaaacgcccccaaatcatcatttangagtcactaagccggccctcgaggggttttctagttcgcctttctctggctaccaagtctagacaacgaccggtcctcccgtnacaatctcgtggctccgaggctagacggacgaggcctagatttacttactcgtcgtacgtcttactatacgtgacgtacggagttggtcgtaaccgtaccgttcccggttaggttacggttaccggggcgggaacgggacccgtaaacgggtcggtaaccccgggttacgtaacggtaccgaaccgggaccccgtaaagggtccccgtacccggtaccccccgttacggggacccgttacccttcccggtttacccgtttacccccccgtaccccgtttaccccggttacgttaacccggtaaccgtttaccgaacccgttaacccgg

SEQ ID NO: 218555 - DNA, 593 bp, Homo sapiens
  misc_feature: GYAE6OF02GO5QC.9.53.E09.1.454.CMB.1.raw
  modified_base (269)..(269): a, c, t, g, unknown or other
  misc_feature (269)..(269): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaacgcccccaaactcatcatttangaggtcactaagcggccctcgaggggtttctattcgcttctctggctcaagtctgacaacacggcctcctgacaatctctgggctcaggctgaggacgaggctgattattactgctgctnatangcagagtggtagactaccgtccgttggttacgttccggggacggaacggggaaccgaagggtacgacccgttaccgtaacggtccaacgacccgaacggccgttaccggccccccgttcgggtacccttaaccgttcccgtttaccgttttccccaaccccgttcccgttaccgaacggtaaccggttactccgtaaccg

SEQ ID NO: 218556 - DNA, 714 bp, Homo sapiens
  misc_feature: GYAE6OF02GC91X.9.53.E09.1.454.CMB.1.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacaggtcgactcacctatcctccgtgacctacgtggaaacccagaccaaggttgattgggttgggggtatttaactcgtaccgtttgttaccgttccgtcggtaaccaacgaccgtcccaacccgaggtacctaaaccgaccccctaaactcaactctaactttagtcggtacggtaccacgtaacgccggtccctacggttacgggtttactacgttccgtaccttcgtacgtcggtcctactaacggttctacgtaccaaccgtaccggtccctaccgtacgaacctactaccgttacggtcgtaccgttacgtacgggtacctgggaaccgggtaacggtacggtagttacggttaactttacgttacgtccgtacgtactcctagtcctaagttcgtacgagtcgttacgtcaacctccggttccgtaggtccgttacgggacgggtaacggtaccggacggtccgtacgtaccgtacggccgtaccgaccggtactccgtcccgtaccccg

SEQ ID NO: 218557 - DNA, 420 bp, Homo sapiens
  misc_feature: GYAE6OF02F29FB.9.53.E09.1.454.CMB.1.raw
  modified_base (407)..(407): a, c, t, g, unknown or other
  misc_feature (407)..(407): n is a, c, g, or t
  modified_base (413)..(420): a, c, t, g, unknown or other
  misc_feature (413)..(420): n is a, c, g, or t
tcagtgatacgtctcacgaccggtgctcgatttagagagagtgtgttgggttgggcgtatttttagcagtgggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattcctttgatatgtggggccaagggacaatggtcaccgtctcttcagcctccacaacgggcccatcggtccttccccctggccgccctgcctccaggacgcacctccgagagcacagccggcctgggctgcctggtcaaggactacttcagacgtatcactgagcggggctggcaggcncatagnnnnnnnn

SEQ ID NO: 218558 - DNA, 624 bp, Homo sapiens
  misc_feature: GYAE6OF02GTV1P.9.53.E09.1.454.CMB.1.raw
tcagtgatacgtctcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtacaccaagtacaggaatattaacctgtttccatcgactacgcctttcgcctcgccttaggggtcgactcaccctgccccgattacgtggacacggacccttggtcttccggcgagcgggcttttcacccgtctttatcgttacttatgtcagctattcgactacttctgactaccctccagtccatcgacctcacacgccacacccttcacgacggtcttacgagaaccgcctaccccctaacccaacaaccgcaataacgccgtccgctcgacccgctacgtccgttacggtcgactacgttcgggtttaccgtccccgtttacgacctttacccgttccccgacctacttaccgtaacggtaacgtaccgttaacg

SEQ ID NO: 218559 - DNA, 869 bp, Homo sapiens
  misc_feature: GYAE6OF02IMAHT.9.53.E09.1.454.CMB.1.raw
  modified_base (236)..(236): a, c, t, g, unknown or other
  misc_feature (236)..(236): n is a, c, g, or t
  modified_base (272)..(272): a, c, t, g, unknown or other
  misc_feature (272)..(272): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgtaccttgtctccgtaggtaccaanagccaccaggcaaaacgccccaaatcatctatttangtagtcaactaacgccgccctcgtagggtttctattcgtcttctacgtcgtcctacctaagttctagaaccaaaccgaccggtcccttaccgtagtaaacctaactcgtacgtacgggtcctaccgaacgggcgtaacggaacgggaaccggtaacggtaccgtaagttacgtttttaaacgtttaccggtgtaccgttaccggtacttaaccttaaagttacgttacggaacgtaacgggtaacgttacggggtacccgtaaaccgttaaccccggttttcccgggttaaggggtttaacggttttacccggggggaaccggggtaaaacgggggtaaacccccggttaaaaggggggtttacccgtaaaccccggggttttacccggttaaaccggggtaaccgtaaaccccgggtaaccccgggtaaacgggtaccccggtttaaccccggtaacccccccggttttaacggggttaacccccgttaaaccccgtttaccccggtttttaccccgttaaccccccgtaacccccgtttacccgttaacccggtaaacccggttaacccgtttaccgtacccgttaaacccgggg

SEQ ID NO: 218560 - DNA, 402 bp, Homo sapiens
  misc_feature: GYAE6OF02FWJA9.9.53.E09.1.454.CMB.1.raw
  modified_base (322)..(322): a, c, t, g, unknown or other
  misc_feature (322)..(322): n is a, c, g, or t
  modified_base (373)..(373): a, c, t, g, unknown or other
  misc_feature (373)..(373): n is a, c, g, or t
  modified_base (391)..(402): a, c, t, g, unknown or other
  misc_feature (391)..(402): n is a, c, g, or t
tcagtgatacgtctcacgaccggtgctcgatttagagagagtgtgttgggtttggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtgggccaagggacaatggtcaccgtctcttcagcctccacaagggcccatcggtcttccccctggccgccctgctccaggagccacctcgagagcacngccgcctgggctgcctggtcaaggctacttcagacgtatcactgagcgggntgggcaaggcacatagcnnnnnnnnnnnn

SEQ ID NO: 218561 - DNA, 744 bp, Homo sapiens
  misc_feature: GYAE6OF02FZ0JG.9.53.E09.1.454.CMB.1.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacgagggtcctgggcccagtctgccctgactcagcctgcctcgtgtctgggtctctggacagtcgatcaccatctcctagcacgtggaaccagcagtgagtggttaggggatttatcgtacctttcggtccttccgttacgggtaaccccaaacgacgtacccaaaccccggaaggaaccaaaaacccggaccccccctaaaagtacctaacttaacctaacgttttaaatacggtaacgtaccgtaaacgtaaacggcccggggtaccccttacggtacgggggttttaccttacgttaccggtctttaccgtcgttcggacccttaacctaagttccgttaacgtaaccgaaaccgacccggtaccccttacccgtaccggaaacctaaaccgttcttccggacggtacctaccgacggcttagggaacggtacggaacgcgttaaggttaattacgttactcgtcttagtcctacgtaatacgtgtacaagttgtacggtacgtacctaccgttccgtagggttacgttacggagggtaaccggacgtaaagggtccgaccgttacgtacgtacgaaccgccggacgtaccgtcccgtacccg

SEQ ID NO: 218562 - DNA, 526 bp, Homo sapiens
  misc_feature: GYAE6OF02FGMAD.9.53.E09.1.454.CMB.1.raw
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (433)..(433): a, c, t, g, unknown or other
  misc_feature (433)..(433): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtcctcctggtaccaacagcacccaggaccaaacgcccccaaactcatctatttatgaggtcactaagcggccctcagggggttttctattcgtcttctctcggctccaagtctagacaacacggcctccctgacaatctctgggctccgaggctgaggacgaggctgatttatactgctgctnatatgcagatgnacnctccgtggtactcggnggacggccgaaggtcgacgttccgaggtcacgacccgaggtctacgccccgtgtccacttctcgtcccacctcctacgacgtcgttatctacg

SEQ ID NO: 218563 - DNA, 690 bp, Homo sapiens
  misc_feature: GYAE6OF02F4P5O.9.53.E09.1.454.CMB.1.raw
  modified_base (216)..(216): a, c, t, g, unknown or other
  misc_feature (216)..(216): n is a, c, g, or t
  modified_base (244)..(244): a, c, t, g, unknown or other
  misc_feature (244)..(244): n is a, c, g, or t
  modified_base (322)..(322): a, c, t, g, unknown or other
  misc_feature (322)..(322): n is a, c, g, or t
  modified_base (390)..(390): a, c, t, g, unknown or other
  misc_feature (390)..(390): n is a, c, g, or t
tcagtgatacgtctcacgaccggtgctcgatttagagagagtgtgttgggtttggggggggtcgacgaagaggcagcgctctcgggacgtctccaccatggcctggctctgctgctcctcaccctcctcactcaggacacagggtcctgggcccaggtctgccctgacctcagcctgcctccgtgtcgttgggtctccgtggacagtcgatcacgntctcctgacacgtggaaccagctaggtnagttggtagggacttagtgtacttgtctcctggtaccacacgcaccaggtacaacgaccccaaactcatctatttagngtagtcacgtaacgccgtcctaggtacggtttactacgttcgtcttctctacggtctactaaggtctntacgaacgaccgtccctccgtacaactaacttcctacgtccggtcgtccgtacggtccgtacgtaacggacggaacgtcgttacgttaacgtttacgttacgttcgactttcgaccgttacgtaattattccggacgttaacgtaggttacgggtactacccgtagttaccccggttagggtttaccgttccgggtaccggggtaacgggaaccggttaaacggggtccggtaaaccggttccggttacggttacccggaaccgttacccggtacgggtaccgtcccggttaccccccgg

SEQ ID NO: 218564 - DNA, 686 bp, Homo sapiens
  misc_feature: GYAE6OF02HALVM.9.53.E09.1.454.CMB.1.raw
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
tcagtgatacgtctcacgaccggtgctcgatttagagagagtgtgttgggtttggggggtcacaagaggcagcgctctcgggacgtctccacatggcctgggctctgctgctcctcaccctcctcactcaggacacagggtcctgggcccagtctcgccctgactcagcctgcctcgtgtcgtgggtctcctggacagtcgatcaccatcctcctgcacgtgaaccagcagtnagtggttgggattntgtaccttgtctcgtggtaccacaccaccagcaaacnccccaaatcatgtattanacgaatcaactaaggccgcctagggtactttcgngtctcgtcttactcgtagcctacctaagtcccgtacaacgccggtaccctcctagtaacacttaccgtcgtcgggtacctaccgtaacgcgttagacgggtacgtacgtacctacttaagtttacgtttaccgtttggtccgtacttaccacgttaattaccggtaacggtttaagttaacggtttacgggtttagggttccggtttacggggtaccgggaacggaacccggttaaggtcccgttaaggtaccccggttaccgggttacggttaccgaaccggtcccggttaaaggcccgtttcccgaccccggtttccggtaccggttacccgttaccgtttaccccgg

SEQ ID NO: 218565 - DNA, 823 bp, Homo sapiens
  misc_feature: GYAE6OF02GDB8C.9.53.E09.1.454.CMB.1.raw
  modified_base (271)..(271): a, c, t, g, unknown or other
  misc_feature (271)..(271): n is a, c, g, or t
  modified_base (365)..(365): a, c, t, g, unknown or other
  misc_feature (365)..(365): n is a, c, g, or t
  modified_base (556)..(556): a, c, t, g, unknown or other
  misc_feature (556)..(556): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacgagggtcctgggcccagtctgcccttgactcagtcctgcctccgtgtccgtgggtcctctaggactagtcgactccacctattcctcctagcctacgtacggaaaccagcaagtgattgggttagggacttntcgtaccttcgtccttaccgttacggaaccaacacggacccaacccggtaaggacccaaaaccgcccccaaacgtctaataccgtaattttagnggtaagtacctaacgtaacgcccggtccgtacggtagggtttcctacgtttccgtctttctacgtcgtaccgtacgtaactcgtaaccgaaccgtaaccgtccccggtcccttaccgaacggtaacctacgttccgttaccggtgggtacccctacggtacgggtaccgtacggggaacgggtaaccgggnggtaacccggttattaaacgttttaccgttaaccggtgttacccgttcggttacccttaagtaccgttagtacccgtagggaagtttcggttaaacgggtcccgaaaccgttcccgggtttaaccgggtaggttttaccggggttcccggaacgggggtaacccggggttaaaccggtaaacggttccgggtaaccccgtttacggaaccggggttccgtaacccggtaccgggtaaccggttaccccgttccccgggtacccccgg

SEQ ID NO: 218566 - DNA, 878 bp, Homo sapiens
  misc_feature: GYAE6OF02JE818.9.53.E09.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctctcactcaggacacagggtcctgggcccagtctgccctgactcagcctgcctcgtgtctgggtctcctggacagtcgatcaccatcctctgcacgtcggaaccngcagtgactggttgggattntacgtccttgtcctccgttaggtaacccaacgacgtccaaacccgtagggaaccaaaacccggtaccccctaaaaactccgtaacttaccgttaaagttttaacgtaggtaaccggtaacgtaaaccgtaaaccgggcccggttaccccttacggggttaaaccgggggttttttcctaaccggtttcccgtttccggttttaaccccgttccgttaccgggggtaccccttttaaaccgtaccgggtttaccgttaaacggaaacccgtaaaccccgtccccggggtaccccttttaacccccgtagggtaaaacccttaaccgtttccgttaacccggttccggggtacccttaacccggggtacgggtaccggttaacggggaaaccgggtaaacggtcgggttaacgttaacgggtaactttttaaaccgttacggtttccgtacgtttccggtaaccgttacttaacggttaccacggtacccggtaagttacggtttcggtaacgtacccgttaaaccggttccggttacggttacgtaccggggacggtaacggtaaaccggttggacccgtaccgttacgtacggtacctccggaaccgttaccggccgtacccgtccccgg

SEQ ID NO: 218567 - DNA, 559 bp, Homo sapiens
  misc_feature: GYAE6OF02I4PGL.9.53.E09.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (294)..(295): a, c, t, g, unknown or other
  misc_feature (294)..(295): n is a, c, g, or t
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
tcagtgatacgtctcacgaccggtgctcgatttagagagagtgtgttgggtttgggggggtcacaagaggcagcgctctcgggacgtctccaccatggcctgggctctgctgctcctcaccctcctcacctgaggacacgagggtcctgggcccagtctcgccctgactcagcctgccgtccgtgtgtggtctccgtggacagtcgatccacgtntcctccagcaacgngaacctgnagtgngtgtagggtattcgctacgtgtnctgacacgnctacgngtacacgccctaanntctaggtcngcgtacactcggctactgtagttcattcgctntcggaanccgtacagtnacganaccgnggccatacgatcgttcngtacgctcgcggtcacgtacgagactntagttacgtcgtcgtacgtcgtacgtcgtactactacgtcgtacgttacgttacgttccttacgtacgtacgttacgtacgtcgtacggtacggtcgtacgtacgtaccgtacgtcgtacgtacgtaccgtaccgtacgtccgtaccgtacg

SEQ ID NO: 218568 - DNA, 255 bp, Homo sapiens
  misc_feature: GYAE6OF02ID1K9.9.53.E09.1.454.CMB.1.raw
  modified_base (245)..(245): a, c, t, g, unknown or other
  misc_feature (245)..(245): n is a, c, g, or t
  modified_base (251)..(255): a, c, t, g, unknown or other
  misc_feature (251)..(255): n is a, c, g, or t
tcagtgatacgtctcacgaccggtgctcgatttagagagagtgtgttgggtttgggggtgtggtggtctccactcccgccttgacgaggctgattattactgctgctcatatgcagatggtgacactcccgtggtattcggcggagggaccaaggtgaccgtcctaggtcagcccaaggctcgccccctggtcactctcgttcccaccctcctcaagcgtatcacgtgagcgggctggcaaggcncatagnnnnn

SEQ ID NO: 218569 - DNA, 701 bp, Homo sapiens
  misc_feature: GYAE6OF02GB5W9.9.53.E09.1.454.CMB.1.raw
  modified_base (201)..(201): a, c, t, g, unknown or other
  misc_feature (201)..(201): n is a, c, g, or t
tcagtgatacgtctcacgaccggtgctcgatttagagagagtgtgttgggtttgggggggggtcacaagaggcagcgctctcgggacgtctccaccatggcctgggctctgctgctcctcaccctcctcactcaggacacagggtcctgggcccagtctgccctgactcagcctgtctccgtgtctgggtctccgtggacngtcgatcaccatcctcctgcactacggaaccagccaggtgagtggttagggtagtttactacggtaccgtttcgtccttccggttacggtaaccaacgacgaccccgaccgaaggaacccaaacccgacccccaaaactcaacttactatttagtggacgtacaacgtacgcccggtcctcggtagggtttctcgttctcgttctcgtcgtcctactacgtcgtacaacgaaccgtaccggcccttaccgactaacctacgtccgttacggtcggtacctaccgacggtacgtaggacggaacggtacggtacttagttaacgtttacttacgtacgtcgtcgtactacgttaagttacgttagaccgtaagtcggttagttaccgtaacccgttcgtccgggttaggttaccggtacggggacgggtaaacggaccggtacggtaccggtaccgtacggtacggtacgaccggaccgtacggcccgtacccgtaccccg

SEQ ID NO: 218570 - DNA, 655 bp, Homo sapiens
  misc_feature: GYAE6OF02GTGKU.9.53.E09.1.454.CMB.1.raw
  modified_base (228)..(228): a, c, t, g, unknown or other
  misc_feature (228)..(228): n is a, c, g, or t
  modified_base (508)..(508): a, c, t, g, unknown or other
  misc_feature (508)..(508): n is a, c, g, or t
tcagtgatacgtctcacgaccggtgctcgatttagagagagtgtgttgggtttggggggggtcacaagaggcagcgctctcgggacgtctccaccatggcatgggctctgctgctcctcaccctcctcactcaggacacagggtcctgggcccagtctgccctgactcagcctgcctcgtgtctgggtctccgtggacagtcgatcaccatctcctgcatcggaaccngcaggtgagtggttgggtagttagtcgtacctttgtcctccgtggtaacctaacgagaccgacccgaacggaccaaaaccggacccccaaaacgtccaactactaacgtttatagaacggttcaaactaacggccggtccctacgtagggtttactacgttcgtcttacctcgtcgggccttaccgtaacgtcgtacgaactaccgaccgaccctccgtagactaactctacgtcggtctcccgagcgtaggtaggacgaggctagtatttatcgtagtntcgtctactatacgtgactagtacgtggtaccgtaacgtaccgttccgggtagggttccggtaccgggtacggggtaacggtaccggtaacggtccggtaaccgtacgggttacgtacggaccgtacccgtaaggtcccgtccccgg

SEQ ID NO: 218571 - DNA, 777 bp, Homo sapiens
  misc_feature: GYAE6OF02GD8IU.9.53.E09.1.454.CMB.1.raw
tcagtgatacgtctcacgaccggtgctcgatttagagagagtgtgttgggtttggggggaaatactttctgagactcatggacctcctgcacaagaacatgaaacacctgtggttcttcctcctgctggtggcagctcccagatgggtcgtgtcccaggtgcagctgcaggagtcgggcccaggactggtagaacgccttcggacgaccctgtccctctcctgccactgtctctggtggcctccatcacgttacttactacgtcggacctggactccggcacggccccggacggggaacgggtacgtggggtacggttggggttacggggtaccgttttagtttttacggcgtagggttacggggaacctaacccgtaacgtaccgaccgtccccctacccgtacgaacggtacgtccgaacgtccaacctagtacgtcaacggtacgaaccgtaccgtaccgaacgaaccagacttcccgtaccgtagtaacgtccgtacgtaccttcgtcggtacccgacccggccggaacccgggacccgtaccgggtccgttacgttacgtttacggtacggtacggtacggtaacgtacccgttaaaccctaaagttacgtacgaaccaaccggtacgtccgttaacggttaaccttaccgttttaccggttttagtaacgttacgggttcggggtaaccgggtaccggtaaagggtaccgttaaacgggttcggtacccgttaccccggtttacgttcccgttacccgcccgttaaccccg

SEQ ID NO: 218572 - DNA, 667 bp, Homo sapiens
  misc_feature: GYAE6OF02IYM1H.9.53.E09.1.454.CMB.1.raw
  modified_base (181)..(181): a, c, t, g, unknown or other
  misc_feature (181)..(181): n is a, c, g, or t
  modified_base (388)..(388): a, c, t, g, unknown or other
  misc_feature (388)..(388): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
tcagtgatacgtctcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgcttaaaccgggacaaccgtcgcccggccaacagtagccttctcccgtcccccttgcagtaacaccaagtaccagaatattaacctgttcccatccgactaccgcctttcggcctcgccgttaggggtcactcaccctgccccgattacgtgacacggacccttggtcttccggcgaggcgggtcttttccgacccgtnttacgtcgttacttatcgtcanctattcgctacgtttcngtactacctccaagctactacgccctacaccacgccacctaccgttccaccgtaaggtccttaacgaactaacccgcccttacccccgtaacccaacaaaccgcaacgttaaacgccgttaccgcgtacgcccgactacggtccgttacggcgtacgtacgttcgggtttacccgttccccgtttaccgtaccttcccgttcccgtacctacgttaccctaagtaaccggttactaccgg

SEQ ID NO: 218573 - DNA, 261 bp, Homo sapiens
  misc_feature: GYAE6OF02HDLNT.9.53.E09.1.454.CMB.1.raw
  modified_base (251)..(261): a, c, t, g, unknown or other
  misc_feature (251)..(261): n is a, c, g, or t
tcagtgatacgtctcacgaccggtgctcgatttagagagagtgtgttgggtttggggggtgtggtggtctccactcccgccttgacgaggctgattattactgctgctcatatgcagatggtgacactcccgtggtattcggcggagggaccaaggtgaccgtcctaggtcagcccaaggctgccccctcggtcactctgttcccgccctcctcagacgtatcactgagcggctggcaaggcgacaatagnnnnnnnnnnn

SEQ ID NO: 218574 - DNA, 767 bp, Homo sapiens
  misc_feature: GYAE6OF02JWNZV.9.53.E09.1.454.CMB.1.raw
tcagtgatacgtctcacgaccggtgctcgatttagagagagtgtgttgggtttggagtacgatttgatgttacctgatgcttagaggcttttcctggaagcagggcatttgttgcttcagcaccgtagtgcctcgtcatcacgcctcagccttgtattttccggtatttgcctaggaaaaccagacctactacgcttaaaaccgggacaaccgtcgcccggccaaacatacgccttcctccgtcccccttcgacacgtaaccacctaacgtacaggaatacttaacctcgtttaccatcgactaccgtccttacggccttcgtccgtttaacggggtctaaccttccaccctcgaccccgtacgttaaacgttcggaacctacgggtaaaccgtttcggttacccgtttccgggcgtacggccgggtcctttttaccgaacccgttcttttacgtaccggttttacttaacttcggttactaggtacctaacgttccgtctaactttctacgacttaccgtccagctactcgaccctacgccatccgacctaccttaccgacgtacgtaaccttacgacgtaacctccctaacccctacccaacctaccgaccaacttaacgccgttaccgcctccgtaccgaccaggttcccgttcgggtacttacggtaccggttttacggttttaccgcccccggtttttactccgtttacccgttccccgttaccctttacggtaacccgttaggtaacccccggtttaaacg

SEQ ID NO: 218575 - DNA, 645 bp, Homo sapiens
  misc_feature: GYAE6OF02JJHWP.9.53.E09.1.454.CMB.1.raw
  modified_base (164)..(164): a, c, t, g, unknown or other
  misc_feature (164)..(164): n is a, c, g, or t
  modified_base (213)..(213): a, c, t, g, unknown or other
  misc_feature (213)..(213): n is a, c, g, or t
  modified_base (277)..(277): a, c, t, g, unknown or other
  misc_feature (277)..(277): n is a, c, g, or t
  modified_base (404)..(404): a, c, t, g, unknown or other
  misc_feature (404)..(404): n is a, c, g, or t
tcagtgatacgtctcacgaccggtgctcgatttagagagagtgtgttgggtttgggggcgtttgcctgggctctgctgctcctcaccctcctcactcaggacacagggtcctgggcccagtctgccctgactcagcctgcctccgtgtctgggtctcctggacngtcgatcaccatctcctgcactggaaccagcagtgatgttgggagttangtaccttgtctcctggtaaccaacagccacccgaggccaaaacgaccccaaactcatcatttangagtcactaagcggacctcgtagggtttcattcgcttctctggactccaagtctgactacgacgcctccagacaactctacgtggctcaggtctgaacggacgaggctagtaattacgttacgtcgntagtctacttaatagttacgacaaggtacgttaggtccaacgtacccgtcccggttagggtaaccggtttcgggggtcgggaaccgggaaccgtaacgggtaccgtaacccggtccgttaacgggtaccacggtacccgaacggtaccgttccggcccccggttaccgtaccggtaccttccgttaacccggttcccctaccccttacccgtccgtaaccgttaccgtagtttacccacgg

SEQ ID NO: 218576 - DNA, 645 bp, Homo sapiens
  misc_feature: GYAE6OF02FNO1C.9.53.E09.1.454.CMB.1.raw
  modified_base (452)..(452): a, c, t, g, unknown or other
  misc_feature (452)..(452): n is a, c, g, or t
  modified_base (566)..(566): a, c, t, g, unknown or other
  misc_feature (566)..(566): n is a, c, g, or t
  modified_base (581)..(581): a, c, t, g, unknown or other
  misc_feature (581)..(581): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctccgtgacagtcgatcaccatctcctgcactggaaccagcagtgatggttgggattatcgtaccttgtccttccgtaggtaacccaacacgccaccccgaaggaccaaaaccgaccccccaaatccattactaatttatacggacggactaacgtaaggccggtccccgtacggtagggttttctattccgtctttcgtctggtcctaccagtctgaaccaaccgtaccgcctccgacgactactctcgtcggcctcgaggctggaacggaccgtacggtactagtattacgtttacngtctcgtctacgtaatgtacgacgaggtacgttcggaccaacgttacccgttccgggttagttaccgggttcgggacgggtacgggtacgaacggtccgtaccgtcgtacgtanaccgaccgtagtccncccgtcccgtcgtacctcttcccgtcccttccctacctcctacgtacgtacttacgacgtacgg

SEQ ID NO: 218577 - DNA, 733 bp, Homo sapiens
  misc_feature: GYAE6OF02HPXRC.9.53.E09.1.454.CMB.1.raw
  modified_base (133)..(133): a, c, t, g, unknown or other
  misc_feature (133)..(133): n is a, c, g, or t
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
tcagtgatacgtctcacgaccggtgctcgatttagagagagtgtgttgggtttgggggctttgcctgggctctgctgctcctcaccctcctcactcaggacacgagggtcctgggcccagtctgccctgactnagcctgcctcgtgtctgggtctcctaggactgtcgatcaccatcctcctgcacgtggaacctagcagtgacttggttgggattatcggtaccttggtcctcgtacggtaaccaacncggccaaccgaggaccaaaccgaccccctaaacncattacattttagtggtacgtacacgtaacgccgtcctcgtacggggttctagttccgtcttacgtcgtcgtcctacctaagtcgtagaaccgaaccgtccggtcccttcccgtacgaactaacttctaccggtcggtaccttaccgaggtcgtaggtacggacggcgtgtaaggttacttagttacgtcgtacgtcgtcttacgtattacggtcgtaccgacgtaacccaaccccggtataacgtttcggtcgttaaccgggtacggtaccgggaacccgtaccgtacccgtaccgggttacctaaccgggtccgtaaacccgtacccgaaaccgtaccccgaaaccccgtcggttacccttacccgtaaccgtttcccgtacccggttcccccacccgttaccgtaccgtaccggaaccttaccgtccggtaccgtgggtaacccggg

SEQ ID NO: 218578 - DNA, 685 bp, Homo sapiens
  misc_feature: GYAE6OF02J2MZL.9.53.E09.1.454.CMB.1.raw
  modified_base (340)..(340): a, c, t, g, unknown or other
  misc_feature (340)..(340): n is a, c, g, or t
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatccaccatcctcctgccacgtcggaacccagcaggtgagttgggtttgggatttatcgtacctttgtcctccgttacggtaccaacgacgaccaccccgaggaccaaaccgcccccaaaactcatactagtttangacggttacaacgtacgccggtcccgtacgttacggggttttcctacgttccgtactttccgtcgtacgtccttaccgtaagttcctaggtaaccaaccgtacccggtccctcccgtaacgtaccgtaactccgtcgtaccgggtccctccggtacggtcgtacgggtacggaccgggacgtcgttggttaacctttagtttaccggcttcgtcgtcttactagttacgcgacgtagtagtcgtacgacctaccggttccgttgtaccggtcgggtacggaacggtaccgaaggttccgaccgttacggtacgtcgaacccgtcgacggttccgcccgtaccccg

SEQ ID NO: 218579 - DNA, 740 bp, Homo sapiens
  misc_feature: GYAE6OF02ICY6O.9.53.E09.1.454.CMB.1.raw
  modified_base (185)..(185): a, c, t, g, unknown or other
  misc_feature (185)..(185): n is a, c, g, or t
  modified_base (206)..(206): a, c, t, g, unknown or other
  misc_feature (206)..(206): n is a, c, g, or t
tcagtgatacgtctcacgaccggtgctcgatttagagagagtgtgttgggtttgggggggggtcacaagaggcagcgctctcgggacgtctccaccatggcctgggctctgctgctcctcaccctcctcactcaggacacgagggtcctgggcccagtctcgccctgactcagcctgcctccgtntcgtgggtcctccgtaggacngtcgatccaccatcctctgacacgtacggaaccagcagtgacgttggttgggtattaagtcgtaccgtttgtccgtaccgtacggtaaccaacgacgacccaaccgaaggtaccaaaacccgaccccaaactcgacttacttattagtacgtaacgtacctaacgtacggcccgtccgttacgggttacggttttacttacgttccgttccgtttccttcggtccgtaccttaaccgtacgttacgttaacggaaccaaacccgtccggtaccccttacctaacgtaaccgttaacttccgtcggtacggtccctaaccggtacggtcgttaacgggaacgggtacggtacggtccgtaagttaagtttaaccttacgtcgtacgtcgtccgtataacttgcgtacgtaggtacgttggtaacgtaccgtccgttcgggtaagttccggtacgggtacggaacggtaaccgtacggttaccggtaccgttacgtacggaccgtaccggaccgtacggtcctcccggttacccgg

SEQ ID NO: 218580 - DNA, 554 bp, Homo sapiens
  misc_feature: GYAE6OF02IFYFP.9.53.E09.1.454.CMB.1.raw
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattangacctttgctctggtaaccanagccaccaggaccaaaacgcccccaaactcactctatttatgaggtcaacgtaacgcggccctcggagggttttctagttcgtcttctcgtgctaccagtctagacaacgcgcctccngacatctcgtggctcgagtctgacggagngctgtattatactnctnctnatangcagnttgnctacgtcgtggtacttcgggcggacggacgtaagcgtaccgttcgtacgtcacgaccgtaaggtcctaccgtccccgtcggtaccaccttccgtcccgttaccccacccgttcctaccggacgtaccgtacgtaccgtcg

SEQ ID NO: 218581 - DNA, 777 bp, Homo sapiens
  misc_feature: GYAE6OF02JDQFJ.9.53.E09.1.454.CMB.1.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctcgtgtctgggtctcgtggcagtcgatcaccattcctcgtgacacgtacggaaccagccagtgattggtacgggattactcgacgttcgtactccgtggtaacccagtacgcctaccagggaccaaaaccgaccccctaaactcgtaactcctaagtttacgacggtacggtaacctaaccgttaacggcccgggtacccttcgggttaaccggggtttcttaacgttccgtctttccgtcggttacgggtacttacccggtaaagtttccgaacggaacccctaaacggtccccggtcccgttaccccgttaggtaaaaccttacgtttaccgttcccggtacggggttccctaccgggtaacgggtccgtacgggaaacgggtaaccgggtcggtaccgttaggtttaactttaccgtttaacgtcggtcctaacggttaccctacgtaattacgtcggtaacgttaggaagtttcggtaccgtaaactccggggttacgttaacggttcgtacggggacgggaacgggtctaaacggggtcttaccccgggttctaacggtccgaaaccggtcccgaacggtccgtcccggtccccg

SEQ ID NO: 218582 - DNA, 733 bp, Homo sapiens
  misc_feature: GYAE6OF02I8JPA.9.53.E09.1.454.CMB.1.raw
  modified_base (642)..(642): a, c, t, g, unknown or other
  misc_feature (642)..(642): n is a, c, g, or t
tcagtgatacgtctcacgaccggtgctcgatttagagagagtgtgttgggtttggggtacgatttgatgttacctgatgcttagaggcttttcctggaagcagggcatttgttgcttcagcaccgtagtgcctcgtcatccacgcctcagccttgattttccggatttgcctaggaaaaccagcctacacgacttaaaccgggacaaccgtccgcccggccaacatacgccttcctcccgtcccccttcgcagtaaccaccaagtacaggaatacttaacctcgttccactcgactaccgtccctttccggcctccgtccgttacggggtccgtacctcctacccctcgtcccccgtaagtttaaccggttcggaccgtacggtaaccctttggtccgttcccggcgaggtccgggtccttttccgaccccgttctttactccggtttaacttattcgtacacgctacttccgctacgttctagtactacccgtccagtcagtccgtacctacactcgaccacctacgttccacgtacggtactacgaacgaacccgtacctaccccctaaccccaacctaaccgtaccaagttaaccgtccgtaaccgttcgaccgtcccgacgtaccgtccgtttccggngtacgtacggttttacggtttacccgttccccggtttaccactttcccgttaccccgacgttacctaccgtacggtaacgtaacgttaccg

SEQ ID NO: 218583 - DNA, 941 bp, Homo sapiens
  misc_feature: GYAE6OF02JJYLT.9.53.E09.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
tcagtgatacgtctcacgaccggtgctcgatttagagagagtgtgttggggtttggggggggtcacaagaggcagcgctctcgggacgtctccaccatggcctgggctctgctgcctcctcaccctctcactcaggacacgcgggtcctcgggacccagtcctcgccctgacctcacgtcctcgcctcgtgtctgggtctcgtggacngtcatccactntcctcgnacacgtacgaactgctaggttgngtttcggggttagggtatttactacgttccgtttcgtccgttaccgttaccggtaacctaacgtacggaccctaacccgacgggaaccaaacccgacccccctaaatccacttaccgttaagtttaggacggtaagggttaccaacggttaaacggcccgggttaacccgttcgggtttaaacgggggttttcttaacgggttcccttcctttacccgtacggttacccgtaccgttaacccggtaattcccggtaacgtaaccgtaaacccgggtaaccccgggttaccccttaccccgtttacgaaacccgtttaacgttaccccggttaccgggtaaccgggttcccctaacccgggtacccgggtttacgggaacgggtaacggggtaaccgtacgggtttaaccgttaacggttaacgtttttacctaacgggtcgttcccgttaccgtactttaacggtaaccgttagtaaccggtacggaacggtttacggttacccgttaacggttaaaccccttcccggggttttaaccggttaacgggttccgggtttaccgggggaaaccggggtttaacccggtaacggtttaaccggggttacccggtaaccccggtttaccgtaaccgggttacccgtacccgggtaaaccgggttcccggttaccccgttcccgggttaacccccgg

SEQ ID NO: 218584 - DNA, 675 bp, Homo sapiens
  misc_feature: GYAE6OF02FHFP6.9.53.E09.1.454.CMB.1.raw
  modified_base (163)..(163): a, c, t, g, unknown or other
  misc_feature (163)..(163): n is a, c, g, or t
  modified_base (401)..(401): a, c, t, g, unknown or other
  misc_feature (401)..(401): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
  modified_base (524)..(524): a, c, t, g, unknown or other
  misc_feature (524)..(524): n is a, c, g, or t
  modified_base (552)..(552): a, c, t, g, unknown or other
  misc_feature (552)..(552): n is a, c, g, or t
  modified_base (562)..(562): a, c, t, g, unknown or other
  misc_feature (562)..(562): n is a, c, g, or t
  modified_base (567)..(567): a, c, t, g, unknown or other
  misc_feature (567)..(567): n is a, c, g, or t
  modified_base (663)..(663): a, c, t, g, unknown or other
  misc_feature (663)..(663): n is a, c, g, or t
tcagtgatacgtctcacgaccggtgctcgatttagagagagtgtgttggggtttcggggggggtcacaacgaggcagcgctctccgggacgtctccaccatcggcctggctctgctgctctcaccctcctcactcacggactaccaggtcctggcccagtccncgccctgactcagcctgcctcgtctcgtgggtctaccgtggctacggtcgactccgaccacttcctccgtcgacctaccgtaccgggaacccacgtccgacggtttacgacgtttcggggttaacgggtacgttacgtacgtaaccgtttcggtccgttcccgtacgggtaccccaaacggccgacccgaaccggacggacccaaaccctccccgtaaattcgacttactagtttacncgacgtcgaactacgccgtaccgtcgttaacggttcacgttccncgttacncgtcncctacgactctacgacactccgcctccganacacttcgtcgngtccacggcgtcgacgacggtaacngtacgtacgttactcgttacgctacgtnccttaatccngtacnccttaggcgttacgactcgttcgtacccgtgtaccggcgacgggtaaacgcggtaccggtacctacggcgtacggtaccaccggccggtcgtaccnccccgtacccgg

SEQ ID NO: 218585 - DNA, 825 bp, Homo sapiens
  misc_feature: GYAE6OF02FS44Z.9.53.E09.1.454.CMB.1.raw
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatcctcctgcactggaaccagcagtgagtggttagggtattatcgtaccttgtcctccgtaggtaaccaacgacgaccaaccccgaggacccaaaccgaccccccaaatccatcctaatttataggacgtaccaacgtaacggccggtacccgtacggttacggggtttccttacgttccgtactttccgtcgtcggtcctaccgtaacgtcgtacgaacctaaccggaccgtcccctacccgtacgaactaacgttccgtacgtcgggtacctaccgacggtcgtacgggacggacggtacggtcgttacgtactttacgttaccgtcgtccgttacgtcgttactaagttacgtacgaccgtaaggtacgttacggtaaccgtaccgttaccggttcccgggttaaggtttaccgggtccggggtaacggggaacggtaaccggttaacgggttaccgtacccggtttacggtaccggttacccgaacccgggtaacccgaaccgggtttcccggtaccccggttacccccggttacggttaccccgttaacccggtttccccgtttaccccccgttaacccccgttaccccgttacccggtttaacccggtaaccgggtaccctttaacccggttaccgtaacccgggg

SEQ ID NO: 218586 - DNA, 871 bp, Homo sapiens
  misc_feature: GYAE6OF02JO5IQ.9.53.E09.1.454.CMB.1.raw
  modified_base (180)..(180): a, c, t, g, unknown or other
  misc_feature (180)..(180): n is a, c, g, or t
  modified_base (234)..(234): a, c, t, g, unknown or other
  misc_feature (234)..(234): n is a, c, g, or t
tcagtgatacgtctcacgaccggtgctcgatttagagagagtgtgttgggtttggggggggtcacaagaggcagcgctcgtcgggacgtctccaccatggcctgggctctgctgctcctcaccctcctcactcaggacacgagggtcccgtcgggcccagtcctcgtcccctgtacctcncgcctcgccctcggtcgtccgtgggttcctacctggaccagttcgactctaccnttcgtccctgtccgaaacctggaacccaggtcgaagttggtacggttaggtttagggtacgttaaccgttggtaccctttcgtcgtacccttacggtaaccgaaccaccggacgacccgaaaccggaccccaaaaccttacccccaaactcctaactttacgtagtttaatcggggaaacgttacgaaccgttaaccgccggtacccggtttacgtaacggggttttcctcggtttccgtctttcggtcctacggtacctacgtacgtctaacggaccgtaacccgtacccggtaccctacccgtaacgtacctaacggttcccgtaccgttccgggtacccgtaccggtacggacccggttagggaacgggttaccggaagggtcctttaaccggtaaactttttccgttaaacccgttaggcccttacgaccttttaacgagttaccgtacggtacgttagggtaaccgttaggtaaacccgttaccggtaccggtttaccgacggggtttaccggaccggggttaaccggaaacgggggttaccgtaaccgggttaccggttaacccggtccggtaacggtaccccggtaacgggtaccccgtacgggtaccccccggtccggttacccccggg

SEQ ID NO: 218587 - DNA, 697 bp, Homo sapiens
  misc_feature: GYAE6OF02G6XFK.9.53.E09.1.454.CMB.1.raw
  modified_base (187)..(187): a, c, t, g, unknown or other
  misc_feature (187)..(187): n is a, c, g, or t
  modified_base (445)..(445): a, c, t, g, unknown or other
  misc_feature (445)..(445): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
tcagtgatacgtctcacgaccggtgctcgatttagagagagtgtgttgggtttggagtacgatttgatgttacctgatgcttagaggcttttcctggaagcagggcatttgttgcttcagcaccgtagtcgccttcgtcatcaccgcctcagccttgtatttttccggatttcgcctaggaaaaccngacctaacacgacgttaaaaccgggacaaccgtccgcccggaccaacatacgcctttcctccccgttccccccttgcctaagtaaccaaccaaacgtacaggaattacttaacctcgtttacccatccgacttaccgtccttcgcctcgtcgttacggggtcactccaccctcgacccgtattaaccgttggacctacggtaacccttggtccttcggcgagtcggtcttttccgaccgttctttagtcgttaacttntcgtcagtctacgttcgctacttcgtntaacttcctacacncatcacctacacncgctactccttaccacgccgttcttaacgacgtaaccgtcccttaccccaaacccgtaaccaaccgtactaacgtaaccgtccgttccgacctccggacctaccgacgttccgtcggtctacgttacggtttaccgtttaccgtcccgtttaaccgcctttaccgttccccgacttaacgttcggtacgacgttaccg

SEQ ID NO: 218588 - DNA, 619 bp, Homo sapiens
  misc_feature: GYAE6OF02FHDZN.9.53.E09.1.454.CMB.1.raw
tcagtgatacgtctcacgaccggtgctcgatttagagagagtgtgttgggtttggagtacgatttgatgttacctgatgcttagaggcttttcctggaagcagggcattttgttgcttcagcaccgtagtgcctcgtcatcacgcctcagccttgattttccggatttgcctggaaaaccagcctacacgcttaaaccgggacaaccgtcgcccggcaaacatacgccttctcccgtcccccttcgcagtaacaccaagtacaggaatacttaacctgttcccatcgactacgcctttcggcctcgccttaggggtcactcacctcgccccgattaacgtggacaggaaccttggtcttccggcgagcgggtcttttcaccgtctttagtcgttacttactgtcagctacttcgctacttctgtaactacctcagcactcgcctcactacgccacaccttcacgtacggtacttaacacgaccgcctacccctaacccaaacaaccgctaacgtaacgcgtacgctcgccgacacgtccgttcggctcgtagttacggtttccgtccccgtttactaccgttcccgttcccgtaccctacgttaccgtagaacgtaccg

SEQ ID NO: 218589 - DNA, 586 bp, Homo sapiens
  misc_feature: GYAE6OF02F9PKV.9.53.E09.1.454.CMB.1.raw
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctctcactcaggacacagggtcctgggcccaggtctgccctgactcagcctgcctccgtgtctgggtctcctggacagtcgatcaccatctcctgcactggaaccagcagtgatggttgggattatgaccttgtctcctggtaaccaacagccacccaggacaaaacgcccccaaaatcatcatttangagtcaactaagccgacctgtaggggtttcattcgctttntcgtggctaccaagtctgaacaacaccggcctcctgaactaatctcgtgggctccgaggctgacggacgagntgtaattatactnctntctctatatgacagtagtggtacgacctaacgttcccgtagggttacgttcgggacgggtaacgggaacctaacggggtccggaacccggtttcccggtaagggtccgtaaccggaccccggtaacggtccgtacccgtaccccccgg

SEQ ID NO: 218590 - DNA, 803 bp, Homo sapiens
  misc_feature: GYAE6OF02HA0CQ.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacgagggtcctgggcccagtctgccctgactcagcctgcctcgtgtctggtctcctggactagtcgatccacctatcctcctgccacgtggaaccagcagtgagttggttagggtattatcgtaccttgtcctcctacggtaaccaacgacgccaacccgaaggacccaaaaccgaccccctaaacgtccacttactaatttaagtaggacggtacaacgtaacggccggtacccgtacggttagggtttctacgttccgtcttcgtcgtcggtacctacgtacgtctacgaaccgaaccgaccggtccctaccgtacgtaactaaccgttcccgtcgggttccgggtacccttaccggacgggtcgttaacgggaacggggtacggaacgggtccgttaaggttaacttttaaccggtttaacgtcggttaccgtcgttacccttacgtaacttaccggtagtaaccgtaacgggttacggttacgggaaccgtaacccgtacccgggtttaccgggttaaggggtttaccgggttcgggggtaacccggggtaacggggtaacccgggttaaacggggttacccggttaacccggttacgggtaccgggtaccgtaacccgggaaccccggtaccggttacccggtcccccggttaccccccgg

SEQ ID NO: 218591 - DNA, 793 bp, Homo sapiens
  misc_feature: GYAE6OF02FUB77.9.53.E09.1.454.CMB.1.raw
  modified_base (246)..(246): a, c, t, g, unknown or other
  misc_feature (246)..(246): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctctcactcaggacacgagggtcctgggcccagtctcgccctgactcagcctgccctccgtgtcgttgggtcctccgtgggacaggtcgatccacctattcctcctggccacgtacggaacccngcgtaggtacgtagttggggttagggtagtttacttacggtacctttggtccttccggtaacggtaaccaacgacgacccaaccccgaacggaaccccaaaacccgaccccctaaaagttcctaacttaccgtttaatttacggtacggaccggttaactaaccgtaacggtcccgtacccgtttaggtaacgggttttctaccgttcgtacctttcggtacgtccgtccgttaaccgtaggttcgtaaccgaacctaccggtacccggtacccttacgaacctaacgtaccgttcgtaccggtacggtccccgtacggcggtacggtacgggaaacgtaccggtgaccttaggttaacgtttactaggtctccgtaacgttcctaatagtacgtcgtaacgtagttacggtagtacccgtaccgtaccgggtttaccggtggttacccgggtacgggaacgggtaaacgggtacgtaacccggtacggtacccgtaggtccgttacgaaccccgggttcctacggcccccgttaaccccgtccggg

SEQ ID NO: 218592 - DNA, 620 bp, Homo sapiens
  misc_feature: GYAE6OF02HRMGF.9.53.E09.1.454.CMB.1.raw
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (365)..(365): a, c, t, g, unknown or other
  misc_feature (365)..(365): n is a, c, g, or t
  modified_base (407)..(407): a, c, t, g, unknown or other
  misc_feature (407)..(407): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (508)..(508): a, c, t, g, unknown or other
  misc_feature (508)..(508): n is a, c, g, or t
  modified_base (530)..(530): a, c, t, g, unknown or other
  misc_feature (530)..(530): n is a, c, g, or t
  modified_base (608)..(608): a, c, t, g, unknown or other
  misc_feature (608)..(608): n is a, c, g, or t
tcagtgatacgtctcacgaccggtgctcgatttagagagagtgtgttgggtttgggggctttgcctgggctctgctgctcctcaccctcctcactcaggacacagggtcctgggcccagtctcgccctgacctcagcctgcctccgtgtctgggtcctccgtggacagtcatcaccntctccgtncactggaaccagctagtgacgtggttgggattagtgtacccttgtacctcgtaggtaccaatacggccaccgagaactaaccacccctaaactcactatagtttgagacgtaccaacgtacgccggtaccctggtacggtttcctagttccgtacttcgtccgtacgcctactaagttcncgaacaccgtcgccctacctacatacgtctcgcggactacgnggctagggaacgtcgagtctacgtattcgtcngtccntntcatgacngacgccactacgtatccgtcgtaggacgtgaccgtgtcccgtctagtaccgganacccgacccgaaccgtaacccnccttacgtctacccggtactaccccggtttctaacccccgtccgttagacccggtacgactttaccccgtcggtaccncggggtaaccgg

SEQ ID NO: 218593 - DNA, 738 bp, Homo sapiens
  misc_feature: GYAE6OF02I2NPD.9.53.E09.1.454.CMB.1.raw
tcagtgatacgtctcacgaccggtgctcgatttagagagagtgtgttgggtttgggggctttgcctgggctctgctgctcctcaccctcctcactcaggacacagggtcctgggcccagtctgccctgactcacgcctgcctccgtgtctgggtctccgtggacagtcgatcaccatctcctgacactaggaccagcagtgatggttgggagttactgtaccttcgtctccgtaggtacccaacacgccaacccgagaccaaccgaccccaaactcatactattagagtacgtcaacgtacgcggccctgtagggtttctacgttcgtcttctcgtcggtcctactaagtcctagacaccgtccggcctccgtcaactatcctacggtcggcctcgagtcgtaggacggacgtacggtacgttcgtatttacttacctgtccgtcgtacttacgtacgttaacgcgtaacgaggtacggttcggtaccgaacccgttcccggttacccgggttacggttaccgggtttaaccgggggacggggtaaacgggtaccggtaaacggggttcccggtaaccgggttacccgttaacggggtacctaacccgggacccggttaccggtaccgtcccccgggtaccccggttcggttacccgtaccgttccccggttaccccgtttaccccgttccccggttccgttaccgtaccggtaaccgttccgtaacccgggtacggg

SEQ ID NO: 218594 - DNA, 821 bp, Homo sapiens
  misc_feature: GYAE6OF02GPGD4.9.53.E09.1.454.CMB.1.raw
tcagtgatacgtctcacgaccggtgctcgatttagagagagtgtgttgggtttggggggggtcacaagaggcagcgctctcgggacgtctccaccatggcctgggctctgctgcctcctcaccctcctcactcaggacacgagggtcctgggcccagtctgccctgactcagcctgcctcgtgtctgggtctcctggacagtcgatcaccatcctcctgcacgtacggaaccagcagtgagttggttgggtattagtcgtaccttgtctcctacggtaaccaacacgccacccgaaggaccaaaaccggacccctaaactcaactctaatttacgtagacggtaccaacgtacggccggtcccttcggtaggggtttacctagttccgtctttaccgtcgttacgggtacttaccgtaacgttctacgaaccgtaaccgtacccgggtccccttacccgtacgaaacctaacgttccctttaccgggtcgggtacccgtaccggacgggtaccgttaaggggaaccgggtaaccgggacggttaccgtttaaggttaaaccgttttaacgtttaccgttacggtccttacggtaccttacgttaagttaaccggtcgaaccggttaaggtacgtttacgggttacgtaacccgttaccgggttcccgggttaaggtttaccgggttacggggaacccgggggtaaccggggttaaacccggtaacggggttaccccggtaaccgggtttaccgttaacccgggtcccggaaacggttaccccgggtaaacggggttccccttaccccgggttaccccccgg

SEQ ID NO: 218595 - DNA, 763 bp, Homo sapiens
  misc_feature: GYAE6OF02FYSMM.9.53.E09.1.454.CMB.1.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcagacacagggtcctgggcccagtctgccctgactcagcctgcctcgtgtctgggtctcctggacagtcgatcaccatctcctgcactggaaccagcagtgtagttggttagggacgtttatacggtaccgtttcgtcctccgttacggtaaccaacgacgacccacccgaaggacccaaaccgaccccctaaactacactactattagtacgtacggtacctaacgtacggccggtacccgttcggtaacggggtttctagttccgtcttcctcgtcggtacctaccgtacgtctacgaaccaaccgaccggtccctcctacgaacctacgtcgtacgtcggacctacgacggtcgtagacggacgacggtcgtagttaactttacgttacgtacgtccgttacgtacccttactaacgttacgttaccgtacgtaaagggttacgtttcgggtaacgtaaaccccgttaccggttaccccgggtttagggtttaccggttaccggggaacccgggggttaccggtaaaccgggttaccgggtaacccggtaacccggttttcccggtaaccggtaacggtaccccgggaacccgtaacccgggttcccgtaccccgggttaccccccgg

SEQ ID NO: 218596 - DNA, 716 bp, Homo sapiens
  misc_feature: GYAE6OF02GNV0Y.9.53.E09.1.454.CMB.1.raw
  modified_base (248)..(248): a, c, t, g, unknown or other
  misc_feature (248)..(248): n is a, c, g, or t
  modified_base (281)..(281): a, c, t, g, unknown or other
  misc_feature (281)..(281): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactgaggacacagggtcctgggcccagtcccgccctgactcagcctgccgccgtgtccgggtctcctggacagtcgatccaccatctcgtgcacgtggaaacgaatagcgactagttggngctactaatcatcgtctcctggtactaataacngtaccaggacaaacgacccccaaactctaagttaatttatgtattgttactttacgaccggtcctcgtaggttacttttcgttacgttcgggtttcgtcgttcggtcctaccgtaaggttaccgtaacggggaaaaccgtcccgtacccgtaccgtacgtaaccgtcgttccgtacggtaccttaccgtaccgtaccgtacggtaacgggtacggtaacgggtaggttacgttaactttaccgtcgtacgtacggttacgttacgtaaccgttacttaccgtaaaccgtttaccccgttccggtttcgggtttacggttcgggtaccgggtaacgggtaccgtagtcgtaccgtcgtaccgtcgtcgtaacgtcgtaccgaccggtaccgtacgtcccgtcccgtccgtccgtactccgttacctcccctacccg

SEQ ID NO: 218597 - DNA, 761 bp, Homo sapiens
  misc_feature: GYAE6OF02IRP60.9.53.E09.1.454.CMB.1.raw
  modified_base (183)..(183): a, c, t, g, unknown or other
  misc_feature (183)..(183): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
tcagtgatacgtctcacgaccggtgctcgatttagagagagtgtgttgggtttgggggggtcacgaagaggcagcgctctcgggacgtctccaccatggcctgggctctgctgctcctcaccctcctcactcaggacacagggtcctgggcccagtctgaccctgactcagcctgcctccgtntctgggtctacctggccaggttcactcaccatccgctgaccactgaaccngcagtgatggtggaattntgacttgtctccgtacggtaccagacgtacaccccaggtaccaaacgtaccccccaaaatccaacttacctattttaagacggtacggtaccaaaccgttaaccggaccgggtacccctttaccggtaagggggggtttttacccttaacgttacggttcccttttacctacggttacgggtccttaacccgggaaatttcgaacttaaacccgaaacccgtacccggtcccgtttcccgaacgtaaaccgttaacctcgtttcccggttaacggtcccttacccggaacggttcggttaccggaacgggttaacgaaccgggtcgtaacggtaatttacgttaccgtagtaccgttacgtcctacgtacgtacgttagaccgtagtacgtaggtaccgacgtacccgtcgtacgggttcaccgggtacggtaacgggaccgtaggtaacccgtaccgttaccggtacgttaccgaccgtacccggaacggttccgcccgttaccccggg

SEQ ID NO: 218598 - DNA, 257 bp, Homo sapiens
  misc_feature: GYAE6OF02HJCKI.9.53.E09.1.454.CMB.1.raw
  modified_base (250)..(257): a, c, t, g, unknown or other
  misc_feature (250)..(257): n is a, c, g, or t
tcagtgatacgtctcacgaccggtgctcgatttagagagagtgtgttgggtttggggggtgtggtggtctccactcccgccttgacgaggctgattattactgctgctcatatgcagatggtgacactcccgtggtattcggcggagggaccaaggtgaccgtcctaggtcagcccaaggctcgccccctggtcactctgttcccaccctcctcagacgtatcactgagcgggctggcaaggcgcatagnnnnnnnn

SEQ ID NO: 218599 - DNA, 619 bp, Homo sapiens
  misc_feature: GYAE6OF02IFBOI.9.53.E09.1.454.CMB.1.raw
tcagtgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcgtgcactggaaacgaatagcgacattggtgctctaatcatgtctctggtactataacagtccaggacaaacgccccaaactcaataattatgatgtcttagcgcctcagggtatttacgttctcgttgtcgtggctccaagtctggaacacggcctcctgaccatctctacggtacttcgacgctaggaggtacggagggtagtactttacttcgtgtctacgttacaagtacttacaacgtaaaccttccccgttcggtttcgggttcggttcgggaccgggaacgggacctacgtacgccgtcgtaccgtccgtacgtacgtccgtacgacccgaaacggtctaccggcccccgttcggtcctacttccgttccgttcccctaccctaccctaccgtaaccgtacgttaactaccgtacgtcggtacggtcggtaccgg

SEQ ID NO: 218600 - DNA, 702 bp, Homo sapiens
  misc_feature: GYAE6OF02FTYBW.9.53.E09.1.454.CMB.1.raw
  modified_base (131)..(131): a, c, t, g, unknown or other
  misc_feature (131)..(131): n is a, c, g, or t
  modified_base (234)..(234): a, c, t, g, unknown or other
  misc_feature (234)..(234): n is a, c, g, or t
  modified_base (495)..(495): a, c, t, g, unknown or other
  misc_feature (495)..(495): n is a, c, g, or t
  modified_base (546)..(546): a, c, t, g, unknown or other
  misc_feature (546)..(546): n is a, c, g, or t
tcagtgatacgtctcacgaccggtgctcgatttagagagagtgtgttggggtttgggggtcacaagaggcagcgctctcgggacgtctccaccatgggcctgggctctgctgctcctcaccctcctcactnaggacacagggtcctgggcccagtctgccctgactcagcctgcctcgtgtcgtggtctcgtggactagtcgactcacctatcctcctagctacgtacgaaccngtctaaggtgtagtttgggtaggggtatttagtcgtaccgtttcgtccgttaccgtacggtaacctaacgacggacccacccgaaggacccaaaacccgaccccctaaatccgtactacttaagtttacgaggtacgtaccgtaacggtaaccgccggttcccgttacgggttacgggtttcctagttccgttcttccgtcgtcgtctacgagttcgacaccacgtccgtacctccgtagaactacgtcttcgcgtaccgngtacgtgacggacgcggagtctagttattctcgtgtctcacgtattcgtanacgacgtagtgtcgttaaccacggttcgttcggttacggttaccggtcgggaagggtacccggaacgtttacgggaaccccgttaccggttaacggttaccggtacccgtaaccgggtaacccggaccgggttaccccgtccccgggttaccccgg

SEQ ID NO: 218601 - DNA, 646 bp, Homo sapiens
  misc_feature: GYAE6OF02H4D38.9.53.E09.1.454.CMB.1.raw
  modified_base (124)..(124): a, c, t, g, unknown or other
  misc_feature (124)..(124): n is a, c, g, or t
  modified_base (179)..(179): a, c, t, g, unknown or other
  misc_feature (179)..(179): n is a, c, g, or t
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
  modified_base (498)..(498): a, c, t, g, unknown or other
  misc_feature (498)..(498): n is a, c, g, or t
  modified_base (507)..(507): a, c, t, g, unknown or other
  misc_feature (507)..(507): n is a, c, g, or t
  modified_base (518)..(518): a, c, t, g, unknown or other
  misc_feature (518)..(518): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
  modified_base (558)..(558): a, c, t, g, unknown or other
  misc_feature (558)..(558): n is a, c, g, or t
  modified_base (566)..(566): a, c, t, g, unknown or other
  misc_feature (566)..(566): n is a, c, g, or t
  modified_base (570)..(570): a, c, t, g, unknown or other
  misc_feature (570)..(570): n is a, c, g, or t
  modified_base (624)..(624): a, c, t, g, unknown or other
  misc_feature (624)..(624): n is a, c, g, or t
tcagtgatacgtctcacgaccggtgctcgatttagagagagtgtgttgggtttggggtcacaagaggcagcgctctcgggacgtctccaccatggcctgggctctagctgctcctcacctcctnaactcaggacacaggtcctgggccagtctgcccgtgactcagcctgccgttcgtntcgtgggtcctcgtggaaccaggtcatccaccagttcctctgactacgtcggaacctaggtacacgttggacgttggtggggtacttgtcggtacctttggaacctttaccgtcggtaaaccacgtaccgaccaacccgaagggttaacctaaaacccgccccaaactnaacgttcgttattaacgngtacgaaactactaaccggccggtccttagggaggttttccaaggtccttcgtcttccgtaagaactcgttaaancgtanaacctaagtcccgttccctactggaaattccngttccgnggtccaacgtgtnaaaccgggngacgtacggtntagttaaacgtttntcgcttnacgtactcnggttaccgtnaacgtgtnaccngccgttcgaaggttccgaacgggtcgtaaggccacgtacggtactcgggtaccncgaccgaccgcgtccgccgccg

SEQ ID NO: 218602 - DNA, 762 bp, Homo sapiens
  misc_feature: GYAE6OF02G1E0L.9.53.E09.1.454.CMB.1.raw
tcagtgatacgtctcacgaccggtgctcgatttagagagagtgtgttgggtttgggggctttgcctgggctctgctgctcctcaccctcctcactcaggacacgagggtcctgggcccagtctgccctgactcagcctgcctccgtgtctgggtctcctggacagtcgatcacatctcctgcacgtaggaaccagtcagtgagttggttagggattatgtaccttgtacctccgtacggtaccaacgacgaccaacccgaggacaaaccgacccccaaactcactctatttacgtaggtacgtactaacgtaacggccggtacccgttacgtaggggtttaccttaacgttccgtcctttacgtccgtcggacctaccgtaactctacgaaccaaccgaacccggtccctacccgttacggaaacctaaacgttccgttacggtcgggtaccccttacggtacgggacgttaacgggaacgggtaaccggacggttacgttaagtaaagttttaccgttaacgttcggacgttccgtacttaacacgttaacgcggactaaggtacggtcgggtactaccgttacccgttccgggttagtaccggtccgggaacgggtaacgtaccggtaagggtccgtaccggtacctacggtaccgaccgaccgaacggtcctcccgtaccccggttcgacccgttaccgtccttccccggtttaaccctccccgttacaccgttaaccggtaacttccgacctaacggg

SEQ ID NO: 218603 - DNA, 919 bp, Homo sapiens
  misc_feature: GYAE6OF02GF0AM.9.53.E09.1.454.CMB.1.raw
  modified_base (242)..(242): a, c, t, g, unknown or other
  misc_feature (242)..(242): n is a, c, g, or t
  modified_base (312)..(312): a, c, t, g, unknown or other
  misc_feature (312)..(312): n is a, c, g, or t
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtccctgggcccagtctcgccctgactcagcctgccctccgtgtcgtcgggtctccgtggacagtcgatccaccattcctcctgcctacgtacggaaccngacgtagttgaacgttgggttagggtaagtttatcgtaccgtttcgtcttccgttacggtaaccctaacncgacccacccgtacggaccgaaacccgaccccccctaaatccgtaacttcctaagttttacgaggtaacgttacgtaaccgtaacggtcccgggtaccccgttacggttaaccggggtttcttaccgttccggttccgtttccgttccgtacggtacccgttacccgtaacgttccgtaacgtaacccctaaccgtccccggttacccttaccccgtaacgtaaccctaacgttcccgtttaccgggtaccgggtaccccgttacccgggtaaccgggtaccgtaacggggtaaccggggtaaaccgggtcgggttaccggttaagttttaaccgtttaaccgttttaaccgttcggttaacccgttacgtacgttaacccgtttaagtaacgttcggtaaccggtaggtaaccggtttcggggttaaccctaaacccgggtttaacccgggttcccggtttacgggttaccgggttaccggggaccggggtaacccggggtaaacccggtaacgggttaccccggttaacccggtacggtttacccggtacgaacccccgggtttaacccgacccgggttaccccgttccccggttaaccccccgg

SEQ ID NO: 218604 - DNA, 592 bp, Homo sapiens
  misc_feature: GYAE6OF02I5HX1.9.53.E09.1.454.CMB.1.raw
  modified_base (134)..(134): a, c, t, g, unknown or other
  misc_feature (134)..(134): n is a, c, g, or t
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
  modified_base (523)..(523): a, c, t, g, unknown or other
  misc_feature (523)..(523): n is a, c, g, or t
tcagtgatacgtctcacgaccggtgctcgatttagagagagtgtggttggggtttggggggggtcacaagaggcagcgctctcgggacgtctccacatggcctgggctctgctgctcctcaccctcctcacctnaggacacagggtcctgggcccagtctgccctgactcagcctgcctcgtgtcgtgggtctcctggacagtcgatcaccntctcctgcactggaaccagcagtgatggttgggattatctcgttntctctggtacaacanccaccaggactaacgacccaaacgtcatcctaattagtgagaccacgtaacgccggtacctcgttagggtttctattcgtcttctcgtgctacaactcgtacacgtaacgcgcctccgtanaacctagtcctgtccggataccgcgacgngtaacggcggtagaccgtattagtttaacctttcgtcggtctagtccgtactaagtatcgacgagtgtgttcgaaacgtccgttaccgtggtacttacggngggtaacggaacgttcggacggttaccgacgttacgtccggacgacccggatcccggtacccgtcccgg

SEQ ID NO: 218605 - DNA, 758 bp, Homo sapiens
  misc_feature: GYAE6OF02JALOM.9.53.E09.1.454.CMB.1.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacgagggtcctgggcccagtctcgccctgactcagcctgcctccgtgtcgtgggtcctccgtggacagtcgactccaccatctcctgcacgtcggaaccagcctagtgattcgggttagggtactttacgtcgtacccgtttgtcctaccggttacgaaccgtaacgacgtaccgaccgacggaacccaaacccgtacccccaacgtactacttacgttatttacgacggtacgtaacctacgtaacggcccgtaccgtagggttacggtttctacgtccgtcttcgtcgtacgtcctaacgtacgtacgtacgaaccgaacgttcccgtacccttaccggtacgtaaccgttaccgtttccgtacgggtccgtaccgtaccggtaacggtaggaccgggtaacgggaaccgggtcgtacggttacgtttaactttacgttacgccgtttcggtacgaccgtttagtagttaccgtagcgttaaggtcgtacgtaccgtaaaccgttccgtttacggggtacgttacggggtaccggtacgggaacccggtaacggttccgggtaccgtacgttaccgggtactccggaacccgtacgtccggccgttccccgtacccgg

SEQ ID NO: 218606 - DNA, 765 bp, Homo sapiens
  misc_feature: GYAE6OF02IW4RP.9.53.E09.1.454.CMB.1.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
  modified_base (591)..(591): a, c, t, g, unknown or other
  misc_feature (591)..(591): n is a, c, g, or t
tcagtgatacgtctcacgaccggtgctcgatttagagagagtgtgttggggtttggggggggtcacaagaggcagcgctctcgggactctccaccatggcctgggctctgctgctcctcaccctctcactcagacacaggtcctgggccagtctgccctgactcagcctgccgtccgtgttcgtgggtctcgtaggacacgtcgatcacctagtcctcngctaacgtgaaccngacaggtgtagttggtggtaacttntacgtaccgttacgtccgttaccgacggttaaccaacgtacgacccaccgaacggaccaaaacccgtaccccaaaactcgtaaccttactaacgtttagtacggtaccgtactaacgtaaccggcccggtaacccgtttacgttacggggtttacttacgttaccgtctttacgtccggtttaggacccttaacgtaactcgttaacgaacctaacccgggcctacccgtaccgtaacaacttacgtccgttacccgacgggtaccctacggcgtacgtggaaaccgggtacgtacgtctaacgttaagttacgtctcggtactccgtacgtntaagtttgacgtacgtaaggtgtaccgtacggtacccttaccggttacgttgggtttacgtaccggggtacggggtaaacccggtaccgttaacggggtaccgtaccgtttaccgggacgtaaaccccggtacggaacccgtttccggtccccgggtccccgttaacccccggg

SEQ ID NO: 218607 - DNA, 832 bp, Homo sapiens
  misc_feature: GYAE6OF02HMRHU.9.53.E09.1.454.CMB.1.raw
  modified_base (226)..(226): a, c, t, g, unknown or other
  misc_feature (226)..(226): n is a, c, g, or t
tcagtgatacgtctcacgaccggtgctcgatttagagagagtgtgttgggtttgggggctttgcctgggctctgctgactcctcaccctcctcactcgaggacacgacgggtcctcggcccagtctcgccctgacctcgacgtcctgccctaccggtgttcgtcgggtaccttccgaggacagtcgactaccaccagttcctccgtgacctaccggtacggaaccngactaggtacagtggttagggattagtctaccttgtccttccgagtaacccaagcgaccaacgacgtacaaaccccgaccctaacgtacacgtaacgttagttacgacgaacgtacaaccgaacggccgtacccgttggttaccgggtttactaacgttcgtacctttacgtccgtacggtacctaaccgtacgttacgtacgaacccgtaggtaccccggaccttacccgacgtaacgtacttccgtacggtcggtacctacgtaacgtcgaacggtaaaccggaccgtacggtacttacgtttaacgtacgttaccgtcggtactcgtacctagtacgtacgtacgacgtaaacgttcggttaaccgtcgtaaccgtccggtttacggttacggttaccgggtaacgggtaccgggtaacggttaaccgggtaacgggttaccgtaacccggttaccgggttaacccggtacgaaacccgtacccgggttaggacccccgttccgttaccccgggtacgttaccctcggtttaaccccgtaccgttacccccgttacctcccggaaaccgttacggttaacccgtacgttacccggttaaccgg

SEQ ID NO: 218608 - DNA, 212 bp, Homo sapiens
  misc_feature: GYAE6OF01BIKWK.18.53.E09.1.454.CMB.1.raw
  modified_base (212)..(212): a, c, t, g, unknown or other
  misc_feature (212)..(212): n is a, c, g, or t
tcagtacgagtatgcacgaccggtgctcgatttagagagagtgtgttggttgggaagaggaagactgacggtcctccaggagttcaggtgctgggcaccgtggcatggggaggtgtgtcacaagatttgggctctgggcacagcggccctgggctgcctggtcaaggactacttcccatactcgtactgagcgggctggcaaggcgcatagn

SEQ ID NO: 218609 - DNA, 216 bp, Homo sapiens
  misc_feature: GYAE6OF01EAQ83.18.53.E09.1.454.CMB.1.raw
  modified_base (216)..(216): a, c, t, g, unknown or other
  misc_feature (216)..(216): n is a, c, g, or t
tcagtacgagtatgcacgaccggtgctcgatttagagagagtgtgttgggtttggggaagaggaagactgacggtcctcccaggagttcaggtgctgggcaccgtggcatggggaggtgtgtcacaagatttgggctctgggcacagcggccctgggctgcctggtcaaggactacttcccatactcgtactgagcgggctggcaaggcgcatagn

SEQ ID NO: 218610 - DNA, 218 bp, Homo sapiens
  misc_feature: GYAE6OF01EKJ87.18.53.E09.1.454.CMB.1.raw
  modified_base (217)..(218): a, c, t, g, unknown or other
  misc_feature (217)..(218): n is a, c, g, or t
tcagtacgagtatgcacgaccggtgctcgatttagagagagtgtgttgggtttggggaagaggaagactgacggtcctcccaggagttcaggtgctgggcaccgtgggcatggggaggtgtgtcacaagatttgggctctgggcacagcggccctgggctgcctggtcaaggactacttcccatactcgtactgagcgggctggcaaggcgcatagnn

SEQ ID NO: 218611 - DNA, 219 bp, Homo sapiens
  misc_feature: GYAE6OF01CRYAE.18.53.E09.1.454.CMB.1.raw
  modified_base (218)..(219): a, c, t, g, unknown or other
  misc_feature (218)..(219): n is a, c, g, or t
tcagtacgagtatgcacgaccggtgctcgatttagagagagtgtgttgggtttggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnn

SEQ ID NO: 218612 - DNA, 218 bp, Homo sapiens; identical to SEQ ID NO: 218610
  misc_feature: GYAE6OF01C5PYB.18.53.E09.1.454.CMB.1.raw
  modified_base (217)..(218): a, c, t, g, unknown or other
  misc_feature (217)..(218): n is a, c, g, or t

SEQ ID NO: 218613 - DNA, 220 bp, Homo sapiens
  misc_feature: GYAE6OF01EQKPC.18.53.E09.1.454.CMB.1.raw
  modified_base (219)..(220): a, c, t, g, unknown or other
  misc_feature (219)..(220): n is a, c, g, or t
tcagtacgagtatgcacgaccggtgctcgatttagagagagtgtgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnn

SEQ ID NO: 218614 - DNA, 191 bp, Homo sapiens
  misc_feature: GYAE6OF01C1OYP.18.53.E09.1.454.CMB.1.raw
  modified_base (173)..(191): a, c, t, g, unknown or other
  misc_feature (173)..(191): n is a, c, g, or t
tcagtacgagtatgcacgaccggtgctcgatttagagagagtgtgttgggttggggaagaggaagacgtgacggtcctccaggagttcaggtgctgggcacagtcggtccctgggctgcctggtcaaggactacgttcccatactcgtactgagcggctggcaagcgcatagnnnnnnnnnnnnnnnnnnn

SEQ ID NO: 218615 - DNA, 220 bp, Homo sapiens; identical to SEQ ID NO: 218613
  misc_feature: GYAE6OF01D873H.18.53.E09.1.454.CMB.1.raw
  modified_base (219)..(220): a, c, t, g, unknown or other
  misc_feature (219)..(220): n is a, c, g, or t

SEQ ID NO: 218616 - DNA, 222 bp, Homo sapiens
  misc_feature: GYAE6OF01APH3P.18.53.E09.1.454.CMB.1.raw
  modified_base (219)..(222): a, c, t, g, unknown or other
  misc_feature (219)..(222): n is a, c, g, or t
tcagtacgagtatgcacgaccggtgctcgatttagagagagtgtgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnnn

SEQ ID NO: 218617 - DNA, 221 bp, Homo sapiens
  misc_feature: GYAE6OF01A0QCH.18.53.E09.1.454.CMB.1.raw
  modified_base (219)..(221): a, c, t, g, unknown or other
  misc_feature (219)..(221): n is a, c, g, or t
tcagtacgagtatgcacgaccggtgctcgatttagagagagtgtgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnn

SEQ ID NO: 218618 - DNA, 231 bp, Homo sapiens
  misc_feature: GYAE6OF01CS3AO.18.53.E09.1.454.CMB.1.raw
  modified_base (219)..(231): a, c, t, g, unknown or other
  misc_feature (219)..(231): n is a, c, g, or t
tcagtacgagtatgcacgaccggtgctcgatttagagagagtgtgttgggtttgggggaagaggaagactgacggtcctcccaggagttcaggtgctgggcaccgtgggcatgggggagtgtgtcacaagatttgggctctgggcacagcggccctgggctgcctggtcaaggactacttcccatactcgtactgagcgggctggcaaaggcgcatagnnnnnnnnnnnnn

SEQ ID NO: 218619 - DNA, 173 bp, Homo sapiens
  misc_feature: GYAE6OF01DMDFO.18.53.E09.1.454.CMB.1.raw
  modified_base (173)..(173): a, c, t, g, unknown or other
  misc_feature (173)..(173): n is a, c, g, or t
tcagtacgagtatgcacgaccggtgctcgatttagagagagtgtgttgggtttgggggaagaggaagactgacggtcccccaggagttcaggtgctgggcacagcggccctgggctgcctggtcaaggactacttcccatactcgtactgagcgggctggcaaggcgcatagn

SEQ ID NO: 218620 - DNA, 171 bp, Homo sapiens
  misc_feature: GYAE6OF01CYBBF.18.53.E09.1.454.CMB.1.raw
  modified_base (171)..(171): a, c, t, g, unknown or other
  misc_feature (171)..(171): n is a, c, g, or t
tcagtacgagtatgcacgaccggtgctcgatttagagagagtgtgttgggtttggggaagaggaagactgacggtccccaggagttcaggtgctgggcacagcggccctgggctgcctggtcaaggactacttcccatactcgtactgagcgggctggcaaggcgcatagn

SEQ ID NO: 218621 - DNA, 507 bp, Homo sapiens
  misc_feature: GYAE6OF01BGJCX.18.53.E09.1.454.CMB.1.raw
  modified_base (375)..(375): a, c, t, g, unknown or other
  misc_feature (375)..(375): n is a, c, g, or t
tcagtacgagtatgcacgaccggtgctcgatttagagagagtgtgttgggtttggggcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaagcccctaaagctcctgatctatgctacatccagtttgcaaagtcggggtaccatcaaaggttcagtggcagtggatctgggacagatttcacttctcaccatcancagtctgactaacctgaagtattttgactaactttactaactgtacaactagtagtttaacagttacccgtgttactttggacctaggggaccaaggctaggagatacaaacgaacgtgtaggctgcactac

SEQ ID NO: 218622 - DNA, 219 bp, Homo sapiens
  misc_feature: GYAE6OF01EJCS8.18.53.E09.1.454.CMB.1.raw
  modified_base (219)..(219): a, c, t, g, unknown or other
  misc_feature (219)..(219): n is a, c, g, or t
tcagtacgagtatgcacgaccggtgctcgatttagagagagtgtgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagn

SEQ ID NO: 218623 - DNA, 221 bp, Homo sapiens; identical to SEQ ID NO: 218617
  misc_feature: GYAE6OF01A4WK2.18.53.E09.1.454.CMB.1.raw
  modified_base (219)..(221): a, c, t, g, unknown or other
  misc_feature (219)..(221): n is a, c, g, or t

SEQ ID NO: 218624 - DNA, 183 bp, Homo sapiens
  misc_feature: GYAE6OF01D1BO4.18.53.E09.1.454.CMB.1.raw
  modified_base (174)..(183): a, c, t, g, unknown or other
  misc_feature (174)..(183): n is a, c, g, or t
tcagtacgagtatgcacgaccggtgctcgatttagagagagtgtgttgggtttgggggaagaggaagactgacggtcctcccaggagttcaggtgctgggcacagcggccctgggctcgcctggtcaaggactacttcccatactcgtactgagcggctggcaaggcgcatagnnnnnnnnnn

SEQ ID NO: 218625 - DNA, 264 bp, Homo sapiens
  misc_feature: GYAE6OF01C2FZ0.18.53.E09.1.454.CMB.1.raw
  modified_base (221)..(264): a, c, t, g, unknown or other
  misc_feature (221)..(264): n is a, c, g, or t
tcagtacgagtatgcacgaccggtgctcgatttagagagagtgtggttggggtttgggggaagaaggaagactgacggtcctcccaggagttcaggtgctgggcaccgtgggcatgggggaggtgtgtcacaagatttgggctctgggcacagcggcctgggctgcctggtcaaggactacttcccatactcgtactgagcgggctggcaaggcgcatagnnnnnnnnnnnnnnnnnnnnnnnnnnnnnnnnnnnnnnnnnnnn

SEQ ID NO: 218626 - DNA, 220 bp, Homo sapiens; identical to SEQ ID NO: 218613
  misc_feature: GYAE6OF01A00UX.18.53.E09.1.454.CMB.1.raw
  modified_base (219)..(220): a, c, t, g, unknown or other
  misc_feature (219)..(220): n is a, c, g, or t

SEQ ID NO: 218627 - DNA, 222 bp, Homo sapiens; identical to SEQ ID NO: 218616
  misc_feature: GYAE6OF01A0WH8.18.53.E09.1.454.CMB.1.raw
  modified_base (219)..(222): a, c, t, g, unknown or other
  misc_feature (219)..(222): n is a, c, g, or t

SEQ ID NO: 218628 - DNA, 173 bp, Homo sapiens; identical to SEQ ID NO: 218619
  misc_feature: GYAE6OF01DGG3E.18.53.E09.1.454.CMB.1.raw
  modified_base (173)..(173): a, c, t, g, unknown or other
  misc_feature (173)..(173): n is a, c, g, or t

SEQ ID NO: 218629 - DNA, 509 bp, Homo sapiens
  misc_feature: GYAE6OF01BMT2N.18.53.E09.1.454.CMB.1.raw
tcagtacgagtatgcacgaccggtgctcgatttagagagagtgtgttgggtttgggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaacaggaaagcccctaaagctcctgatctatgctacatccagtttgacaaagtggggtccatcaaggttcagtggcagtgatcgtggacagattcactctcaccatcagcagtctagcaacctgaacgtatttgactaacttactactgtacaacagtaacgttacacgtacccgtacgtacttttcggaccagggtaccaaggtctagggtagattacgaaaacgaactggtacggactacgcaaccgtac

SEQ ID NO: 218630 - DNA, 247 bp, Homo sapiens
  misc_feature: GYAE6OF01DW1GK.18.53.E09.1.454.CMB.1.raw
  modified_base (218)..(247): a, c, t, g, unknown or other
  misc_feature (218)..(247): n is a, c, g, or t
tcagtacgagtatgcacgaccggtgctcgatttagagagagtgtgttggggtttgggggaagaggaagactgacggtcctcccaggagttcaggtgctgggcaccgtgggcatgggggagtgtgtcacaagatttgggctctgggcacagcggcctgggctgcctggtcaaggactacttcccatactcgtactgagcgggctggcaaggcgcatagnnnnnnnnnnnnnnnnnnnnnnnnnnnnnn

SEQ ID NO: 218631 - DNA, 545 bp, Homo sapiens
  misc_feature: GYAE6OF01EEEE9.18.53.E09.1.454.CMB.1.raw
  modified_base (193)..(193): a, c, t, g, unknown or other
  misc_feature (193)..(193): n is a, c, g, or t
tcagtacgagtatgcacgaccggtgctcgatttagagagagtgtgttgggtttgggacagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagcttatttaaattggtatcagacaagaaaacagggaaacgcccctaagctcctgatctatgctacatccagtttcgactaaagtcggggtacccatcgaaggttcagtggactagtggatcgtaggactagtactttcactctaccactatcagctagtctacgacaactgaacgttatttcgactaacttactactcgtacaactagtacgttactacgttacccgtacgttacgtttggaccgtagggaacctaaggtcgtaggacgtaactaccgaaacgtacgtggtacggactcggcctactacg

SEQ ID NO: 218632 - DNA, 173 bp, Homo sapiens; identical to SEQ ID NO: 218619
  misc_feature: GYAE6OF01E4UBJ.18.53.E09.1.454.CMB.1.raw
  modified_base (173)..(173): a, c, t, g, unknown or other
  misc_feature (173)..(173): n is a, c, g, or t

SEQ ID NO: 218633 - DNA, 222 bp, Homo sapiens
  misc_feature: GYAE6OF01EJ1E5.18.53.E09.1.454.CMB.1.raw
  modified_base (220)..(222): a, c, t, g, unknown or other
  misc_feature (220)..(222): n is a, c, g, or t
tcagtacgagtatgcacgaccggtgctcgatttagagagagtgtgttgggtttgggggaagaggaagactgacggtcctcccaggagttcaggtgctgggcaccgtgggcagtgggggaggtgtgtcacaagatttgggctctgggcacagcggccctgggctgcctggtcaaggactacttcccatactcgtactgagcgggctggcaaggcgcatagnnn

SEQ ID NO: 218634 - DNA, 221 bp, Homo sapiens
  misc_feature: GYAE6OF01BE1EW.18.53.E09.1.454.CMB.1.raw
  modified_base (220)..(221): a, c, t, g, unknown or other
  misc_feature (220)..(221): n is a, c, g, or t
tcagtacgagtatgcacgaccggtgctcgatttagagagagtgtgttgggtttgggggaagaggaagactgacggtcctcccaggagttcaggtgctgggcaccgtgggcagtgggggaggtgtgtcacaagatttgggctctgggcacagcggccctgggctgcctggtcaaggactacttcccatactcgtactgagcgggctggcaaggcgcatagnn

SEQ ID NO: 218635 - DNA, 220 bp, Homo sapiens; identical to SEQ ID NO: 218613
  misc_feature: GYAE6OF01BX5FT.18.53.E09.1.454.CMB.1.raw
  modified_base (219)..(220): a, c, t, g, unknown or other
  misc_feature (219)..(220): n is a, c, g, or t

SEQ ID NO: 218636 - DNA, 220 bp, Homo sapiens; identical to SEQ ID NO: 218613
  misc_feature: GYAE6OF01DG2E6.18.53.E09.1.454.CMB.1.raw
  modified_base (219)..(220): a, c, t, g, unknown or other
  misc_feature (219)..(220): n is a, c, g, or t

SEQ ID NO: 218637 - DNA, 498 bp, Homo sapiens
  misc_feature: GYAE6OF01B9N9P.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaacagggaaagccctaagctcctgatctatgctacatccagtttgcaaagtgggtcccatcaaggttcagtggcagtggatctgggacagatttcactctcaccatcagcagtctgcaacctgaagtattttgactaattactactgtacaactagtacgttaactacgtacccgttcgtaacttttggccaggggaccaaggctaggagatacgaaacgaactgtaggctgcactacg

SEQ ID NO: 218638 - DNA, 174 bp, Homo sapiens
  misc_feature: GYAE6OF01B3DQV.18.53.E09.1.454.CMB.1.raw
  modified_base (173)..(174): a, c, t, g, unknown or other
  misc_feature (173)..(174): n is a, c, g, or t
tcagtacgagtatgcacgaccggtgctcgatttagagagagtgtgttgggtttgggggaagaggaagactgacggtcccccaggagttcaggtgctgggcacagcggccctgggctgcctggtcaaggactacttcccatactcgtactgagcgggctggcaaggcgcatagnn

SEQ ID NO: 218639 - DNA, 492 bp, Homo sapiens
  misc_feature: GYAE6OF01DL6IG.18.53.E09.1.454.CMB.1.raw
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtgggtcccatcaaggttcagtggcagtggatctgggacagatttcactctcaccatcagcagtctgcaacctgaagtattttgactaacttactactgtacaactagtagttacagtacccgttcgtacttttcggccagggaccaagctaggagatacaaacgactgtaggntgcnctac

SEQ ID NO: 218640 - DNA, 215 bp, Homo sapiens
  misc_feature: GYAE6OF01BBJYU.18.53.E09.1.454.CMB.1.raw
  modified_base (177)..(215): a, c, t, g, unknown or other
  misc_feature (177)..(215): n is a, c, g, or t
tcagtacgagtatgcacgaccggtgctcgatttagagagagtgtgttgggtttgggggaagaggaagactgacggtcccccaggagttccaggtgctgggtcacagcggccctgggctgcctggtcaaggacctacgttcccatactcgtactgagcgggctggcaaggcgcatagnnnnnnnnnnnnnnnnnnnnnnnnnnnnnnnnnnnnnnn

SEQ ID NO: 218641 - DNA, 221 bp, Homo sapiens
  misc_feature: GYAE6OF01DFGQU.18.53.E09.1.454.CMB.1.raw
  modified_base (218)..(221): a, c, t, g, unknown or other
  misc_feature (218)..(221): n is a, c, g, or t
tcagtacgagtatgcacgaccggtgctcgatttagagagagtgtgttgggtttggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnnn

SEQ ID NO: 218642 - DNA, 220 bp, Homo sapiens; identical to SEQ ID NO: 218613
  misc_feature: GYAE6OF01EC1N6.18.53.E09.1.454.CMB.1.raw
  modified_base (219)..(220): a, c, t, g, unknown or other
  misc_feature (219)..(220): n is a, c, g, or t

SEQ ID NO: 218643 - DNA, 225 bp, Homo sapiens
  misc_feature: GYAE6OF01CN53F.18.53.E09.1.454.CMB.1.raw
  modified_base (218)..(225): a, c, t, g, unknown or other
  misc_feature (218)..(225): n is a, c, g, or t
tcagtacgagtatgcacgaccggtgctcgatttagagagagtgtgttgggttggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcgatagnnnnnnnn

SEQ ID NO: 218644 - DNA, 542 bp, Homo sapiens
  misc_feature: GYAE6OF01CORUS.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagacagaaacaggaaacgacccctaagctcctgatctatgctacatccagttgacaaggtcgggtaccagtacgtaaggttcagtggacagtggatgtaggacagtatttcactctacaccatcagcagtctgacctaactgaagtatttcgactaacttactactcgtactaacgtagtattaccgacgttacccgttacgttacgtttcggaccgtacggggtaccaaggtccgtaggaacgtactaccgaaaacgtacgttaggtacggactcggcctaaccgtacg

SEQ ID NO: 218645 - DNA, 499 bp, Homo sapiens
  misc_feature: GYAE6OF01AI7S9.18.53.E09.1.454.CMB.1.raw
  modified_base (470)..(470): a, c, t, g, unknown or other
  misc_feature (470)..(470): n is a, c, g, or t
  modified_base (493)..(493): a, c, t, g, unknown or other
  misc_feature (493)..(493): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtcccatcaaggttcagtggcagtggatcgtgggacagatttcactctcaccatcagcagtctgcaacctgaagtattttgctaacttactactgtacaacagtagttacagttacccgtcgttactttggcctaggggaccaaggcgtaggagntacgaaacaacgtgtaggctgcncctacg

SEQ ID NO: 218646 - DNA, 595 bp, Homo sapiens
  misc_feature: GYAE6OF01DH1P6.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaacaggaaagcccctaagctcctgatctatgctacatcctagtttcaaagtgggtaccatcaaggttcagtggcagtgatcgtagggacagatttcactctcaccatcagtcagtctagacctaacctagaaagtattttgaccttaaactttaaccttacttacgttaacaacgtaacgtaacgtttaacctaacggtttaaccccgttaccggtttaccgtttttacgggaccccgtaagggggtaacccctaaggtaccgttagggaacgtaacgttaaccgaaaacggtaacgttcgggttacggacctggaaccctaccgacgtttacccg

SEQ ID NO: 218647 - DNA, 518 bp, Homo sapiens
  misc_feature: GYAE6OF01AV615.18.53.E09.1.454.CMB.1.raw
  modified_base (193)..(193): a, c, t, g, unknown or other
  misc_feature (193)..(193): n is a, c, g, or t
  modified_base (482)..(482): a, c, t, g, unknown or other
  misc_feature (482)..(482): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctatttaaattggtatcagcaagaaaacaggaaagcccctaagctcctgatctatgctacatccagtttgacaaagtggggtcccatacaaggttcagtggcagtggatcgtgggacagatttcactctcaccatcagcagtctcgacaacctgaagtattttgactaacttactactactacaacagtacgttacacggttacccgtcgttacgtttcggaccgtagggacctaaggctaggganactaccgaaacgtaacgtgtaggactcgccactacg

SEQ ID NO: 218648 - DNA, 509 bp, Homo sapiens
  misc_feature: GYAE6OF01DWRT9.18.53.E09.1.454.CMB.1.raw
  modified_base (271)..(271): a, c, t, g, unknown or other
  misc_feature (271)..(271): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaancccctaagctcctgatctatgctacatccagtttgcaaagtcgggtacccatcaaggttcagtggcagtggatcgtggacagtatttcactctcaccatcagcagtctgcaacctgaagtattttgactaacttactactgtacaactagtaacgttacacgttacccgttcgttaccgtttggaccgtagggaccaaggtcgtaggagatacgaaacgacgtgtgactcgcactacg

SEQ ID NO: 218649 - DNA, 174 bp, Homo sapiens
  misc_feature: GYAE6OF01AILUU.18.53.E09.1.454.CMB.1.raw
  modified_base (174)..(174): a, c, t, g, unknown or other
  misc_feature (174)..(174): n is a, c, g, or t
tcagtacgagtatgcacgaccggtgctcgatttagagagagtgtgttgggtttgggggaagaggaagactgacggtcctcccaggagttcaggtgctgggcacagcggccctgggctgcctggtcaaggactacttcccatactcgtactgagcgggctggcaaggcgcatagn

SEQ ID NO: 218650 - DNA, 544 bp, Homo sapiens
  misc_feature: GYAE6OF01ECW45.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagaccgagtcaccatcacttgtcgggcaatcaggataattaaaacctggttagttggtatcagcaagaaaaccaggaaaacgcccctaagctgacagatgattcggtccgtctagtttccaagtagtcggggccccagtcgagtacttccgcgtcagtggatcgtggacagtatttcactctacacatcagcacgcctgcagcctagaagtatttgactaacttactattgtacagcaggcacactaactttcccgcttcgtacgtttcggacggtaacgggaccgtaagggtacggaagtacgtacgaaacggtacgtaggtacggacgtacggacacctattcgtgttacc

SEQ ID NO: 218651 - DNA, 171 bp, Homo sapiens
  misc_feature: GYAE6OF01AGBX9.18.53.E09.1.454.CMB.1.raw
  modified_base (170)..(171): a, c, t, g, unknown or other
  misc_feature (170)..(171): n is a, c, g, or t
tcagtacgagtatgcacgaccggtgctcgatttagagagagtgtgttgggtttggggaagaggaagactgacggtccccaggagttcaggtgctgggcacagcggcctgggctgcctggtcaaggactacttcccatactcgtactgagcgggctggcaaggcgcatagnn

SEQ ID NO: 218652 - DNA, 533 bp, Homo sapiens
  misc_feature: GYAE6OF01DL2US.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaagcccctaagctcctgatctatgctacatccagttgacaaagtggggtacccatcaaggttcagtggcagtggatcgtgggacagtatttcactctcacatcagcagtctcgactaaccgtgaaacgtattttacgacttaacttactactcgtaccaactagtacgttactacgttacccgttcgttaacgtttcggaccgtaggggtaccaaggtcgtaggaagactaacgaaacgtaacgtggtacgctcgctacctacg

SEQ ID NO: 218653 - DNA, 527 bp, Homo sapiens
  misc_feature: GYAE6OF01C7SPB.18.53.E09.1.454.CMB.1.raw
  modified_base (491)..(491): a, c, t, g, unknown or other
  misc_feature (491)..(491): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaagcccctaaagctcctgatctatgactacatccagtttgacaaaggtgggtcccatcaaggttcagtggcagtggatcgtggacagtatttcactctcacctatcagcagtctcgcaacctgaagtattttgactaacttactaactgtacaactagtagttaacagttaccccgttcgttacctttggaccgacggggaccaaggtcctaggaacgtaanacgaaaacgaacgtgtacggactcggctacctaacg

SEQ ID NO: 218654 - DNA, 552 bp, Homo sapiens
  misc_feature: GYAE6OF01C6R0L.18.53.E09.1.454.CMB.1.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggnaagtcagancatagcagctatttaatgtatcagacaagaaaacagggaaacgaccctaagctcctagatctatgactacactccagtttgacgtaaaggtcgggtaccagtcgtaaaggttcaggtgacgagtggatcgtggacagtatttcactctcaccatacagcagtctgacaaccgtagaagtattttacgactaacttactactagtactaacgtagtacgttactacgttaccgtacgttacgtttcggaccgtaacgggaccaacggtacgtaggaacgtacgttaacgaaaacgtacgttacggtacgtacgtacgcctagtaaccg

SEQ ID NO: 218655 - DNA, 506 bp, Homo sapiens
  misc_feature: GYAE6OF01DCRZP.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccaggaaaagcccctaagctgcagatgattggtccgtccagtttccaagatcggggcccatcgagattccgcgtcagtggatcgtgggacagtatttcactctcaccatcagcagcctgcagcctgaagtattttgactaacttacttattgtcagtcaggccgcactaactttcccgcttccaccgtttcggcgggtacgggaccgaagggtggacgatacgaaacgaacgtgtacggctgacc

SEQ ID NO: 218656 - DNA, 718 bp, Homo sapiens
  misc_feature: GYAE6OF01BNMXF.18.53.E09.1.454.CMB.1.raw
  modified_base (272)..(272): a, c, t, g, unknown or other
  misc_feature (272)..(272): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaacagggaaacncccctaagctcctgatctatgctacatcctagtttgactaaaggtcggggtacccaagtactaaagggtttcaaggttcggacgtaggttggaacgttcgtaggggtaacaaggttaacttttccaaccttcccgttacctaaccccgtaactttaccgaacggtaccgtaaacggtttccgtacggtaaccctaaaaccccgttaggtaaaacggtttaacttttttacggaaaccctttaaacgtttaaacccttaacgtttacggttaacctaaaccgtaaggttaacgtttaacccgtaacggtttaacccccggttacgtttaaccggtttttacggaccccgtaagggggtaaacccctaaggtccgttagggaacgtaacgttaaccgtaaaaccggaaccgttagggttacggtaccttacgggcctaaccgttaacg

SEQ ID NO: 218657 - DNA, 488 bp, Homo sapiens
  misc_feature: GYAE6OF01D5H82.18.53.E09.1.454.CMB.1.raw
  modified_base (484)..(484): a, c, t, g, unknown or other
  misc_feature (484)..(484): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaacaggaaagcccctaagctcctgatctatgctacatccagtttgcaaagtggggtcccatcaaggttcagtggcagtggatctggacagatttcactctcaccatcagcagtctgcaacctgaagtattttgctaacttactactgtacaacagtagttacagtacccgtcgttactttggccagggaccaagctaggagatacgaaacgaactgtaggctgcnctac

SEQ ID NO: 218658 - DNA, 558 bp, Homo sapiens
  misc_feature: GYAE6OF01ED609.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaacgcccctaagctcctgatctatgctacatccagtttgacaaaggtcggggtacccatcaaggttcagtggcagtggatcgtgggacagtatttcactctcaccatcagcagtctgacaacctgaagtattttacgactaacttactactgtacaacagtagttacgtacgttacccgttcgttaacgttttcggacccgtaaggggaaccctaaggtcgtaagggaacgtaacgttaaccgaaaacggtaaccgttacggtacgggacttacggcctaaccttaacg

SEQ ID NO: 218659 - DNA, 518 bp, Homo sapiens
  misc_feature: GYAE6OF01AGKW0.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacaggaaagcccctaagctcctgatctatgctacatccagtttgcaaagtggggtcccatcaaggttcagtggcagtgatcgtgggacagatttcactctcaccatcagcagtctgccaacctgaagtatttgctaacttactactgtacaacagtacgttacacgttacccgtacgttacgttttcggccgtacggggacccaaggtcctaggacgtactacgaaacgaacgtggtacggactcggccaccgtacg

SEQ ID NO: 218660 - DNA, 533 bp, Homo sapiens
  misc_feature: GYAE6OF01CPALU.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatgtatcagacaagaaacaggaaacgcccctaagctcctgatctatgctacatccagtttgactaaagtcgggtaccagtacaaggttcagtgcagtgatcgtaggacagtatttcactctacacctatcagtcaagtctagacaacctagtaaagtattttacgactaactttactactagtacaaactagtagttaactaacgtacccgttacgttacgtttgaccgtagggtaccaaggctaggagacttaacgaaacgtacgtaggtacgagtcgacgacctacg

SEQ ID NO: 218661 - DNA, 220 bp, Homo sapiens; identical to SEQ ID NO: 218613
  misc_feature: GYAE6OF01EMVV8.18.53.E09.1.454.CMB.1.raw
  modified_base (219)..(220): a, c, t, g, unknown or other
  misc_feature (219)..(220): n is a, c, g, or t

SEQ ID NO: 218662 - DNA, 504 bp, Homo sapiens
  misc_feature: GYAE6OF01CHPT4.18.53.E09.1.454.CMB.1.raw
  modified_base (499)..(499): a, c, t, g, unknown or other
  misc_feature (499)..(499): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaagcccctaagctgcagatgattggtccgtccagtttccaagatcggggccccagtcgagtacttccgcgtcagtggatcgtgggacagtatttcactctcaccatcagcagcctgcacgcctagaagtatttcgactaacttacttattgtacagcaggcgcaactacttccgctctacgtttcggcggtagggaccaaggtggagtactaacgaaacgaactgtcggntgacc

SEQ ID NO: 218663 - DNA, 175 bp, Homo sapiens
  misc_feature: GYAE6OF01EBUPH.18.53.E09.1.454.CMB.1.raw
  modified_base (174)..(175): a, c, t, g, unknown or other
  misc_feature (174)..(175): n is a, c, g, or t
tcagtacgagtatgcacgaccggtgctcgatttagagagagtgtgttgggtttgggggaagaggaagactgacggtcctcccagaagttcaggtgctgggcacagcggccctgggctgcctggtcaaggactacttcccatactcgtactgagcgggctggcaaggcgcatagnn

SEQ ID NO: 218664 - DNA, 506 bp, Homo sapiens
  misc_feature: GYAE6OF01EBKD2.18.53.E09.1.454.CMB.1.raw
  modified_base (366)..(366): a, c, t, g, unknown or other
  misc_feature (366)..(366): n is a, c, g, or t
  modified_base (474)..(474): a, c, t, g, unknown or other
  misc_feature (474)..(474): n is a, c, g, or t
  modified_base (502)..(502): a, c, t, g, unknown or other
  misc_feature (502)..(502): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaacagggaaagcccctaagctcctgatctatgctacatccagtttgcaaagtggggtccatcaaggttcagtgcagtgatgtggacagtattcactctcacatacancagtctgcaactgaagtattttagactaacttactactagtacaactagtacgttacacgttacccgttcgttacgtttggacccgtaggggaccaaggcgtaggganacgtacaaacgtaactgtaggctcgccnctac

SEQ ID NO: 218665 - DNA, 535 bp, Homo sapiens
  misc_feature: GYAE6OF01CTRDH.18.53.E09.1.454.CMB.1.raw
  modified_base (392)..(392): a, c, t, g, unknown or other
  misc_feature (392)..(392): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaacaggaaagcccctaagctcctgatctatgctacatccagtttgacaaagtcggggtcccatcaaggttcagtggcagtggatcgtgggacagatttcactctcaccatcagcagtctgcaacctgaagtntttgctaactttactactgtacaacgtagtagttaccacgttacccgtcgttaacttttcggacccgtaaggggacccaaaggtccgtagggaacgaacgttacgaaaacggtaacttggtacggactacggccaaccgtacg

SEQ ID NO: 218666 - DNA, 574 bp, Homo sapiens
  misc_feature: GYAE6OF01A8VPU.18.53.E09.1.454.CMB.1.raw
  modified_base (434)..(434): a, c, t, g, unknown or other
  misc_feature (434)..(434): n is a, c, g, or t
tcagtacgagtatgcacgaccggtgctcgatttagagagagtgtgttgggtttggggcagtctcagtcaggacacagcatggacatgagggtccccgctcagctccgtggggctcctgctactctggctccgaggtgccagatgtgacatccagatgacccagtctccatccctccctgtctgcatctgtaggagacagagtcaccatcacttgccgggcaagtcagagcattagcagacttaatttaaattggtatcagacaagaaaacgagggaaacgacccctaagcctcctagatctatgactacatcctagtttagacgtaaaggtcggggtaccatcgaaggttcgagtggacaggtggatcgtagggactagtactttcacttctacaacctatcagctagtctagacctaaccgtagtaaacgttnttttacgacttaacttacttactcgtaacaacgtagtacgttactacgttacccgtgttacgttcggaccgtacgggacctaaggtcgtaggacgtactaaccgaaacgtaacgttcggtacgactacgcctaacctacg

SEQ ID NO: 218667 - DNA, 537 bp, Homo sapiens
  misc_feature: GYAE6OF01B0FJJ.18.53.E09.1.454.CMB.1.raw
  modified_base (269)..(269): a, c, t, g, unknown or other
  misc_feature (269)..(269): n is a, c, g, or t
  modified_base (379)..(379): a, c, t, g, unknown or other
  misc_feature (379)..(379): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcaagaaacagggaacnccctaagctctgatctatgctacatcctagttgacaaggtcgggtccattcaaggttcagtggcaggtgatcgtagggactagtctttacactctacacatcagcagtcngacactgaatatttacgactaacttactactcgtacaacgagtacgttactacgtacccgtcgttacgtttcgggaccgtacggggaccaggtccgtaggaacgtaacgtaccgaaaacggacgttagggtacggtactacggtcccgtaaccgtacg

SEQ ID NO: 218668 - DNA, 222 bp, Homo sapiens; identical to SEQ ID NO: 218616
  misc_feature: GYAE6OF01DARYE.18.53.E09.1.454.CMB.1.raw
  modified_base (219)..(222): a, c, t, g, unknown or other
  misc_feature (219)..(222): n is a, c, g, or t

SEQ ID NO: 218669 - DNA, 539 bp, Homo sapiens
  misc_feature: GYAE6OF01B0IQS.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctatttaaattggtatcagcaagaaaacagggaaacgcccctaagctcctgatctatgctacatccagtttgacgtaaaggtcggggtacccatcgaaggttcaggtggcagtggatcgtggacagtatttcactctcacatcagcagtctgacaactgaagtatttgactaacttactactgtaccaactagtagttaccaacgttacccgttacgttaccgtttcgggacccgtaggggtaaccaaggtcctagggacgtactaccgaaacgtacgtcggtcggtactcgccaccgtacg

SEQ ID NO: 218670 - DNA, 536 bp, Homo sapiens
  misc_feature: GYAE6OF01E4D8S.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagacaagaaaacagggaaacgcccctaagctcctgatctatgctacatcctagtttgacgaaaggtggggtacccagtacgaaggttcaggtggcaggtggatcgtgggacagtattcactctacacatcagcagtctgacctaacgtgtaagtatttagactaactttactactcgtacaacagtagttacacgttacccgttacgttacgtttggaccgtacgggaactaaggctagggaacgtactaacgaaacgtacgtaggtcggactcgccacgtac

SEQ ID NO: 218671 - DNA, 514 bp, Homo sapiens
  misc_feature: GYAE6OF01B4BML.18.53.E09.1.454.CMB.1.raw
  modified_base (269)..(269): a, c, t, g, unknown or other
  misc_feature (269)..(269): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagctatttaaatggtatcagcagaaaacagggaaanccctaagctcctgatctatgctacatccagtttgcaaagtgggtaccatcaaggttcagtggcagtggatcgtggacagtattcactctacacatcagcagtctgacaacctgaagtatttgactaacttactactgtacaacagtagttaactacgtaaccgtcgttacgtttcggaccgtacgggaaccgtaaggtcgtaggacgatacgaaaacgaacgtagtacgactgcccccataaccg

SEQ ID NO: 218672 - DNA, 224 bp, Homo sapiens
  misc_feature: GYAE6OF01CBU47.18.53.E09.1.454.CMB.1.raw
  modified_base (214)..(214): a, c, t, g, unknown or other
  misc_feature (214)..(214): n is a, c, g, or t
  modified_base (219)..(224): a, c, t, g, unknown or other
  misc_feature (219)..(224): n is a, c, g, or t
tcagtacgagtatgcacgaccggtgctcgatttagagagagtgtgttgggtttgggggaagaggaagactgacggtcctcccaggagttcaggtgctgggcaccgtgggcagtgggggagtgtgtcacaagatttgggctctgggcacagcggccctgggctgcctggtcaaggactacttcccatactcgtactgagcgggctggcaaggcgnatagnnnnnn

SEQ ID NO: 218673 - DNA, 224 bp, Homo sapiens
  misc_feature: GYAE6OF01DC6UI.18.53.E09.1.454.CMB.1.raw
  modified_base (220)..(224): a, c, t, g, unknown or other
  misc_feature (220)..(224): n is a, c, g, or t
tcagtacgagtatgcacgaccggtgctcgatttagagagagtgtgttgggtttgggggaagaggaagactgacggtcctcccaggagttcaggtgctgggcaccgtgggcagtgggggaggtgtgtcacaagatttgggctctgggcacagcggccctgggctgcctggtcaaggactacttcccatactcgtactgagcgggctggcaaggcgcatagnnnnn

SEQ ID NO: 218674 - DNA, 224 bp, Homo sapiens
  misc_feature: GYAE6OF01A09HB.18.53.E09.1.454.CMB.1.raw
  modified_base (219)..(224): a, c, t, g, unknown or other
  misc_feature (219)..(224): n is a, c, g, or t
tcagtacgagtatgcacgaccggtgctcgatttagagagagtgtgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnnnnn

SEQ ID NO: 218675 - DNA, 541 bp, Homo sapiens
  misc_feature: GYAE6OF01AJZNU.18.53.E09.1.454.CMB.1.raw
  modified_base (398)..(398): a, c, t, g, unknown or other
  misc_feature (398)..(398): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaacgcccctaagctcctgatctatgctacatccagtttgacaaaggtcggggtcccatcgaaggttcaaggtggcagtggatcgtggacagtattcactctcaccatcagcagtctgccaacctgaagtntttacgactaacttacctactcgtacaactagtaagttaccacgttacccgtacgtttacgtttcggaccgtacggggaccaaggtccgtagggacgtacgtaccgaaaacgtaacgtggtacggacctggacctaccgtacg

SEQ ID NO: 218676 - DNA, 233 bp, Homo sapiens
  misc_feature: GYAE6OF01B81AT.18.53.E09.1.454.CMB.1.raw
  modified_base (220)..(233): a, c, t, g, unknown or other
  misc_feature (220)..(233): n is a, c, g, or t
tcagtacgagtatgcacgaccggtgctcgatttagagagagtgtgttgggtttgggggaagaggaagactgacggtcctcccaggagttcaggtgcgtgggaaccgtgggcatgggggaggtgtgtcacaagatttgggctctgggcacagcggccctgggctgcctggtcaaggactacttcccatactcgtactgagcgggctggcaaggcgcatagnnnnnnnnnnnnnn

SEQ ID NO: 218677 - DNA, 519 bp, Homo sapiens
  misc_feature: GYAE6OF01AZTOT.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgactaaaggtggggtacccagtcaaggttcagtggacagtggatcgtgggacagtatttcactctcacctatcagcagtctgccaaccgtgaatatttagactaacttaatactgtacaacagtaacgttactacgtacccgtcgttactttggaccgtagggaccaaggcgtaggagtactaccgaaacgactcggtaggactcgctacgtac

SEQ ID NO: 218678 - DNA, 693 bp, Homo sapiens
  misc_feature: GYAE6OF01C2SWY.18.53.E09.1.454.CMB.1.raw
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgcgacgagtccccaggatcgtaccgaggtccggtcctaggtcccaaccgtcgtcctagtacgatcgtgtaggacgacagacgtcaccgtatacgacttggccggacaagtccagagcattagccaagtctaatttaagtcggtaatccagcaagaaacgngggaacncccgtaagctcctagatctagtgtacttacntacctagttcgacgtaagtccggtccagttcgaacgtttcgagtgacgtaggtcgagttccgagggacctaggtactttaccgacgtttaccacgtaaccgtaacgttccgacggtacgtaacgttccgtaccggaaccctaacggttacggaaacgtttacggttttacctttaaaccgttaccgttaacgttacgtaaccgtaaaccgttagttacccgttaactaccgggtttaccccctaggtttcgtttaacgggacccggagggtaaacccgtgtacggttcggtaacgaacggtttacgaaaaccgtgtttacggacgtaccttaagggccctaccgagtttcccgg

SEQ ID NO: 218679 - DNA, 521 bp, Homo sapiens
  misc_feature: GYAE6OF01CU8NS.18.53.E09.1.454.CMB.1.raw
  modified_base (271)..(271): a, c, t, g, unknown or other
  misc_feature (271)..(271): n is a, c, g, or t
  modified_base (408)..(408): a, c, t, g, unknown or other
  misc_feature (408)..(408): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcaagaaacagggaaacncccctaaagcctcctagatctatgctacatccagttcgacaaagtcggggtccagtactaaggttcaggtgacagtggatcgtgggactagtactttcactctacacatcagcagtcagacaaccgtgaagtatttnactaacttactactgtacaactagtagttacacgttacccgtagttacgttcggcgtacgggaccaagcgtaggaagtactaccgaaagtactggtacggatcgcaccgtacg

SEQ ID NO: 218680 - DNA, 220 bp, Homo sapiens
  misc_feature: GYAE6OF01BVMOB.18.53.E09.1.454.CMB.1.raw
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
tcagtacgagtatgcacgaccggtgctcgatttagagagagtgtgttgggtttgggggaagaggaagactgacggtcctcccaggagttcaggtgctgggcaccggtggcagtgggggaggtgtgtcacaagatttgggctcgtgggcacagcggccctgggctgcctggtcaaggctacttcccatactcgtactgagcgggctggcaaggcncatagn

SEQ ID NO: 218681 - DNA, 576 bp, Homo sapiens
  misc_feature: GYAE6OF01DFVRX.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagtcttaatttaaattggtatcaagacaagaaaacgagggaaacgacccctaagctcctgatctatgctacactccgtagtttgacgtaaggtcggggtacccagtacgtaaggttcaggtggacgtaggtggagtcgtaggactagtactttcacttctaccacctatacagctagtctacgacctaacgtaggtattacgtttcgaccttaaccttactacgtacgtaacaacgtagttacgttaccgtacgttacccgttcgttacgtttcggaccgacgggaccaggtcgtaggagtacgtaaccgaaacgtacgttcggcgtactcgcctactacg

SEQ ID NO: 218682 - DNA, 575 bp, Homo sapiens
  misc_feature: GYAE6OF01D6PF9.18.53.E09.1.454.CMB.1.raw
  modified_base (216)..(216): a, c, t, g, unknown or other
  misc_feature (216)..(216): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggnaagtcagagcattagcagctattaaattgtatcagcagaaaacaggaaagcccctaagctctgatctatgctacatccagtttgacaaagtggggtccatcaaggtcagtgcagtgatctggacagatttcactctcaccatcagtcagtctgacaaccttgaagtattttgactaacttaatactacgttacaacgtaagtaacgtttaactacgttaccccgtacgtttaaccgttttacgggacccgaacgggggtaaccctaaaggtccgtagggtaacggtaaacgttaacccgtaaaaaacggtaaacccgttgggttacgggtaaccgtttacgacccgtaaccgttaaccg

SEQ ID NO: 218683 - DNA, 559 bp, Homo sapiens
  misc_feature: GYAE6OF01BRYEU.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagacttaatttaaattggtatcagacaagaaaacgagggaaacgcccctaagctcctgatctatgctacatcctagtttgacgtaaaggtcggggtcccaagtcgtaaaggttcaggtggctaggtggatcgtaggactagtatttcactctacaccatcagtcagtctacgacctaaccgtgaaagttctttagacctaactttactactgtacaactagtacttaacacgttacccgttacgttactttacgaccgtagggaaccaaggtcgtaggaagacgttaccgaaaacgtacgttcggacggtactcgtccacgtacg

SEQ ID NO: 218684 - DNA, 503 bp, Homo sapiens
  misc_feature: GYAE6OF01D4OKG.18.53.E09.1.454.CMB.1.raw
  modified_base (271)..(271): a, c, t, g, unknown or other
  misc_feature (271)..(271): n is a, c, g, or t
  modified_base (475)..(475): a, c, t, g, unknown or other
  misc_feature (475)..(475): n is a, c, g, or t
  modified_base (499)..(499): a, c, t, g, unknown or other
  misc_feature (499)..(499): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaattggtatcagcagaaaacaggaacnccctaagctcctgatctatgctacatccagtttgacaaagtcggggtacccatacaaggttcagtggacagtggatcgtaggacagtatttcactctcacatcagcagtctgacaactgaatatttgactaacttactactgtacaacagtacgttacacgttaccgtacgttacgtttcggaccgagggacctaggctagganactacaaacgactggtcgatcgcnctac

SEQ ID NO: 218685 - DNA, 576 bp, Homo sapiens
  misc_feature: GYAE6OF01CY8BA.18.53.E09.1.454.CMB.1.raw
  modified_base (283)..(283): a, c, t, g, unknown or other
  misc_feature (283)..(283): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctcctgtctgcatcgtgtaggagacagagtcaccatcacgttcgccgggcaaggtcagagctattagcagtcttaatttaaatggtatcaagacaagaaaacgagggaaacncccgtaagctacctagtactctaatgactactactcctagttacgacgtaaggtcggtccagtacgtaaggtcgaagtggactaggtacgattcgtagggactagttacttcacgtacctacactatacagtactacgtctacgactaacgtagtaactattttacgacttaacttactactacgtaacaacgtagtaacgttacacgttaccgttacgtacgtttcggacgacggtaacacgcgtaggactaagacctaacggacgttaggtacgtactaccgctacgtacg

SEQ ID NO: 218686 - DNA, 495 bp, Homo sapiens
  misc_feature: GYAE6OF01DLBBM.18.53.E09.1.454.CMB.1.raw
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (466)..(466): a, c, t, g, unknown or other
  misc_feature (466)..(466): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacaggaaagcccctaagctcctgatctatgctacatccagtttgcaaagtggggtcccatcaaggttcagtggcagtgatcgtgggacagatttcactctcacatcagcagtcngcaactganattttgctaacttactactgtacaactagtagttaacagtacccgttcgtacttttcggaccgagggaccaagtctaggganatacgaaacgactgtacgctgctacgtac

SEQ ID NO: 218687 - DNA, 220 bp, Homo sapiens
  misc_feature: GYAE6OF01E3GCN.18.53.E09.1.454.CMB.1.raw
  modified_base (220)..(220): a, c, t, g, unknown or other
  misc_feature (220)..(220): n is a, c, g, or t
tcagtacgagtatgcacgaccggtgctcgatttagagagagtgtgttgggtttgggggaagaggaagactgacggtcctcccaggagttcaggtgctgggcaccgtgggcagtgggggaggtgtgtcacaagatttgggctctgggcacagcggccctgggctgcctggtcaaggactacttcccatactcgtactgagcgggctggcaaggcgcatagn

SEQ ID NO: 218688 - DNA, 221 bp, Homo sapiens; identical to SEQ ID NO: 218617
  misc_feature: GYAE6OF01BKYJA.18.53.E09.1.454.CMB.1.raw
  modified_base (219)..(221): a, c, t, g, unknown or other
  misc_feature (219)..(221): n is a, c, g, or t

SEQ ID NO: 218689 - DNA, 574 bp, Homo sapiens
  misc_feature: GYAE6OF01CCXKK.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaattggtatcagacaagaaaacgagggaaacacccctaagctcctgactctatcgctacatcctagtttgactaaaggtcggggtaccctaagtacgtaaaggttcaggttcggactaggtggatcgtggaacagtattcactctcacctatcagctagtctagactaacctagtaagtattttgactaacttactactgtacaacagtacgttacgacgttacccgttacgttacgtttcggaccgtaagggaccgtaaggtcgtagggaacgtaacgtaaccgaaaaccggtacgttacggtacggtaccgtacgccgtaccgtaacg

SEQ ID NO: 218690 - DNA, 224 bp, Homo sapiens
  misc_feature: GYAE6OF01BXKHI.18.53.E09.1.454.CMB.1.raw
  modified_base (221)..(224): a, c, t, g, unknown or other
  misc_feature (221)..(224): n is a, c, g, or t
tcagtacgagtatgcacgaccggtgctcgatttagagagagtgtgttggttttgggggaagaggaagactgacggtcctcccaggagttcaggtgctgggcaccgtgggcagtggggggaggtgtgtcacaagatttgggctctgggcacagcggccctgggctgcctggtcaaggactacttcccatactcgtactgagcgggctggcaaggcgcatagnnnn

SEQ ID NO: 218691 - DNA, 222 bp, Homo sapiens; identical to SEQ ID NO: 218616
  misc_feature: GYAE6OF01DDBAO.18.53.E09.1.454.CMB.1.raw
  modified_base (219)..(222): a, c, t, g, unknown or other
  misc_feature (219)..(222): n is a, c, g, or t

SEQ ID NO: 218692 - DNA, 536 bp, Homo sapiens
  misc_feature: GYAE6OF01DA6Y4.18.53.E09.1.454.CMB.1.raw
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagtctatttaaattggtatcagacagaaaacagggaaagcccctaagcctctagatctatgctacntccagtttgacaaggtcggggtccatcgtaaggtcaggtggcagtggatcgtgganagtatttcactctcacatcagcagtctcgctaactgaagtacttttgactaacttactacttgtacaactagtagttactacgttacccgtcgtttacgtttacggccgaacggggtaccaacggtcgtaggacgtaactaccgaaaacgtacgtaggtaccgagtacgcgtaacctacg

SEQ ID NO: 218693 - DNA, 553 bp, Homo sapiens
  misc_feature: GYAE6OF01CDQFY.18.53.E09.1.454.CMB.1.raw
  modified_base (370)..(370): a, c, t, g, unknown or other
  misc_feature (370)..(370): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagacttaatttaaattggtatcagacaagaaaacagggaaacgcccctaagctcctgatctatgctacatccagtttgacgtaaaggtcgggtacccagtacaaggttcagtgagagtggatcgtagggactagtntttcactctacacatacagcagtctgacaactagtaagtatttacgactaactttactacttacgtacaaacgtagtagttaacctacggttaacccgttcgttaaccgttttcggaccgtaacggggaacccaaggtcgtaggagactacgaaacgtacgtacgtacggactcgcgcctacg

SEQ ID NO: 218694 - DNA, 517 bp, Homo sapiens
  misc_feature: GYAE6OF01A6WGZ.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaacaggaaagcccctaagctcctgatctatgctacatcctagtttgcaaagtggggtcccatcaaggttcagtggcaggtggatctgggacaggtatttcactctcaccatcagcagtctgacaacctgaagtattttgctaacttactactgtacaacagtagttacacgttacccgtgttaccttttcgggaccgtagggaccctaaggcctagggacgtaacgtacaaacggaactgtacggactcgcacctacg

SEQ ID NO: 218695 - DNA, 645 bp, Homo sapiens
  misc_feature: GYAE6OF01DFD9Z.18.53.E09.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
tcagtacgagtatgcacgaccggtgctcgatttagagagagtgtgttgggtttggggcagtctcagtcaggacacagcatggacatgagggtccccgctcagctccgtgggctcctgctactctggctccgaggtgccagatgtgacatccagatgacccagtcctccatccctccctgtctgcatctgtagganacagagtcaccatcacgttcggccggganaagtcagagcattagcagtcttaatttaaatgtatcagacaagaaacgaaggaacgaccctaacgactcctgatctatgactactatcgtagttagacgaagtcgggtaccatacgtaaggtacgtagtaggtcgaggtaggacgttcggtacgggtaactaggttactttactaccttcctaccgtaacctatcgacgtacgtacgttacgtacgaccctaacgttaacgaagtttactttacgtaacctaacttttaacgtacttaacgaaccgtaaacgtaacgtacgtttaacctacggtttaaccccggttacgtttaacggtttacccggcggaaacggggtacctaaggtcgttagggaacgtaacttaacgtaaacggtacgtaggttcggacctacggtacctaccgttacg

SEQ ID NO: 218696 - DNA, 517 bp, Homo sapiens
  misc_feature: GYAE6OF01CR8Y6.18.53.E09.1.454.CMB.1.raw
  modified_base (225)..(225): a, c, t, g, unknown or other
  misc_feature (225)..(225): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagngcattagcagctattaaatggtatcagcagaaaacaggaaagcccctaagctcctgatctatgctacatccagtttgacaaaggtcggggtcccatacgtaaggttcagtggcagtggatcgtggacagatttcactctcacatcagcagtctcgcaacctgaagtattttgactaacttactactagtacaacagtacgttacacgttacccgtcgttaccgtttcggaccgtaggggtaccaaggcgtaggacgtactacgaaacgacgtggtacggctcgcaccgtacg

SEQ ID NO: 218697 - DNA, 694 bp, Homo sapiens
  misc_feature: GYAE6OF01AV1XT.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagcttatttaaattggtatcagacaagaaaacgaggaaacgcccctaagctcctgatctatgactacatcctagtttacgacgtaaaaggttcgggggtaccccaagtaccgtaagggttcaaggttggcgtaggttggacttcgtaggggactaggtactttacacttcctacacccattccaagtcaggtccttacggaccctaaacccgttagaaacgtttactttttacggaaccttaaacctttaaccgttaaccttacggttaaccctaaactaacgggtaacgtttaaaccgtaccggtttaacccccgtttacggtttaccgtttttaccggggaccgtaaaccgggggtaaccgtaaacggtccgttaagggtaacgtaacgttaacccgtaaaaaccggttacccgttacgggttacgggtacccgttacggaccccgtaaccgttacg

SEQ ID NO: 218698 - DNA, 573 bp, Homo sapiens
  misc_feature: GYAE6OF01BKH3M.18.53.E09.1.454.CMB.1.raw
  modified_base (192)..(192): a, c, t, g, unknown or other
  misc_feature (192)..(192): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctcctgtctgcatctgtagganacagacgtcaccatcacttcggccgggacaagtcagagctattagcagtcttaatttaattggtatacagacaagaaaacgagggaacaccctaagcctctagtatctatgactacatcctagttacgacgtaaacggtcggggtacccagtacgtaaaggttcaaggtcggacaggtggtactcgtaggactagtacttcactctacactatacancagtcngactaacgtgaagttatttacgacttaacttactacttcgtaacaacgtagtaacttaacgtacgttaccgttacgttacgtttcggacgtacgggaaccaggcgtaggacgtaactaaccgaaaacgtacgtaggtacggtatacggactacgtacg

SEQ ID NO: 218699 - DNA, 605 bp, Homo sapiens
  misc_feature: GYAE6OF01AX0MH.18.53.E09.1.454.CMB.1.raw
  modified_base (218)..(218): a, c, t, g, unknown or other
  misc_feature (218)..(218): n is a, c, g, or t
  modified_base (278)..(278): a, c, t, g, unknown or other
  misc_feature (278)..(278): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagtcttaatttaaattggtatcagacaagaaaacgagggaaacncccctaagcctccgtagatctatcgactacacttccgtagtttacgactaaaggtcgggtacccagtacgtaaggttcaggtcggacaggtggtagtcgtagggactagtacgtttacaccttcctacacctatacacgctagtactacgacctaacgtagaacttatttacgacttaacttacgtactacgtaactaacgtagtaacgttacgtacggttacccgttacgttacgtttacggaccgtaacgggtaacctaaggtccgtaggaacgtacgaaccgtaaaacgtacggttaggtacggtacgtcgaccgtacgtaccg

SEQ ID NO: 218700 - DNA, 584 bp, Homo sapiens
  misc_feature: GYAE6OF01DZW1A.18.53.E09.1.454.CMB.1.raw
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
  modified_base (365)..(365): a, c, t, g, unknown or other
  misc_feature (365)..(365): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctcctgtctgcatctggtaggagacagacgtcaccatcacgttgccggganaagtcagagcattagcagcttaatttaaatggtatcagcaagaaacgaggaaacnccctaagctacctagatctatcgactacatactagtttagacgtaaggtcggtaccagtactaaggttcaggtgactagtaggatcgnggactagtacgtttacaaccgtctacgaacctatacgagctaagtctacgacctactagtaacttactttcgaactaacttactaacgttctaacgtaaactaggtaattaaccgtacgttacccgtttagttacgtttacgggaccgtacgggtaacctaggtcgtaggtaaggtactaacgaaacgtacgttcggtacggactcgtacctaagtacg

SEQ ID NO: 218701 - DNA, 567 bp, Homo sapiens
  misc_feature: GYAE6OF01D43JA.18.53.E09.1.454.CMB.1.raw
  modified_base (193)..(193): a, c, t, g, unknown or other
  misc_feature (193)..(193): n is a, c, g, or t
  modified_base (273)..(273): a, c, t, g, unknown or other
  misc_feature (273)..(273): n is a, c, g, or t
  modified_base (401)..(401): a, c, t, g, unknown or other
  misc_feature (401)..(401): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagcttaatttaaatggtatcagacaagaaacagggaacnccctaagctactgatctatgactacatccagtttgacgtaaaggtcggggtacccagtacgtaaggttcaaggtggactaggtaggatcgtgggactagtatttcactctacacctatacagcagtcncgactaacgtagaagttatttcgactaacttactactacgtacaacagtacgttaactacgttacccgttacgtttacgtttcggaccggtaacggggaacctaaggtcgtagggaactaacgtaaccgaaacgtaacgtcggtacggtactacgacctacgtacg

SEQ ID NO: 218702 - DNA, 562 bp, Homo sapiens
  misc_feature: GYAE6OF01A7B9V.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaattggtatcagcaagaaaacagggaaacgcccctaagctcctgatctatgctacatcctagtttgactaaacggtcggggtacccagtacgtaaggttcagtggctaggtggatcgtgggacagtatttcactctacaccatcagcagtctacgcctaacctgaaagtattttacgacttaactttactacttcgtacaacagtacgttaactacgttacccgttacgttacgtttcggaccgtaggggaacccaaggtcgtagggagtaactaacgaaacgtaacgttacggtacggtacctcgacctacgtaacg

SEQ ID NO: 218703 - DNA, 727 bp, Homo sapiens
  misc_feature: GYAE6OF01ADZ9M.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctcctgtctgcatctgtaggagacagacgtcaccatcacttcggccgggacaagtcagagctattagcagtactaatttaattggtatcagacaagaaacgaggaacgacccctaagcctactgatctatcgactacatcagtttagacgtaaaggtcggggtacccagtacgtaaggttcgaggtcggacgtaggtaggtacgtacggtagggtaactaggttacttttaccgacctttacctaccgtaacccgtagttaccgaacggtccgtaagttcccgtacgtacccgtaaacccgttagtaaacggtttaactttttacggaaccctttaaaccgtttaaccgttaaccgttacggttaaaccctaaaccggtaacgggttaaaccgtttaaccgttaaacccgggttttaaccccggttacggtttaacccggttttaccggggaacccggtaaccgggggtaacctaacgggtccgttaaggggaactaacgtaacccggtaaaacgtaccggttgggtacggtaccgtacggtaccctacgttaccg

SEQ ID NO: 218704 - DNA, 582 bp, Homo sapiens
  misc_feature: GYAE6OF01ENOD5.18.53.E09.1.454.CMB.1.raw
  modified_base (98)..(98): a, c, t, g, unknown or other
  misc_feature (98)..(98): n is a, c, g, or t
  modified_base (256)..(256): a, c, t, g, unknown or other
  misc_feature (256)..(256): n is a, c, g, or t
tcagtacgagtatgcacgaccggtgctcgatttagagagagtgtgttgggtttggggcagtctcagtcaggacacagcatggacatgagggtcccccntcagcccctgggctcctgctactctggctccgaggtgccagatgtgacatccagatgacccagtctccatcctccctgtctgcatctgtaggagacagagtcaccatcacttgccgggcaagtcagagcattagcagacttatttaaattggtatcanacaagaaaacagggaaacgaccctaagctcctgactctatgctacatcctagtttgacgaagtcgggtccatcgaaaggttcacggtggactaggtggaattcgtgggactaagtacttttaccacctctacctaccaactacacgactacgtactgtacccaaccgtaggtaaacgtattttcgacttaacgttaacttactagtaccaatagtaacgttactaccgtacccgttcgttacgtttacggccgtaacggggtaccaaggtcgtacggaagtactaccgaaacgtagttcggtacggtactagactacctgttaccg

SEQ ID NO: 218705 - DNA, 787 bp, Homo sapiens
  misc_feature: GYAE6OF01C7HXQ.18.53.E09.1.454.CMB.1.raw
  modified_base (278)..(278): a, c, t, g, unknown or other
  misc_feature (278)..(278): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccggaggtgccagatgtgacatccagatgacccagtcctccatccctccctgtctgctatctgtaggagacagagtcaccatcacttggccgggcaagtcagagcattagcagctatttaaatggtatcagacaagaaaacgagggaaancccctaaagctacctgatctatgactactactcctagtttacgacgtaaaaggttcgggggtaccctaagttaccgtaaacgggtttccgaaggtttacgggaccgtaagggttacgggtaacgtttaccggttagggggtaaccttaagggttaactttttacccgaacctttaccgtaccctaaacccgtactttaaccgaacgtaccgtaacggttccgtaacggtaccgtaaaacccgtttaggtaaaagtttacttttttacggaaccctttaaacctttaccgtttaacgtttacgtaacccgtaaaacgtaaccgggttaacgtttaaaccggttaaccgggtttaacccccggtttacggttttaacccggtttttacggggaaccccgtaaagggggtaacccctaaaggggtaccgtaggggtaaacgttaacgttaaacccggtaaaacgtaacgggttacgggttaccggacctttacggaccctaacgtttacccg

SEQ ID NO: 218706 - DNA, 657 bp, Homo sapiens
  misc_feature: GYAE6OF01CLIQ4.18.53.E09.1.454.CMB.1.raw
  modified_base (202)..(202): a, c, t, g, unknown or other
  misc_feature (202)..(202): n is a, c, g, or t
  modified_base (625)..(625): a, c, t, g, unknown or other
  misc_feature (625)..(625): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccggaggtgccagatgtgacatccaggatcgacccagtccccttcttccgtgtctgcgtctggtaggagaccgngtcaccatcacttgcgggacaatcaggtatattaaacgtggttagtttggatcgagacaagaaaccgaaggaaaacgccccgtaagcctaggacaagatagacgtttcggtccgttaccgtagttttacccgaaaggtccggttccggggaccccctagtaccggagtaacgttccggcggtacgaggtggaactcggtagggaactagtacttcaactctacactagtcagtacacgtccgtcgacacgtaccgtaggtaagttaacgttttacgaacctttaactttacttaacgtttcgtactacgacggacggtacgtacctaacttaacccgtttcccgtccgttaccgtaccgggtttaccgggacgggtaacgggaacggtaaggtacggaagacgtaacgtaaacgtacgtaggngcgtcacgacgtactctagtcttctattcccg

SEQ ID NO: 218707 - DNA, 735 bp, Homo sapiens
  misc_feature: GYAE6OF01A8MCW.18.53.E09.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
tcagtacgagtatgcacgaccggtgctcgatttagagagagtgtgttgggtttggggcagtctcagtcaggacacagcatggacatgagggtccccgctcagctccgtggggctcctgctactctggctccgaggtgccagatgtgacatccagatcgacccagtctccatccctcctgtctgctatctgtagganacagagtcaccatcacgttcggccgganaagtcagagactattagctaagtcttaatttaaattggtactacagacaagaaaacgagggaaacaccctaagctctagatctatcgactacatacctagttacgacaaacggtcgggtacccagttacgtaaaggttcgaggttacggctaaggtggtaacgtcggttagggaacctaagttactttaccgaacgttccttaccgaacctacgtaccgaacgtacgtacgttaccgtacgaacctaaccgttagggtaaactttaacgtttttaccggaacccttaaacttttaacccttaacgttaacgttaacccgtaaaacgttaacggttaaacggttttaaccccgttaaacgggtttaaccccgtttaccggtttaaccgttttaccggggaaccgtaaaccggggtaaaccctaacgggtcggtaaccgggtaacgtaacttaaacccggtaaaaaggacggtttacgggtaccgtaagtaccgtaaccgtaaccgttaaccg

SEQ ID NO: 218708 - DNA, 571 bp, Homo sapiens
  misc_feature: GYAE6OF01A3OTI.18.53.E09.1.454.CMB.1.raw
  modified_base (273)..(273): a, c, t, g, unknown or other
  misc_feature (273)..(273): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatcacttggccgggcaagtcagagcattagcagcttatttaaatggtatcagcagaaaacagggaacnccctaagctcctgactctatcgctacatcctagtttgactaaaggtcggggtacccataccaaggttcaggtggacaggtggactcgtgggacagtacttcactctcaccatcagctagtctgacctaacctgtaaagtattttacgacttaacctttactaccgtagttacaacgtagtaacgttaccacgttacccgttcgttacgtttgggacctacggggaacctacggtcgtaggaacgtactaacccgtaaaagtacccgttaggtaccggacccgctaaccgtacgttccg

SEQ ID NO: 218709 - DNA, 526 bp, Homo sapiens
  misc_feature: GYAE6OF01DUYZW.18.53.E09.1.454.CMB.1.raw
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccggaggtgccagatgtgacatccagatgacccagtctccatcctccctgtctgcatctggtaggagacagagtcaccatcacttgccgggcaagtcagagcattagcagtctaatttaaattggtatcagacaagaaaacngggaaacnccctaagctctgactctatgctacatccagttgactaagtgggtcccatcgaagtcagtgcagtgatcgnggacagtatttcactctcacntcancagtcngactacgtgaacgtatttgactaacttactactagtacaactagtacgttaccacgttaacccgttcgttacgtttcggaccggtaagggtacccaaggtcgtaggagtactaacgaaacgaacgtgtacgggctacgcgtaactacg

SEQ ID NO: 218710 - DNA, 605 bp, Homo sapiens
  misc_feature: GYAE6OF01DRONV.18.53.E09.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
tcagtacgagtatgcacgaccggtgctcgatttagagagagtgtgttgggtttggggcagtctcagtcaggacacagcatggacatggagggtccccgctcagctccgtggggctcctgctactctggctccggaggtgccagatgtgacatccagatgacccagtctccatccctcctgtctgcatctgtagganacagagtcaccatcacgttgccggacaagtcagagctaattagcagtcttaatttaaattggtatcaagcaagaaaacgagggaaacncccctaagctcctgaatctatnctacactctaagtttgacgtaaaggtcgggtacccatacgaaggttcagtggcaggtgacgtcgtagggaactagtactttcaccttctaccaaccgataccgagtctaacgtctacgaccgtaaaccgtagtaaagttacttttacgaactaaacgtttaactacgttacgtaacaacgtagtaacttacgtaccgttacccgttagttacgttttcgggaccgaaggggtaaccaaggtcggtaggacgacttaaacgaaaaccgtacgttacggtacggatcgtaccacgttaacg

SEQ ID NO: 218711 - DNA, 528 bp, Homo sapiens
  misc_feature: GYAE6OF01CMYG4.18.53.E09.1.454.CMB.1.raw
  modified_base (516)..(516): a, c, t, g, unknown or other
  misc_feature (516)..(516): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctatttaaatggtatcagcaagaaacagggaaagcccctaagctcctgatctatgctacatcctagtttgacaaaggtcggggtacccatacgaaggttcaggttggcaggtggattcgtagggacagtatttcacgttctcaaccatcagcaagtctcgcaacctgaagtatttagactaacttactattcgtacaactagtattacacgttacccgtgttacctttggacccgtagggaccaagtcgtagggaatactaacaaacgtactggtacgntacgcaccctac

SEQ ID NO: 218712 - DNA, 784 bp, Homo sapiens
  misc_feature: GYAE6OF01A595V.18.53.E09.1.454.CMB.1.raw
  modified_base (507)..(507): a, c, t, g, unknown or other
  misc_feature (507)..(507): n is a, c, g, or t
tcagtacgagtatgcacgaccggtgctcgatttagagagagtgtgttgggtttgggcagtcggtcagtacaggacacagcatgggacatcgacgggtccccgcgtccaggcctcctggggcctcctgcctactctggcctccgaggtgccgagatggtcgacgactccagagtcgacccagtcctaccactccctcccgtgttcctggcctactcgtcggtaggaagtacacgtagttccaccgactccgtacgtacggccggacaagtcgagtacgtcgtaattacgtcgacgttacgtttaacttttaaagttacgggtaactacgaacgaaccgaaacggaaaaaccgaacgggaaaaccaccccgttaaagccttaccgttagtaactactaagtcgacctacgtacgtttaccgttagtttacgaaccgtaaacggttccggggtaccctagtaccgtaacggttacaggtcggacgtacggtcgtactacggtaggtaacncgttaacgtttccgaaccttccgtaaccgacctagtacggacgtacgtacgttacgttacgtacccgttaacgtgttaacgttagttttaccgacgttaacgtttaccgtaacgttagtaaccgtaacgtacggttaaccgttaccgttaccggttaaccggttaccgttaccgtttacggaccggtaaccgggaaccttaacggtcggtaacgggacgtaaccgttaccgaaaccgttccgtacggtacggtactccgtacccgtaacccgttacg

SEQ ID NO: 218713 - DNA, 568 bp, Homo sapiens
  misc_feature: GYAE6OF01CS7BB.18.53.E09.1.454.CMB.1.raw
  modified_base (193)..(193): a, c, t, g, unknown or other
  misc_feature (193)..(193): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccgggcaagtcagagcattagcagtcttaatttaaattggtatcagacaagaaaacagggaaacgccccgtaagctcctagatctatgctacatcctagtttgacaaaggtcgggtcccagtcgaaggttcaggtgcagtggntcgtggacagtattcactcncacatcagcagtctgactaaccgtgtaagtatttcgaactaactttactacgttgtacaactagtacgtttaacgtacgttacccgttcgtttaccgtttacgggacccgtaaggggtaccaaggtccgttaagggaacgtaactaaccgaaaacggtacttacgggtaggacccttggccctaacgttacg

SEQ ID NO: 218714 - DNA, 731 bp, Homo sapiens
  misc_feature: GYAE6OF01DKZO1.18.53.E09.1.454.CMB.1.raw
  modified_base (280)..(280): a, c, t, g, unknown or other
  misc_feature (280)..(280): n is a, c, g, or t
tcagtacgagtatgcacgaccggtgctcgatttagagagagtgtgttgggtttggggcagtctcagtcaggacacagcatggacatggacgggtccccgctcagctccgtggggctcctgctactctggctcgaggtgccagatgtgacatccagatcgaccctagtcctccactccctccctgtctgctatcgtggtaggagacagacgtaccaaccatctacgttcggccgggactaagtcagagactatagactagtacttaagtttaaagttgtanacaagaacaaacgaaaacggaacgggaaacctaccccgtaagtccttactagtactaccttaagtacgtactaacctacgttaccgttaacggttacgaaccggtaaacgggttccggggtaaccctaagtacgttaacggttcgaagggtcggtacgtaggtaggtacgtacggtaaggacctagttactacctacgtcctacacgtatacgagtactacgtcgtaacgaacctaacgttaggtaaactttacgtttaaccgaactttaaacgtttcctaacgttcaaaccgtaacgtaacggttaacgttaaccggtaccgtttacccgttagtttaccggttacgggaccgtacgggtaactaggtaaccggtaggtaaagtacccgtaaaccggtaaaacggttacggttaccggtacgtaccgtaccgtaacctaccggtttaacg

SEQ ID NO: 218715 - DNA, 556 bp, Homo sapiens
  misc_feature: GYAE6OF01BEE8W.18.53.E09.1.454.CMB.1.raw
  modified_base (278)..(278): a, c, t, g, unknown or other
  misc_feature (278)..(278): n is a, c, g, or t
  modified_base (407)..(407): a, c, t, g, unknown or other
  misc_feature (407)..(407): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccgggcaagtcagagcattagcagcttatttaaattggtatcagacaagaaaacgagggaaacnccccgtaagcctactgatctatgactacatcctagtttcgacgtaaaggtcggggtacccagtacgtaaggttcaggtggacgaggtggatcgtaggactagtatttcacttcacaccatcagcagtcngactaactagaattatttcgacttaacttactactgtacaagtagtacgttactacgttacccgttgttacgtttcggaccgacgggtaaccaaggtcgtaaggagtaacgtaccgaaaacgtacgtcggtaggacctgacctacgtac

SEQ ID NO: 218716 - DNA, 565 bp, Homo sapiens
  misc_feature: GYAE6OF01EVAY5.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagacttaatttaaattggtatcagacaagaaaacgaggaaacgcccctaagcctacctgatctatgactacatcctagtttagacgtaaaggtcggggtacccagtacgtaagggttcaaggtggacgaggtggtatcgtagggacagtactttcactctcacatcagctacgtctacgacctaaccgtagtaacgtattttacgacttaactttactactacgtacaactagtaacgttactacgttacccgttacgttacgtttacgggaccgtacgggaccaaggtcgtaggacgtactaccgaaacgacgtggtacgactgcacgtac

SEQ ID NO: 218717 - DNA, 626 bp, Homo sapiens
  misc_feature: GYAE6OF01B3C9B.18.53.E09.1.454.CMB.1.raw
tcagtacgagtatgcacgaccggtgctcgatttagagagagtgtgttgggtttggggcagtctcagtcaggacacagcatggacatgagggtcccccgctcagctcctggggctcctgctactctggctccgaggtgccagatgtgacatccagatgacccagtctccatccctccctgtctgcatctgtaggagacagagtcacatcacttgccggcaagtcagagcattagcagacttaatttaaattggtatcagacaagaaaacgagggaaacgacccctaagcctacctagatactatgactacactctagttgactaaaggtcggggtaccctagtacgtaaggttcgaggtcggacgtaggtggacgttacggtagggtaactagttaacttttccgaacttcccgttaccaacctaactaccgaacgtccgtaacgttacgtacgtaccgtaaaccgttagaacgtttattttacgaactttaacctttactacgttacgtaacaacgagttaacgtaccgtacgttacccgttagttaccgtttacggacgtacgggtactaaggcgtaggacgtaataccgtaaacgacgtaggtacgtactacgcctaccgtacg

SEQ ID NO: 218718 - DNA, 695 bp, Homo sapiens
  misc_feature: GYAE6OF01DDIQM.18.53.E09.1.454.CMB.1.raw
  modified_base (98)..(98): a, c, t, g, unknown or other
  misc_feature (98)..(98): n is a, c, g, or t
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (443)..(443): a, c, t, g, unknown or other
  misc_feature (443)..(443): n is a, c, g, or t
tcagtacgagtatgcacgaccggtgctcgatttagagagagtgtgttgggtttggggcagtctcagtcaggacacagcatggacatgagggtccccgntcagctcctggggctcctgctactctggctccgaggtgccagatgtgacatccagatgacccagtctccatcctcctgtctgcatctggtagganacagactcaccatcacgttggccggganaagtcaagagtctattagacagtacttaatttaaattggtatacgagacgaagaaaacgaagggaaacgaccccgtaagcctacctgactctaagtcgactacactaccgtagtttcgacgtaaaggtcgggtaccagtacgtaaagggtctaaggtcggactaggtaggtactcgttaggggaactacggtactttcaccttcgtaccacctatacgaacncgtaacgttcctacggacctaaaccggttaagtaaacgtttaacgtttttacgactttaaacctttacgtaaccgttaacgttaacctaaacggtaacgttaacgtttaaacccgtaacggtttaacccccggttacgtttaaccggttttaacgggacccggtaaaccgggggtactaaacggtcggttaaggaaggtaaccaacggtaaaaccgtacgttacggacggtacctcggtaaccacccttacg

SEQ ID NO: 218719 - DNA, 711 bp, Homo sapiens
  misc_feature: GYAE6OF01D2T8Q.18.53.E09.1.454.CMB.1.raw
  modified_base (199)..(199): a, c, t, g, unknown or other
  misc_feature (199)..(199): n is a, c, g, or t
tcagtacgagtatgcacgaccggtgctcgatttagagagagtgtgttgggtttggggcagtctcagtcaggacacagcatggacatgacgggtccccgctcagctccgtgggcctcctgctactctggctccgaggtgccagatgtgacatccagatcgacccagtcctccactccctccctgtctgcatctgtagganacagactccaacctatccacgttcggccggacaagtcgagacgactagttacgactagtactttaattttaaagttggttaatacgaagacgaaagtaaaaccggaacgggaaaccgtaccccgtaaagtccttaccgtagtacttctaagtcgtacttaactacttaccgtaggtttacgaacgtaaacgggtccggggttacctaagttacgtaacggttcgtaggtcggacgtaggtaggacttacggtaggtaactagttactttacctaccgtacctacctaaccgtactaccgacgtacctacgttacgtacgtaaccctaaaccgttaggtaaacgtttacttttaacgaacccttaaactttaaccgtacttacgtaacctaacgtaacggttaacgttaacctacggttacccgttacgttacgtttacggaccgtaacggggtaccaacggtcgtaggaactacgtaaccgaaagtacgtcggtacgactcgactacgtacg

SEQ ID NO: 218720 - DNA, 659 bp, Homo sapiens
  misc_feature: GYAE6OF01CKHJ5.18.53.E09.1.454.CMB.1.raw
  modified_base (196)..(196): a, c, t, g, unknown or other
  misc_feature (196)..(196): n is a, c, g, or t
tcagtacgagtatgcacgaccggtgctcgatttagagagagtgtgttgggtttggggcagtctcagtcaggacacagcatggacatgagggtccccgctcagctccgtgggctcctgctactctggctccgaggtgccagatgtgacatccagatcgacccagtcctccatccctccctgtctgcatctgtagganacagactaccaccatctacgttcggccgggacaaagtcaagacgtacaattagctaagtacttaatttaaagttggtatcaagacaaagaaaacgaagggaaacgtacccctaagcctacctagactctatcgactactactcctagttagacgtaaggtcggtaccagtacgtaaggttcgaggtcggacaggtcgtacgtcgtaggactagtactttaccgaccttacgtacaacctatacgaagtcgtacgtcgtcgtacctaaaccgtagtaacgttatttacgaactaacttactacgtacgtaactaacgtaacgtacgttaaccgtaccggttaacccgttcgtttaaccggtttaccggaccggtaaccggggtaacctaacgggtcgtaagggaacgtaacgtaaccgaaaacgtacggttacggtaccggacctacgtaccgtaccgttaacg

SEQ ID NO: 218721 - DNA, 595 bp, Homo sapiens
  misc_feature: GYAE6OF01BZ9OF.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttggccgggcaaggtcagagcagttagcagtcttaatttaaattggtatcagacaagaaaacaggaaacgcccctaagctctgatctatgactacatcctagtttcgacgaaaggttcggggtacccagtacgtaaggttacgaaggttggacgtaggtgggtaactcggttaggggaacctaggtatttaccaccgttctaccaacctagtcagtcgacgttctaggacctaaaccgtgtaagttactttcgaacttaacttacgtactgtaacaacgtaagtacgttactacggtacccgtacgttacgtttcggaccgacgggaactacggcgttagggactaagtaccaaacggtagtcggtacgagtcgactccgtaacg

SEQ ID NO: 218722 - DNA, 652 bp, Homo sapiens
  misc_feature: GYAE6OF01BMSW3.18.53.E09.1.454.CMB.1.raw
  modified_base (219)..(219): a, c, t, g, unknown or other
  misc_feature (219)..(219): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggnaagtcagagcattagcagcttaatttaaattggtatcagacaagaaaacgaggaaacgcccctaagcctacctgactctatgactacactaccgtagtttcgacgtaaacggtcggggtacccagttacgtaagggttcgaaggttcggacgtaggttggacgtcgtaggggaactaaggtacttttaccgaaccttacctaccgtaacctacgttaccaacggtactacggttacctacggaccttaaacccgttaaggtaaacgtttatttttacgaaccttaaaccgtttacctaacgttcggtaaccgtaacgtaaggtaacgtttaccgtaaccgttacccgttacgtttaacgtttcgggacgtaacggggacctaaggtcgtaggagtaactacgaaacgacgttggtacgacgtcgtccacgtac

SEQ ID NO: 218723 - DNA, 614 bp, Homo sapiens
  misc_feature: GYAE6OF01EM1LH.18.53.E09.1.454.CMB.1.raw
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtccaccatcacttgccgggcaagtcagagcattagcagcttaatttaaattggtatcagacaagaaaacgagggaaacncccctaagctcctgatctatgctanacttcagtttgacgtaaaggtcggggtacccatacgtaaggttcaaggtcggacgagtggactcgtaggggtacaaggtactttacacgttcctaccaacctatacgaacgtcgtaacgtctacgacctaacccgttagtaaacgttattttacgacttaaccttacttacgtagttacaaacgtagtacgttaacctacggttacccgttacgtttaccggtttcggacccgtaaggggaaccctaaggtccgtagggtaacgtacgtaaccgaaaacgtacgttggtacgtactcgaaccgtcgtacg

SEQ ID NO: 218724 - DNA, 575 bp, Homo sapiens
  misc_feature: GYAE6OF01BH89Z.18.53.E09.1.454.CMB.1.raw
  modified_base (430)..(430): a, c, t, g, unknown or other
  misc_feature (430)..(430): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggcaagtcagagcattagcagcttaatttaaattggtatcagacaagaaaacgaggaaacgcccctaagcctcctagatctatgactacactacctagtttacgacgtaaaggtcggggtacccagtacgtaaggttcgagtggacgtaggtggatcgtgggaactagtactttacactctaccacatcagcagtcacgacctaacgtgtaacgttntttacgacttaacgttactacgtcgtaacaacgtagtaacgttaccgacgttacccgttacgtttacgtttcggaccgtaacgggtacctaaggtcgtagggacgtataacgaaacgtacgtcggacgtactacgcctacgtacg

SEQ ID NO: 218725 - DNA, 668 bp, Homo sapiens
  misc_feature: GYAE6OF01DMWUT.18.53.E09.1.454.CMB.1.raw
  modified_base (226)..(226): a, c, t, g, unknown or other
  misc_feature (226)..(226): n is a, c, g, or t
tcagtacgagtatgcacgaccggtgctcgatttagagagagtgtgttgggtttgggcagtctcagtcaggacacagcatggacatgagggtccccgctcagctccgtggggctcctgctactctggctccgaggtgccagatgtgacatccagatcgacccagtctccatccctcctgtctgcatcgtgtaggagacagacgtcaccatcacgttcggaccggganaagtcaagagctaattagcagtacttaatttaaagttggtatacacgaacgaaacggaaaacgaggggaaacctacccctaaagccttaccgtagtacttactagtcgtactaactacttaccgtagtttacgacgtaaaggtcggggtaccctaagtaccgtaaggttcgaaggtcggacgtaggtgacgtcggtaggactagttacttccgaactcctacacgtactcgagtacgtagtctacgacctaacgttagtaacgtttatttacgaacctttaacgtactacgtacgtaacaacggtaagttaccgttaaaccgtacggttaaccccgttacgttacggtttaccggaaccgggaaccgggtaaactacggtccgtaaggaaccgtaacgtaccgaaaacgtacggtcgaccggtagaccgtacctacggttac

SEQ ID NO: 218726 - DNA, 678 bp, Homo sapiens
  misc_feature: GYAE6OF01B6T53.18.53.E09.1.454.CMB.1.raw
  modified_base (662)..(662): a, c, t, g, unknown or other
  misc_feature (662)..(662): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagtactaatttaaattggtatcagacaagaaaacgaagggaacgacccctaagcctcctgtactactatgactacactacctagtttacgacgtaaacggtcggggtcccagttaccgtaaagggttccgaggtcggacgtaggtaggtacttcggtagggtaactaacggtacttttaccgaaccttccttacccgaaccctaacgttaccgaacggtaccgtaacggttcctacggtaaccctaaacccgttaggtaaacgtttacttttacgtaacccttaaacgttttaacctacgttacgtaaccaaacgtaacgtaacgttaaccgtaccgttacccggttacgttaccgtttacggaccggtacgggaaccgtaacggtccgtaggaacgtaacgtaccaaaaccggtacgtcggtacggntacgccaaccgttacg

SEQ ID NO: 218727 - DNA, 519 bp, Homo sapiens
  misc_feature: GYAE6OF01ATQNA.18.53.E09.1.454.CMB.1.raw
  modified_base (218)..(218): a, c, t, g, unknown or other
  misc_feature (218)..(218): n is a, c, g, or t
  modified_base (373)..(373): a, c, t, g, unknown or other
  misc_feature (373)..(373): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctatttaaatggtatcagcagaaaacaggaaacgcccctaagctcctgatctatgctacatccagtttgactaaagtggggtaccatcaaggttcagtggcagtgatcgtggactagtatttcactctcaccatcancagtctagcaacctagaagtatttgactaacttactactgtacaacagtacgttactacgttaccgtacgttacgtttcggaccgtaagggacctaagcgtagggaagactacgaaacgacgtacgtacggactcgcctacgtacg

SEQ ID NO: 218728 - DNA, 625 bp, Homo sapiens
  misc_feature: GYAE6OF01C95XW.18.53.E09.1.454.CMB.1.raw
  modified_base (223)..(223): a, c, t, g, unknown or other
  misc_feature (223)..(223): n is a, c, g, or t
  modified_base (613)..(613): a, c, t, g, unknown or other
  misc_feature (613)..(613): n is a, c, g, or t
tcagtacgagtatgcacgaccggtgctcgatttagagagagtgtgttgggtttggggcagtctcagtcaggacacagcatggacatgagggtccccgctcagctccgtggggctcctgctactctggctccgaggtgccagatgtgacatccagatgacccagtcctccatccctccctgtctgcatctggtaggagacagagtcaccatcacttggccgggnaagtcagagcattagcagtacttaatttaaattggtatacagacaaagaaaacgagggaaacgacccctaagcctacctagatctatcgactaacactaccgtagtttacgacgtaaggtcgggtaccctaagtaccgtaaaggttcgaaggtggacgtaggtaggacttcggtaggggaactaggttactttcgactacctaccaacctatcacggctaggtacctcgacctaaccgtaggtaattacgttttacgaacttaacctttacgtacttacgtaacaaacgtagttaacgttacgtacgttaacccgttgttaccgttacggaccggacgggtaccaaggtcgtaaggacgtaactaacgaaacgtacgtggtacgacctcncctaacgttacg

SEQ ID NO: 218729 - DNA, 550 bp, Homo sapiens
  misc_feature: GYAE6OF01CD93C.18.53.E09.1.454.CMB.1.raw
  modified_base (275)..(275): a, c, t, g, unknown or other
  misc_feature (275)..(275): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccggcaagtcagagcattagcagacttatttaaattggtatcagacaagaaaacgagggaaacncccctaagctctagactctatgctacatcctagtttgacgtaaaggtcggggtacccagtacgtaaggttcaggtgcgaggtggatcgtaggacagtatttcactctacacatcagctagtcacgacaaccgttgagtatttcgactaacttactactatacaactagtacgttaacgtacgtaccgttacgttacgtttcggaccgaacgggtaccaaggtcgtaggaacgtactaaccgtaaagtacgtggtacggtactacggctacgtacg

SEQ ID NO: 218730 - DNA, 640 bp, Homo sapiens
  misc_feature: GYAE6OF01CY0MQ.18.53.E09.1.454.CMB.1.raw
tcagtacgagtatgcacgaccggtgctcgatttagagagagtgtgttgggtttggggcagtctcagtcaggacacagcatggacatgagggtcccccgctcagctcctgggctcctgctactctggctccgaggtgccagatgtgacatccagatgacccagtctccatccctcctgtctgcatctgtaggagacagagtcaccatccacgttcggccgggacaagtcagagcattagcagtctaatttaaagtggtatcagcaagaaaacaggaaacacccctaagctacctgatcctatcgctacactccgtagtttcgacgtaaaggtcggggtaccctagttacgaaggttccgaggtggacgagtaggacttacggtaggacctagtacttttccaacgttcctaccaacccgtatcgaacgtctacgttacctacgtaacctaaccgtagtaaagttacttttacgaaccttaactttacctaacttcgtaactaacgtaagttacgttaacctaccgtttacccgttacgtttaccgtttcgggaaccggtaacggggaccgtaacggtcgtaaggtaagtaaacgtaccgaaaacggtacgttggtacggtacttcgacctacccgttaacg

SEQ ID NO: 218731 - DNA, 224 bp, Homo sapiens; identical to SEQ ID NO: 218673
  misc_feature: GYAE6OF01C3DK1.18.53.E09.1.454.CMB.1.raw
  modified_base (220)..(224): a, c, t, g, unknown or other
  misc_feature (220)..(224): n is a, c, g, or t

SEQ ID NO: 218732 - DNA, 225 bp, Homo sapiens
  misc_feature: GYAE6OF01ERPDO.18.53.E09.1.454.CMB.1.raw
  modified_base (221)..(225): a, c, t, g, unknown or other
  misc_feature (221)..(225): n is a, c, g, or t
tcagtacgagtatgcacgaccggtgctcgatttagagagagtgtgttgggtttggggggaagaggaagactgacggtcctcccaggagttcaggtgctgggcaccgtgggcagtgggggaggtgtgtcacaagatttgggctctgggcacagcggccctgggctgcctggtcaaggactacttcccatactcgtactgagcgggctggcaaggcgcatagnnnnn

SEQ ID NO: 218733 - DNA, 646 bp, Homo sapiens
  misc_feature: GYAE6OF01BQAPC.18.53.E09.1.454.CMB.1.raw
  modified_base (218)..(218): a, c, t, g, unknown or other
  misc_feature (218)..(218): n is a, c, g, or t
  modified_base (282)..(282): a, c, t, g, unknown or other
  misc_feature (282)..(282): n is a, c, g, or t
  modified_base (454)..(454): a, c, t, g, unknown or other
  misc_feature (454)..(454): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagataacccagtctccatcctccctgtctgcatctgtaggagacagagtcaccatcacttgccgganaacgtcagacgcattagcagtacttaatttaaatggtatcgagacaaagaaaacgagggaaacncccctaagcctaccgtgactctatgtacctactactccgtaggtttcgaacgtaaagggtccggtaccctagtacgtaacggttcaaggtggacctagggtaggatcggtagggactaggtactttccgaccgttcgtaccctaactactacgtacgtacgtacgttaccgngtaaccctaacgtagtaacttagttttacgaccttaaacgtttactacgtacgtaaccaacgttacggtaacgtttaaccaccggtttaccgttaccgtttacggtttaccggaccggtaacgggtaaccgacgtaccgtaggactaagtaccgaaacgttacgtcggtcgtactacgactacgtacgttcg

SEQ ID NO: 218734 - DNA, 973 bp, Homo sapiens
  misc_feature: GYAE6OF01D6TKS.18.53.E09.1.454.CMB.1.raw
tcagtacgagtatgcacgaccggtgctcgatttagagagagtgtgttgggtttggggcagtctcagtcaggacacagcatggacatgagggtccccgctcagctccgtggggcctcctgctactctggctccgaggtgccagatgtgacatccagatcgacccagtctccatccctccctgtctgctatcgtggtaaggagacagacgtccaaccctatccgaccgttcggacccggggtacaaaggtccaaggaacgtcctaagtttaacggcctaaggtacctttaaattttaaaacgtttgggttaattaccgaagaacgaaaacggaaaaaaccggaacggggtaaaaccggtaccccccttaaaggtaccgtttaccccttaggtaacttaccgttaacttcggtacctttaacctaccgttaccgttaacggtttttaaccgaaccggtaaaaaccgggtttccggggggttaaccccaagtttacccggtaaaacggggtttaccgtaacggggttacggtaccggtaagggttacgggttaacggtacggggtttaaccggggtaacgtaaacggttttaaccgtttttaccgaaccgttttaccccgtaccccttaaacccgtaacgtttacccggaaaccggttcgaaccggtttacccgttacggaaaccccgttaaacccgggttaacgggtaaaacgtttttacgtttttaacccggtaaaccgtttttaaacccttttaaccgtaacggtttaccttaaaccgaaaaccgtttaagggtttaaaccccgtttaaccgtaaaacccggttttcccccgggttaaggtttttaaccccggtttaccggggtaacccggtaaccggggtaaaccgttaacgggtcgttaagggtaacggtaaaccctaaacggtaaaacgtaacggttgggtaaccggtacttccggaaccctacgttaccg

SEQ ID NO: 218735 - DNA, 732 bp, Homo sapiens
  misc_feature: GYAE6OF01CY1M7.18.53.E09.1.454.CMB.1.raw
  modified_base (169)..(169): a, c, t, g, unknown or other
  misc_feature (169)..(169): n is a, c, g, or t
  modified_base (200)..(200): a, c, t, g, unknown or other
  misc_feature (200)..(200): n is a, c, g, or t
tcagtacgagtatgcacgaccggtgctcgatttagagagagtgtgttgggtttggggcagtctcagtcaggacacagcatggacatgagggtcccccgctcagctccgtggggctcctgctactctggctccgaggtcgccagatgtgacatccagatcgacccagtcnccactccctccctgtctgcatcgtgtagganacgagacgtcacctatcacgttcggaccggacaagtcgaagacgacctaagttacgactaagtactttaattttaaaagttggtaactacgaagactaaaggaaaacgaagggaaaccctccccgtaagtcctacctagtactctaagtcacctactactacgtagttacgacgtaaggtccgggtacctaagtacggtaagttacgaggtacggacgtagggtcgtagtcggtaggtacctagttactttaccgactaccttacaaccctagtaccgaacgtcgtacgtacctaggaaccctaacggttaagtaaacgtttacgtttaacgaacccttttaacggttacctaacgttcgtaaaacctacggttaaacggttaaccgttacccgtaaccgtttacccggtacgtttacccggtttagggacccgggtaaacgggttaacccgaaggttccggtaaagggtaactaaaccggtaaccggttaaacgggtttaccgcggaacccttacgaccgttaacccgttc

SEQ ID NO: 218736 - DNA, 570 bp, Homo sapiens
  misc_feature: GYAE6OF01EQTMB.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgacccagtcctccatccctccctgtctgcatctgtaggagacagagtcaccatcacttgccggcaagtcagagcattagcagtcttaatttaaattggtatcagacaagaaaacagggaaacgcccctaaagcctcctagatctatgctacatcctagtttgacgaaagtcggggtacccagtacgaacggttcaggtcggactaggtgatcgtggactagtattcactctacacatacgagctacgtctcgaccaacgtgaaagttagttttgaccttaaccgtttactaacgttacgtacaaacgtagtaacgtttaacctacgttacccgttcgttaactttcgggacccgtagggacctaggtcgtagggaatacgtacgaaaacgtacgtggtacgatcgcaccgtacg

SEQ ID NO: 218737 - DNA, 592 bp, Homo sapiens
  misc_feature: GYAE6OF01AWT4A.18.53.E09.1.454.CMB.1.raw
  modified_base (228)..(228): a, c, t, g, unknown or other
  misc_feature (228)..(228): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttggccgggcaagtcagngcattagcagtctatttaatggtatcagacagaaaacagggaaacgcccctaagctcctgactctatgactacgatctagtttagactaaaggtcggggtacccagtactaagggttcagtggcgagtggatcgtaggggactaggtactttccacgttcctaccacctactcaagccgtacgtcgtacgaccaaccgttagaagttacttttacgaactaactttacctaacttcgtaacctaacgtagtaacgttacctaacggttacccgttacgttacgttttcgggaccgtaacggggtaaccaaggtcgtagggacgacgtacgtaaacgtacgtacgtcggtactcgcctacgtacg

SEQ ID NO: 218738 - DNA, 839 bp, Homo sapiens
  misc_feature: GYAE6OF01AGNB0.18.53.E09.1.454.CMB.1.raw
  modified_base (422)..(422): a, c, t, g, unknown or other
  misc_feature (422)..(422): n is a, c, g, or t
tcagtacgagtatgcacgaccggtgctcgatttagagagagtgtgttgggtttggggcagtctcagtcaggacacagcatggacacgagggtccccgctcagctcctggggctcctgctgctctggctcccaggttccagatgcgacatccagatcgacccacgtccccttcttccgtgtctgcgtctgtaggacgaccgagtcaccatcacgttggtcgggacaatcgaggaattaacttaaaaccgtggtttagtttgtatcagacgaacgaaaaccgaaggaaaaccgccccgtaagccgtagacagtacgtagtacgttcggtcccgtcctacgtttaccgaagcgtccgggcccagtaccgagtacttccgcgtacgagtgactcgtaggactagtactttccactctaccacgtancgacgccacgcctgaccgtacgtaccgtaaggtaacgttacgttttacgaacgttaaccttttaacgttacgtttccgtaacgaccgggtaccgtaaccggggtaacccgtaccttaaaccccgtttaacccgttttccccccgggtaaccgtttacccccggtttaacccggggtttttacccgggggaaccccgggggttaaacccgggggttaaaccccggtaagggggttaacccgggaaaacggttaacccgtttaaaaaccccgggtaaaaaccgggtttaacccgggttaggggttaaccccgggtaccgttaacccgggtaaccctaaaccccgtttaacggtttccccggttttaacgttacccccgttttaccgttaacccccggttttcccccgttaaccccccgg

SEQ ID NO: 218739 - DNA, 606 bp, Homo sapiens
  misc_feature: GYAE6OF01D475P.18.53.E09.1.454.CMB.1.raw
  modified_base (220)..(220): a, c, t, g, unknown or other
  misc_feature (220)..(220): n is a, c, g, or t
  modified_base (281)..(281): a, c, t, g, unknown or other
  misc_feature (281)..(281): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccgggnaagtcagagcattagcagtacttaatttaaattggtaatcagacaagaaaacagggaaacnccctaagctacctgactctatcgactacactcctagtttcgactaaaggtcggggtcccagtacgtaaggttcaggtggctaggtggtagtcgtagggaactagtactttcaactctccaactatcagtctagtctacgactaacgttagtaagttacgttttacgaccttaaacctttactaacttacgtaacgaaccgtaaggtaacgtttaacgaacggttaaccccgttacggtttacgtttcgggaccgtacggggaacctaggccgtaggaacgtagtaaccgaaacgtaaccgttggtacgatcggacctaccgtacg

SEQ ID NO: 218740 - DNA, 705 bp, Homo sapiens
  misc_feature: GYAE6OF01CNH0J.18.53.E09.1.454.CMB.1.raw
  modified_base (95)..(95): a, c, t, g, unknown or other
  misc_feature (95)..(95): n is a, c, g, or t
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagtacgagtatgcacgaccggtgctcgatttagagagagtgtgttgggtttgggcagtctcagtcaggacacagcatggacatgaggtccccntcagctcctgggctcctgctactctggctccgaggtgccagatgtgacattccagatgacccagtctccatccctcctgtctgctatctgtagganaccagatcacctatcacttgccggtanaagtcagcgctagttacgctaggtaccttaagtttaaagtggtaactcgagtacaaaggaaaaccgtagggtaaactcccccgttaaaggtccttaccgtaggtaacttccgttaacgtacgtaccttaaccgtaacgttaccgtaaggtttacggaaccgtaaaacggttccggggttaccctaagttaccgtaagggttcgaaggttacggaccgtaaggtcggtacgtacggtagggtaactacggtactttaccgaccttacctaccgacctagtaccgagtccgtacgtctacgtacctaacgtacgtaagtcgtttacgaccttaacgttacgtacgtcgtaaccgtaacgagttaaccgttaacgtaccgtttacccgtacggtttaaccgttccgggaaccgttacgggaactacggtcgtaggtaacctacgtaaccgtaaacgtacgttcggtacgtctacggtcctaacggttacg

SEQ ID NO: 218741 - DNA, 543 bp, Homo sapiens
  misc_feature: GYAE6OF01BTZO7.18.53.E09.1.454.CMB.1.raw
  modified_base (270)..(270): a, c, t, g, unknown or other
  misc_feature (270)..(270): n is a, c, g, or t
  modified_base (375)..(375): a, c, t, g, unknown or other
  misc_feature (375)..(375): n is a, c, g, or t
  modified_base (418)..(418): a, c, t, g, unknown or other
  misc_feature (418)..(418): n is a, c, g, or t
tcagtacgagtatgcacgaccggtgctcgatttagagagagtgtgttgggtttgggcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgaccgggcaagtcagagcattagcagctatttaattggtatcagacaagaaacgaggaacnccctaagctctagatctatgactacatctagtttgacgtaaggtcgggtccagtctaaggttcagtggacagtgatcgtggacagtacttcactctcacatacancagtctagacaacgtagaatatttcgacttaacttacttactntaacaactagtacgttacgacgttacccgttacgttacgtttcggaccgtaacggggtaccaaggtccgtagggaactacgtaaaccgaaacggtaacgttgggacgtacgtcgcctaacgtacg

SEQ ID NO: 218742 - DNA, 783 bp, Homo sapiens
  misc_feature: GYAE6OF01DKXHE.18.53.E09.1.454.CMB.1.raw
tcagtacgagtatgcacgaccggtgctcgatttagagagagtgtgttgggtttggggcagtctcagtcaggacacagcatggacatggacgggtcccccgctcagctccgtggggcctcctgctactctggctccggaggtgccagatgtgacatccagatcgacccagtcctccactccctccctgtctgctatcgtagaggagacagacgtaccaccatccgtacgttcggccgggactaagtcgaagacgctaagttacgacgtaacgttactttaagttttaaagttggtactacgaagaacaaaaggaaaaaccggacggggtaaacccgtaccccgtaaacgtcctccgtagtaacttaccgtatacgtaccttaactaccgttacccgttaaggtttacgaacgggtaaacgggttccgggttaccctaaggttaccgtaaggttaccgtagggtacggacgtaggtacggtacgtacgggtacggtaactagttactttaccgacttcctaccgacctactcgacgtacgtacgtcctacgtacctaacgtagtaacgtttacgtttacgtaacctttaacctttaccgtaacgttcgtaaccgtaagttacggttaaccgtttaaccgttaccccgtttaccggttacgtttaaccgggttaccgggtaacccggaacgggtaacccgtagggtaaccggtaaggttaaaccggtaacgttaaacccgtaacggtacgttcgggtactacccgtacgaacccgtacgttaccgg

SEQ ID NO: 218743 - DNA, 692 bp, Homo sapiens
  misc_feature: GYAE6OF01AQUQL.18.53.E09.1.454.CMB.1.raw
  modified_base (193)..(193): a, c, t, g, unknown or other
  misc_feature (193)..(193): n is a, c, g, or t
  modified_base (259)..(259): a, c, t, g, unknown or other
  misc_feature (259)..(259): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccgggtcagtcagagacatagcagtcttaatttaagttgtatcganacaagaaacgaggaacgaccctaagctcctagacttctatcgtacctaacatccgtaagtttcgacgtaaacggtcggggtaccctataccgtaaggttacgagtggacgtaggtgacgttcgtagggacctaggttactttacgacgttcctactaacctataccgtagacctacgttaccgttacgacccgttaaaccgtaggtaaacgtttacggttttacgaaccttaaaccgttttaactaaccgtaagttaaccctaaacggtacgttaaaccgttaacgttaaccgggtttaaccccgtttacggtttacggtttacccggaaccgggaccggggtaaccgtaacgggtacgttaacgggaggtaaaccgttaaccgaaaacggttacgttacggttacggtacctacgaaccggttacctaacgg

SEQ ID NO: 218744 - DNA, 698 bp, Homo sapiens
  misc_feature: GYAE6OF01D79NH.18.53.E09.1.454.CMB.1.raw
  modified_base (208)..(208): a, c, t, g, unknown or other
  misc_feature (208)..(208): n is a, c, g, or t
  modified_base (250)..(250): a, c, t, g, unknown or other
  misc_feature (250)..(250): n is a, c, g, or t
tcagtacgagtatgcacgaccggtgctcgatttagagagagtgtgttgggtttgaggcagtctcagtcaggacacagcatggacatgacgggtccccgctcagctccgtggggcctcctgctactcgtggctccgaggtgccagatgtgacatccagatcgaccctagtcctccactcccttcctgtcctgctattcgtaggtagganacgagtactacaccatcacgttcggccggacaagtcgagacnctattacgctaagtactttaatttaaagttgtaactagacgaacaaaggaaaacgtacgggaaaacctacccgtaacgtcctaccgagtactactagtcgtaactaacgtactccgttaagtttacgaacgtaaacgggtccggtaacctagtaccggtaaaggttcgaggtacggtacgaaggtcggtagtacgggtaacggacgttaagttaccttacgtacgttccgtaccgtctaacgtacgacgtctacgtcctagtaaccgaacgttagttaacgttagtttaccgaactttaaccgttacacgttacgtaacaagttacgtaccttaacgtaccggttaccgttcgttaacggttcggaccggtaagggtaccgtaacgtacgtacggaaacacgttaaaccggaacgtttacgggcgtacgtaccgtaggtaccctaacg

SEQ ID NO: 218745 - DNA, 229 bp, Homo sapiens
  misc_feature: GYAE6OF01C09U5.18.53.E09.1.454.CMB.1.raw
  modified_base (220)..(229): a, c, t, g, unknown or other
  misc_feature (220)..(229): n is a, c, g, or t
tcagtacgagtatgcacgaccggtgctcgatttagagagagtgtgttgggtttgggggaagaggaagactgacggtcctcccaggagttcaggtgctgggcaccggtgggcatggggggagtgtgtcacaagatttgggctctgggcacagcggccctgggctgcctggtcaaggactacttcccatactcgtactgagcgggctggcaaggcgcatagnnnnnnnnnn

SEQ ID NO: 218746 - DNA, 745 bp, Homo sapiens
  misc_feature: GYAE6OF01B2RCJ.18.53.E09.1.454.CMB.1.raw
  modified_base (97)..(97): a, c, t, g, unknown or other
  misc_feature (97)..(97): n is a, c, g, or t
tcagtacgagtatgcacgaccggtgctcgatttagagagagtgtgttgggtttggggcagtctcagtcaggacacagcatggacatgagggtccccnctcagctccgtggggcctcctgctactctggctccgaggtgccagatgtgacatccagatcgacccagtcctccactccctccctgtcctgctatcgtaggtaggacgacgagtacgtaccaacctactcctaccggttcgggacccggggtaacaacggtcgaaggacgctaagttacgctaagttactttaaattttaaagttggtaactacgaacgaacgaaaaggaaaaaccggaacggggaaaaccctaccccgtaaagtcccttacgtacgtaacttcgtaagtcgtacctaacgtaccttaccgttagtttacggaaccgttaaacgggtccggtaccctaagtaccggtaaggttacgaggtacggtacgtaggtgtacgtggacggtactagttacttcgaccttcctacacatcaacgtctacgtctacgacctaacggtagtaagtttacttacgaaccttaacgtttactacgtactaaccgtaaagtaacgttaaccgttaccgttaacccggtttaccggtttacgttaacggttcccgggaaccggtaacgggaaccgtaaggtaccggtaagtaacgtaaacctaacggtaaaccgttcgtcggtaacccggctactaacccgtcgttaccg

SEQ ID NO: 218747 - DNA, 698 bp, Homo sapiens
  misc_feature: GYAE6OF01EOBQ1.18.53.E09.1.454.CMB.1.raw
  modified_base (97)..(97): a, c, t, g, unknown or other
  misc_feature (97)..(97): n is a, c, g, or t
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (320)..(320): a, c, t, g, unknown or other
  misc_feature (320)..(320): n is a, c, g, or t
  modified_base (516)..(516): a, c, t, g, unknown or other
  misc_feature (516)..(516): n is a, c, g, or t
tcagtacgagtatgcacgaccggtgctcgatttagagagagtgtgttgggtttggggcagtctcagtcaggacacagcatggacatgagggtccccnctcagctcctggggctcctgctactctggctccgaggtgccagatgtgacatccagatcgacccagtcctccactccctcctgtctgctatctagtagganacagacgtaccacatcctacgttcggcccggganaagtcgaggtacnctattagcagtacttaatttaagttggtatacagacgaaaggaaaacgacgggaacctaccctaagcctacgtanagttacctatcgtacctaactacttaccgtagtttacgaacgtaacgggtccgggtaccctagttacggtaagttacgaggtcggtagtcggtagggtactacggtacgggaactacggttactttaccgaccgttactaccgtaacctacgttaccgaaggtctacgtacgtacaccgttaacgtagtaacgttnttacgacttaacttaccgtatacgtaacctaacgtaacgttaccgttaaccgttaccgttacccggtttacgttaccggttaccggaacgggttaccgggtaaccgtaggccggttaggaactacggtttaaaaccgaaaccgttacggttacggtacgtaccgtaccgacctacccgttag

SEQ ID NO: 218748 - DNA, 737 bp, Homo sapiens
  misc_feature: GYAE6OF01DFWNJ.18.53.E09.1.454.CMB.1.raw
  modified_base (101)..(101): a, c, t, g, unknown or other
  misc_feature (101)..(101): n is a, c, g, or t
  modified_base (208)..(208): a, c, t, g, unknown or other
  misc_feature (208)..(208): n is a, c, g, or t
  modified_base (724)..(724): a, c, t, g, unknown or other
  misc_feature (724)..(724): n is a, c, g, or t
tcagtacgagtatgcacgaccggtgctcgatttagagagagtgtgttgggtttggggcagtctcagtcaggacacagcatggacatggacgggtcccccgntcagctccgtggggctcctgctactctggctccggaggtcgccagatgtgacactccagatacgacccagtcctccactccctccctgtctgctatcgtggaagganacagacgtaccacctatccacgttcggaccgggactaagtcgaaggagtctaagttacgacgtaagttactttaaaagttttaaagttggtaactacgaagaacgaaaacggaaaaacggaacgggaaaccctaccccgtaaaggtccttaccgttaagtactaccgttaatacgtacctaacctacgttccgttaaggtttacgaacgttaaacgggttccgggtaaccctaaggtaacgtaaacgggttcgaagggtacggacgtaggtacgtacgtacggtaggaacttgtactttccgtactaccgtaccaacttacgacgtacgtacgtacgtaccgtaccgtaacctaacgtaacgtaaagttactttaccgtaaacttaaccgttaacgtacgttagtaaccgtaacgtaaacggttacgtaaaccgttaccgttaccgttaccgttacgttacggacggacggaactaaggtcggataacgactaacgaaacgtcgtacgacgtaccnctaccgacttacg

SEQ ID NO: 218749 - DNA, 623 bp, Homo sapiens
  misc_feature: GYAE6OF01AQXVX.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagctattagcagcttaatttaaattggtatcagcaagaaaacaggaaacgcccctaagctcctgatctatcgactacactacctagtttacgacgtaacggtcgggtacccatacgaaggttcaggtcggctaggtggtaacgtcgtagggaactaggtacttttacgacttacctactacccgataccacgtccgtaagtccttacggaccctaacccggttagtaaacgtttacgtttacgtaacccttaaacgtttacttacttacgtaactaaacgtacgttaacgttaaccgtacgttaaccccgttacgtttaccggtttaccggaccgtacgggtaaccaacggtcgtaggataacgtaccgaaagtacgtggtagaccagaccgccgtac

SEQ ID NO: 218750 - DNA, 720 bp, Homo sapiens
  misc_feature: GYAE6OF01D7EWV.18.53.E09.1.454.CMB.1.raw
  modified_base (194)..(194): a, c, t, g, unknown or other
  misc_feature (194)..(194): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctggtagganacagagtcaccatccacgttcggccgggtacaagtcgagagcagttagacagtacttaatttaaattggtactacgagacaaagaaaacgaacgggtaaaccgaccccgtaaagtcctaccgtagatactatgtacctactactaccgtagtttacgacgtaaaggttcggggtacctaagtacgtaagggttacaaggtcggacgtaggtagtacgtcgtaggactagtactttcacttccacctacactcagtctagtccgtactaaccgtaaccgttagtaaatttacgtttaccgtaaccttaactttaccgttactaccgttaacgtaacgtaacggtttaacgttaacccgttacggttaccccgtttacggttttaacccgttttacgggaccgggttaaaccggggtaaccgtaaacggttccggtaagggtaaacgttaaaccgttaaaccggtaaaacggttaaccgtttcgggttaaccggacccgtttaaacgaacccgttaacccgttaacgg

SEQ ID NO: 218751 - DNA, 642 bp, Homo sapiens
  misc_feature: GYAE6OF01D6NEH.18.53.E09.1.454.CMB.1.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
  modified_base (634)..(634): a, c, t, g, unknown or other
  misc_feature (634)..(634): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgacccagtctccatccctcctgtctgcatctggtagganacagacgtccaacctatcctacgttcggcccgggtacaagtcagagctaattagcagtacttaatttaaagttggtatacagacaaagaaaacgacgggaaacncccgtaagcctcctgtacttctatcgtacctaactacttaccgtagttacgaacgtaaacggttcggggtaccctagttacgtaaggtttcgaggtcggtacgtaggtagtacgtcggtagggaactagttaactttcaactcctacaccatacgacgtcacgttacgtacgtacctaaccgttagtaacgtttagtttacaaccttaacttacctactacgtacaaacgtagttacgttaccgtacgttacccgttcggtttacgttcggaccggtaacggaccaggtcgtaggataacaacgaaacgtacgttcggtacgaccgtacgtaccncgttaacg

SEQ ID NO: 218752 - DNA, 178 bp, Homo sapiens
  misc_feature: GYAE6OF01DWWN3.18.53.E09.1.454.CMB.1.raw
  modified_base (175)..(178): a, c, t, g, unknown or other
  misc_feature (175)..(178): n is a, c, g, or t
tcagtacgagtatgcacgaccggtgctcgatttagagagagtgtgttgggtttggggggaagaggaagactgacggtcctcccaggagttcaggtgctgggcacagcggccctgggctgcctggtcaaggactacttccatactcgtactgagcgggctggacaaggcgcatagnnnn

SEQ ID NO: 218753 - DNA, 242 bp, Homo sapiens
  misc_feature: GYAE6OF01DBZ9M.18.53.E09.1.454.CMB.1.raw
  modified_base (221)..(242): a, c, t, g, unknown or other
  misc_feature (221)..(242): n is a, c, g, or t
tcagtacgagtatgcacgaccggtgctcgatttagagagagtgtgttgggtttggggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcaatagnnnnnnnnnnnnnnnnnnnnnn

SEQ ID NO: 218754 - DNA, 761 bp, Homo sapiens
  misc_feature: GYAE6OF01BDCZ0.18.53.E09.1.454.CMB.1.raw
  modified_base (140)..(140): a, c, t, g, unknown or other
  misc_feature (140)..(140): n is a, c, g, or t
  modified_base (746)..(746): a, c, t, g, unknown or other
  misc_feature (746)..(746): n is a, c, g, or t
  modified_base (754)..(754): a, c, t, g, unknown or other
  misc_feature (754)..(754): n is a, c, g, or t
tcagtacgagtatgcacgaccggtgctcgatttagagagagtgtgttgggtttggggcagtctcagtcaggacacagcatggacatgacgggtccccgctcagcctccgtggggctcctgctactctggctccggaggtncagatgtgacatccagatcgaccctagtcctccatccctccgtgtctgcctattcgtaggtaggagacaggtactccaacctagttccgtacgttcggcccgggtactaaaggtccaaggacgtacgtaagttacgacgtaacggttacttttaaattttaaaagtttcgggtaacttaccgaaggtaacgaaaacgggaaaaacggaacgggggtaaaccctaaccccctaaggtcccttaccgtagtaacttacttagtaccgtacttaacctacttaccgttaggtttacgaacggtaaacgggttccggtaacctaagtacgtaagggtctaggtcggacgtaggttcgacgtacggtaggactagttacctttacgaccttaccgtacctactacgtcgacgtacgtacgtcctagtaccctaacgttaggtaacgtttacgttcctaaacttaacgttactacgttactaactaacggtacgttaccgtaaccgttacggtttaacccgttacggtttacggttaccgggaaccggtaacgggtacccgtaaggtccgtaggaaacttacgaaccgttaaaacggcgttcggacgtaccngtaacccncgttacg

SEQ ID NO: 218755 - DNA, 228 bp, Homo sapiens
  misc_feature: GYAE6OF01E1JOS.18.53.E09.1.454.CMB.1.raw
  modified_base (222)..(228): a, c, t, g, unknown or other
  misc_feature (222)..(228): n is a, c, g, or t
tcagtacgagtatgcacgaccggtgctcgatttagagagagtgtgttgggtttgggggaagaggaagactgacggtcctcccaggagttcaggtgcgtgggcaccggtgggcagtgggggaggtgtgtcacaagatttgggctctgggcacagcggccctgggctgcctggtcaaggactacttcccatactcgtactgagcgggctggcaaggcgcatagnnnnnnn

SEQ ID NO: 218756 - DNA, 691 bp, Homo sapiens
  misc_feature: GYAE6OF01B2PT8.18.53.E09.1.454.CMB.1.raw
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgacccagtctccatccctccctgtctgcatctagtaggagacagacgtccaccatcacgttcggcccggganaagtcagagctagttagcagtacttaatttaagttggtatcagacaagaaacgaggaacgcctaagctacgtnatcatcgctacnctctagttagacgtaacggtcgggtaccagtacgtaaggttcgagtcggactaggtaggtacgtcggtacggaactacggttactttaccgactttaccctacctaacgtacgttaccaacggtaccttacggttacctaccggtacccgtaaccgttaaggttaaacgttttaactttttaccgtttaaacctttaacctacgttacgtaaccctaaacggtacgtttaaccggttaaccgttacccggtttaccccggttacgttttaacccggtttacgggaacccggttaaccggggaacctaaggtacggtacgggtaactaacggtaacgaaaccgttagtcggtacgtccgtagaacccgtctgttacccg

SEQ ID NO: 218757 - DNA, 606 bp, Homo sapiens
  misc_feature: GYAE6OF01BFMQI.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatcgtagtaggagacagagtcaccatcacttggccgggcaagtcgagagcattagcagtcttaatttaagtggtatcagacaagaaacgtaacgggaaacgtaccccgtaagcctacctagtatctatcgactactactccgtagttacgacgtaaacggtcggggtacccagtacgtaacggttcgaggtcggacgtaggtggtactcggtaggactagtactttacctacctctaccacctatcgacgactacgtctacgacctaaccgtagtaacgttatttacaccgttaactttaccgtactacgtaacaacgtagtaacgttaccgtacggttacccgtagttacggtttcggaccgtacgggtaccgagtcgtaggacgtactaacgaaagacgtacgtacggactctccgagtacg

SEQ ID NO: 218758 - DNA, 229 bp, Homo sapiens
  misc_feature: GYAE6OF01A9CRE.18.53.E09.1.454.CMB.1.raw
  modified_base (220)..(229): a, c, t, g, unknown or other
  misc_feature (220)..(229): n is a, c, g, or t
tcagtacgagtatgcacgaccggtgctcgatttagagagagtgtgttgggtttgggggaagaggaagactgacggtcctcccaggagttcaggtgctgggcaccgtgggcatggggggaggtgtgtcacaagatttgggctctgggcacagcggccctgggctgcctggtcaaggactacttcccatactcgtactgagcgggctggcaaggcgcatagnnnnnnnnnn

SEQ ID NO: 218759 - DNA, 660 bp, Homo sapiens
  misc_feature: GYAE6OF01CJYUI.18.53.E09.1.454.CMB.1.raw
  modified_base (650)..(650): a, c, t, g, unknown or other
  misc_feature (650)..(650): n is a, c, g, or t
tcagtacgagtatgcacgaccggtgctcgatttagagagagtgtgttgggtttggggcagtctcagtcaggacacagcatggacatgagggtccccgctcagctccgtgggctcctgctactctggctccggaggtgccagatgtgacatccagatcgacccagtcctccactccctccctgtctgcatctggaggagacaggactaccaccatctacgttcggaccgggtacaaggtcagagtactagttacgcctaagttactttaagttttaaagttcggttaactacgaagaacgtaaaacggaaaaccggaacggggtaaaccgtacccccgtaacgtccgttaccgtagtactacctagtacgtactactacttacgtagttacgaacgtacggtcggtacagtacgtaggtagtaggtagcgtaggtgtacgtagaggactagtacttaccactctaccactacacgagtacgtacgtacacgtactactaggttaactactttactaacttaactacctagtaactacgtacgtaacgttaccgttaccgtaccgtttccgttacgttccggtaccggaccggaaccgggtacacggtgtaacggacgtaacgtaacgaactacggtacggtacgaccttanccgtctacgg

SEQ ID NO: 218760 - DNA, 763 bp, Homo sapiens
  misc_feature: GYAE6OF01D6MV3.18.53.E09.1.454.CMB.1.raw
  modified_base (482)..(482): a, c, t, g, unknown or other
  misc_feature (482)..(482): n is a, c, g, or t
  modified_base (499)..(499): a, c, t, g, unknown or other
  misc_feature (499)..(499): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatcgacccagtctccatccctccctgtctgcatctgtaggagacaggacgtaccacctatcacgttcggccgggacaaggtcgaaggacgacaagtttacgacgtaagttacttaaagttttaaagttggttaactaccgaagaactaaaacggaaaaaccggaaacgggggtaaaaccctacccccgttaaaggcccttaccgttaggtaactttcgtaatcggaccttaacacttccgtagtttaacgacgtaacggtccgggaccctagtacgtaacggttcgaggtggacgtaggtcggtagtcgtaggtaactagttactttccncttacctaccgtaaccngtaacgtacgtactacgtactaccgaccgtaacgttacgtaagtttacgtttaaccgaactttaacctttaaccgtaacttcgtaaacctaacgtaacgttaccggttaaccgttaaccggttacccggttacggtttacgttacccgggaacgggttaacccggggtaacccgtaagggttaccggtaacgaacggtaaacccgtaaacggttaaacccgtacggttacggttaggaccccgtagtaccctaacccgttacgg

SEQ ID NO: 218761 - DNA, 612 bp, Homo sapiens
  misc_feature: GYAE6OF01EQQ17.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttcggccgggacaagtcagagcattagcagtattaattaattggtatcagacaagaaacgaggaaactacccgtagctctgatctatgactacactccgtagttcgacgtaaggtcgggtaccctagtacgtaaggttcgaggtcggactaggtgtacgtcggtaggactagtactttactactacttaccaacgtactacgagtacgtacgttactacgacgtaaaccctaggtaagttacgttttacgactttaaccgttactaacgttcgtaactaacgtaagttaacgttacgtaccgtttacccgtacgtttacgttcgggaccgtaacgggaacctacggtacgtaggataacgtaacgtaaacgtacgtcggtacggtacacggactacgttacg

SEQ ID NO: 218762 - DNA, 707 bp, Homo sapiens
  misc_feature: GYAE6OF01ETVZR.18.53.E09.1.454.CMB.1.raw
tcagtacgagtatgcacgaccggtgctcgatttagagagagtgtgttgggtttgggggcagtctcagtcaggacacagcatggacatgagggtccccgctcagctccgtggggctcctgctactctggctccggaggtgccagatgtgacatccagatcgacccagtcctccactccctccctgtctgcatctagtaggagacagagtcaccatcacttcggccgggcaagtcagagctagttagacagtacttaatttaaagttggtaatcgaacgacgaaaggaaaacgaacggggaaaccgtcccccgtaaagcccgttacccgtagtaacttacctaagtcgtacctaactacttaccgtaaggtttacggaacgtaaacgggtccggggttaacccagttaccgtaaagggttccgaggtacggtcgtaggtacgggtacttccggtagggaactacgttactttaccacttacctactaacctacgtactacgactacgttaccgacgtaacctaacgtagtaagtttactttacgaccttaacctttactacgttacgtaactaacgtagtaacgttaccgtaccgttacccggttacgtttaacgggttaccggaccgggtaacgggtaaccgtaggtcgtaagggtaacgacgtaacgtaaaccggtacgttcggtacggtatccgtacctacgtacg

SEQ ID NO: 218763 - DNA, 692 bp, Homo sapiens
  misc_feature: GYAE6OF01D9VSU.18.53.E09.1.454.CMB.1.raw
  modified_base (98)..(98): a, c, t, g, unknown or other
  misc_feature (98)..(98): n is a, c, g, or t
  modified_base (200)..(200): a, c, t, g, unknown or other
  misc_feature (200)..(200): n is a, c, g, or t
tcagtacgagtatgcacgaccggtgctcgatttagagagagtgtgttgggtttggggcagtctcagtcaggacacagcatggacatgagggtccccgntcagctccgtggggctcctgctactctggctccgaggtgccagatgtgacatccagatcgacccagtcctccactccctcctgtctgctatctaggtagganacagacgtccaaccctatcctacgttcggcccggggtacaaggtcgaaggagactattagctagtactttaatttaaagttggtatcaagacaaaggaaaacgaagggaaaccgacccctaagcctacgtagtacttcgtatcgtaccttaactacgtaccgttagttacgaacgtaaacgggttccggggttaccctaagttacgtaacggttacgaggtcggacgtaggtagacgtcggtaggaactagttactttaccaccgttactacccgaactacgtacagtctaacggtctacgacctaacgtagtaagtttacttagaaccttaacttactacgtacgtaacgaacgtagttacgttaacgtacccgtttaccgttacgtttacggttaccggaccggtacgggtaacctagggtccgtagggaactacgtaaaccgtaaacggtacgtttaccgggacgtaccgtacgtacccgtccgttacg

SEQ ID NO: 218764 - DNA, 698 bp, Homo sapiens
  misc_feature: GYAE6OF01AYN10.18.53.E09.1.454.CMB.1.raw
  modified_base (290)..(290): a, c, t, g, unknown or other
  misc_feature (290)..(290): n is a, c, g, or t
tcagtacgagtatgcacgaccggtgctcgatttagagagagtgtgttgggtttggggcagtctcagtcaggacacagcatggacatgagggtccccgctcagctccgtggggctcctgctactctggctccgaggtgccagatgtgacatccagatgacccagtctccatccctccctgtctgcatctgtaggagacagagtcaccatccacttggccgggacaagtcagagctaattagcagtacttaatttaaattggtatcgagacaaagaaaacgaagggaaaccnccccgtaaagcctaccgtagacttctatcgtactactacttaccgtagttacgaacgtaacggtcggggtaccctagtacgtaacggttcgaggtcggacaggtggtacgttcggtaggtaacgtaggttaactttaccgaccgttcctacctaaccgtacttaccacggtaccgtaggtacctacgaaccgtaaccgttaaggtaaacgtttacgtttacgacctttaacttacctacgttaacgtacgaacgtaacgttacgttaaccgtacggttacccgttacgttaaccgtttacgggacccggtaaacgggtaacccgaaggttccgtaaagggtaacctaaacggttaaaccgaaaacggttacgttacggtccggtaacgttaccgaccgtaccgttacg

SEQ ID NO: 218765 - DNA, 636 bp, Homo sapiens
  misc_feature: GYAE6OF01CGWSD.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtccaccatcacttgccgagacaagtcagagcattagcagtacttaatttaaattggtatcagacaagaaaacgagggaaacgcccgtaagcctcctagactactatcgactaactactccgtagtttacgacgtaaacggttcgggtacccagtacgtaaggttcgaggtggactaggtggtatcggtagggactagtactttccacttcctaccactatacgagctacgtctacgacctaaaccgttagtaacgtttacttttacgaaccttaaacctttacttaaccgttacgtaacctaaacggtacgttaacgtttaaccgtaaccgtttaccccgttacgtttaccggtttacgggacccggtaaacggggacctaacggtcgtagggactaacgtaacgaaacgtacgtcggtacgtctcgacctaaccg

SEQ ID NO: 218766 - DNA, 242 bp, Homo sapiens
  misc_feature: GYAE6OF01CM65E.18.53.E09.1.454.CMB.1.raw
  modified_base (215)..(215): a, c, t, g, unknown or other
  misc_feature (215)..(215): n is a, c, g, or t
  modified_base (222)..(242): a, c, t, g, unknown or other
  misc_feature (222)..(242): n is a, c, g, or t
tcagtacgagtatgcacgaccggtgctcgatttagagagagtgtgttgggtttgggggaagaggaagactgacggtcctcccaggagttcaggtgctgggcaccgtgggcatggggggagtgtgtcacaagatttgggctctgggcacagccggccctgggctgcctggtcaaaggactacttcccatactcgtactgagcggctggcaaaggcncaatagnnnnnnnnnnnnnnnnnnnnn

SEQ ID NO: 218767 - DNA, 599 bp, Homo sapiens
  misc_feature: GYAE6OF01CCAEZ.18.53.E09.1.454.CMB.1.raw
  modified_base (362)..(362): a, c, t, g, unknown or other
  misc_feature (362)..(362): n is a, c, g, or t
  modified_base (417)..(417): a, c, t, g, unknown or other
  misc_feature (417)..(417): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagtcttaatttaaagttggtatcagacgaagaaaaccgagggaacaccccgtaagcctactagactctatcgactacacttactagtttagacgtaaaggtcgggtccagtacgaaggttcagtcggnaggtgagtcgtaggactagtactttacgacctctaccacctatcagctacgttcngactacgttagaacggttatttacgaccttaaccttacttacgtacgtaccaaacgtaagtacgtttaaccgaccgtttacccggttacgtttaccgtttcggaccgtacggggacccaagggtcgtaggtacgacgtaacgtaaaaccggtcgttacggacgacaccgtccgtaacgtacg

SEQ ID NO: 218768 - DNA, 588 bp, Homo sapiens
  misc_feature: GYAE6OF01BOGQL.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccgggcaagtcagagcattagcagtcttaatttaaattggtatcagacaagaaaacgagggaacgcccctaagcctctagatctatcgactacactcctagtttacgacgtaaacggtcggggtacctagtacgtaaggttcgaggtggacgtaggtggagtcgtagggactagtactttccgactctacactatacacgtctagtcgtacgacctaactagtaagttatttacgactaacttactactacgtacaacgtagtaacgttacgtacgtacccgttacgttacgtttacggaccggtacggggaacctaggacgtaggacgtaacgtaacgaaacgtacgttacgggtacgtactcgtactaccgtacg

SEQ ID NO: 218769 - DNA, 782 bp, Homo sapiens
  misc_feature: GYAE6OF01C0BCI.18.53.E09.1.454.CMB.1.raw
  modified_base (137)..(137): a, c, t, g, unknown or other
  misc_feature (137)..(137): n is a, c, g, or t
tcagtacgagtatgcacgaccggtgctcgatttagagagagtgtgttgggtttggggcagtctcagtcaggacacagcatggacatgagggtccccgctcagctccgtggggctcctgctactctggctccgaggtnccagatgtgacatccagatcgaccctagtctccactcctccctgtctgctatctaggtaggacacaagacgtaccacctactcaccgttggcccggacaaagtcagcgcaattagcaagtacttaattttaaagttggttatcgaagacaaagaaaacgaacgggaaacgacccccgtaagcctctagtactactactagtcctaactactaccgtagttagaaccgtaaacgggtccgggtacctagtacgtaacggttcgacggtcggtacacggtagacgttacggtacgggtactacggttactttccgaccttactacctaacctacgtaccgaggtacctaacgtccgtacgaccctaacgtacggttaaagtttaccgtttacgtaccttaactttaaccgttaaaccgttacgtaacccgtaaacgttacgggttaaccgtttaaccggttaacccggtttacccccggttttacgggtttaacccgttttacccgggggaacccgggtaaaccgggggttaacccgtaaaacgggtccgggttaaacggtaccggtaaaaccggttaaccggtaaaaacccggttacggtttacgggtaaccggtacccttacggaaccccttacgggttaacccc

SEQ ID NO: 218770 - DNA, 734 bp, Homo sapiens
  misc_feature: GYAE6OF01AOGLH.18.53.E09.1.454.CMB.1.raw
  modified_base (431)..(431): a, c, t, g, unknown or other
  misc_feature (431)..(431): n is a, c, g, or t
  modified_base (658)..(658): a, c, t, g, unknown or other
  misc_feature (658)..(658): n is a, c, g, or t
tcagtacgagtatgcacgaccggtgctcgatttagagagagtgtggttgggtttggggcagtctcagtcaggacacagcatggacatgacgggtccccgctcagctccgtggggctcctgctactctggctccggaggtgccagagtgtgactatccgagactcgacccagtcctccactcccgtcctgtcctgctatcgtgaggagacaggtactcaccataccgacgttcggccggactaacgtacgagacgtactaagttagacgtatacttttaaagttttaaaggttgttactacgaagaacgaaacgtaaaacggaacggtaaaccctacccgtaacgtccttaccgactagttcgtaagtcgactactaacgttcgtagttacggaacgtacggtcggtactagtacggtaagtcgaggtcggngaggtcgtatcggacggtactagttacttaccgactcccgactaccaagttccgaaggtcctacgttcgaacgtacgttaaacgtacttaacgttacgtttacgtaaaccctattttacccgttaagtaacccgtaaccttaaacggtcgttttaaaacccttccgggttaaaccccttcgggttttacggttacccgtaacggggcccggttaaaacgggtaaccngggtacggtaaacggtaattaaacccgtaacggaaaacggtttcggcggttaactccggacttacccgtataccgg

SEQ ID NO: 218771 - DNA, 691 bp, Homo sapiens
  misc_feature: GYAE6OF01BWH2Q.18.53.E09.1.454.CMB.1.raw
  modified_base (97)..(97): a, c, t, g, unknown or other
  misc_feature (97)..(97): n is a, c, g, or t
  modified_base (135)..(135): a, c, t, g, unknown or other
  misc_feature (135)..(135): n is a, c, g, or t
  modified_base (202)..(202): a, c, t, g, unknown or other
  misc_feature (202)..(202): n is a, c, g, or t
  modified_base (443)..(443): a, c, t, g, unknown or other
  misc_feature (443)..(443): n is a, c, g, or t
  modified_base (683)..(683): a, c, t, g, unknown or other
  misc_feature (683)..(683): n is a, c, g, or t
tcagtacgagtatgcacgaccggtgctcgatttagagagagtgtgttgggtttgggcagtctcagtcaggacacagcatggacatgagggtccccgntcagctcctggggctcctgctactctggctccggagtnccagatgtgacatccagatcgacccagtcctccatccctccctgtctgactagtcctaggtaagganaaccgaggacgtccaaccagttcaacgttcggcccgggacaaaggtccaaggagactaagttacggacacggttacttaattttaaaagttaggttaatcgaagtaacgaaaggaaaaaccgaacgggaaaaccgtacccccttaaaggccttaccgtagtactctaagtctacctactaacgtccgtagtttcgaacgtaaggtcgggtacctagtccgtaaaggtcgagtggcgtaagnggtactacgtaggtacagtacttactcgtctacaactagtactacgaactcggtcctagaacctaaccgttagtaaacgttcttttaccgaacttaaccgtttaaccttacgttaactaaccgtaacgtaacgtttaagtaccgtaaccgtttaaccggtcctttacggtttacgaccggtaacggtaacaggtactagggaataccgtaaccgtaacgtacgtcggtaaccgcacgtanaccgttac

SEQ ID NO: 218772 - DNA, 769 bp, Homo sapiens
  misc_feature: GYAE6OF01A4VJU.18.53.E09.1.454.CMB.1.raw
  modified_base (98)..(98): a, c, t, g, unknown or other
  misc_feature (98)..(98): n is a, c, g, or t
  modified_base (195)..(195): a, c, t, g, unknown or other
  misc_feature (195)..(195): n is a, c, g, or t
tcagtacgagtatgcacgaccggtgctcgatttagagagagtgtgttgggtttggggcagtctcagtcaggacacagcatggacatgagggtccccgntcagctcctggggctcctgctactctggctccgaggtgccagatgtgacatccagatgacccagtctccactccctcctgtctgcatctagtagganacgagtacgtcaaccagtcctacgttcggaccgggacaagtcgagagtactagttagactagtactttaaagtttaacgttaggtatcgaacgacgaaaggtaaaaacgaacgggaaaccgtaccccgtaaggtaccttaccgtaggtaacttccgttaacgtacggaccttaaccgtacttaccgttaagttttacgaacggtaaacgggtccggggttaccctaaggttaccgtaagggttaccgtagggtccggtaagtaacgggttacggtacggttaccggtcggggaaactaggttaactttaccgaacttccgtaccacgtactcgacgtacgtacgtcgtaccgtaactaaccgtaaggttaactttacgtttacgtaaccttaacgttaccttacgttaacgtaacctaacgtacgttaaaccgtttcggtaacccgtttacccggttacgtttacccgtttacgggacccgtaacggggtaacctacgggttaccggtaggaaccgttaacgtaacggaaacccgtttaacggtggtacggtaaccgcgtaacccgtcttaacg

SEQ ID NO: 218773 - DNA, 728 bp, Homo sapiens
  misc_feature: GYAE6OF01AWRXL.18.53.E09.1.454.CMB.1.raw
  modified_base (141)..(141): a, c, t, g, unknown or other
  misc_feature (141)..(141): n is a, c, g, or t
  modified_base (186)..(186): a, c, t, g, unknown or other
  misc_feature (186)..(186): n is a, c, g, or t
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (513)..(513): a, c, t, g, unknown or other
  misc_feature (513)..(513): n is a, c, g, or t
tcagtacgagtatgcacgaccggtgctcgatttagagagagtgtgttgggtttggggtcgagtctcagtcaggacacagcatggacatgagggtccccgctccagctccgtcggggctcctgctactctggctccgaggtnccgagatgtgacatccagatcgaccagtctccactcctcctgtcngacatctggtacgganacgagacgtccaccntctacgttggcccggganaaggtcagacgtgtactagctagtacttaatttaaacgtggttactacgacgtaacaaaggaaaacgaacgggaaaccgtaccctaacgtccttacgtacgtatcgttatcacgttactaacttccgtaagtttacgaacgtaacggtccggggtacctaacgtaccggttaacgtctaaggtcggtaacgtaggttacggacgttacggtaacggaacgtattacgtttccgaacccgttcctactaccgtaataccgtacgtacgtacgttacctntaacccgacttaacggtaacgtttaagttaccggttaacttaacgttacttacgtacgtaacctaacgacgttacgttaccgttaaccgttccgttaaacggtttcgtacccgggtacgaaaccggggtacctaacgggtcgtacggttaaccgaacgttaaccgaaacggtacccggttagtacccgtaaggtcctaacccgggtcttaacggg

SEQ ID NO: 218774 - DNA, 735 bp, Homo sapiens
  misc_feature: GYAE6OF01DASU0.18.53.E09.1.454.CMB.1.raw
tcagtacgagtatgcacgaccggtgctcgatttagagagagtgtgttgggtttggggcagtctcagtcaggacacagcatggacatggacgggtccccgctcagctccgtggggctcctgctactctggcctccggaggtcgccagagtgtagacatccagactcgacctatcctccactccctccctgtctgactattcgtaggtaggacgaacagacgtccaacctactacgtacggttcgggaccggggaactaacggtaccaaggacgtaccttaagtacggacgtaacgttatttaagtttaagtggtacacgaagacaaaaggtaaacgaacggtaaccctacccgtaatccgttactacgtactacgttataccgtactaacgttccgtaacgtttagttacggaacggtaacgggtccgggttaacccaagttaaccgggttacgttacggtaagtggtaacggtaaggttcgggtaactccggggtaagtaacgttacgttaccttaccttacctactaccaactagtcgaacgtcgttaacggtacgtaactaaccggtaacttaacgttaacgtttattaccgtaacttaacgttactaacgttctaacgtacgtaaccgttaacgtaaccgttacgtacctttacggtaccgttagggaccgaacgggtacacggtacgagtacgaactacggaaacgttgtacgtacgacgtcacctaggtc

SEQ ID NO: 218775 - DNA, 852 bp, Homo sapiens
  misc_feature: GYAE6OF01C4S2G.18.53.E09.1.454.CMB.1.raw
  modified_base (98)..(98): a, c, t, g, unknown or other
  misc_feature (98)..(98): n is a, c, g, or t
  modified_base (150)..(150): a, c, t, g, unknown or other
  misc_feature (150)..(150): n is a, c, g, or t
  modified_base (168)..(168): a, c, t, g, unknown or other
  misc_feature (168)..(168): n is a, c, g, or t
tcagtacgagtatgcacgaccggtgctcgatttagagagagtgtgttgggtttggggcagtctcagtcaggacacagcatggacatgagggtccccgntcagctcctgggctcctgctactctggctccggaggtgccagtatgtgaacntccagaatgacccagtcnccatccctccctgtctgcatctgtagatacaggatccacctagtcacgttggcccgggcaaggtccaggagcattagcagtactaattttaaattggtatacagacaaagaaacacgggaaactcccctaaagtcctccgttagacttacgtatacggttacctacgttactacccgttaggttttacgaaccggtaaaagggttcccggggttacccgtaagtaaccgggttaaacggggtttacccgtaagggtacgggtaaccggaggtttaacggggcgtttaccggttaacggggggtaacaaacgggttttcttttacccggaacctttacccgttacccgaaaccccttaggttaaccacccggtaacgtttaccgggtttaaccttaccgggtacccgttaaaccccgtaacgggtttaaggtttacggttttttaaccgtaaccttaaacccgttttaactttaacgttaccggtttaaccaaacggttaacggttaaaccgtttacggttaaaccccgtttaacccggttccggtttaaccgtttcggggaaacccggttaccggggaacccgaaacgggttcccggtaagggttaacccggaattaaaccccgggtaaaacccgttaacgttcggggttaacgtccctttaggggacccccttcgtttaacgg

SEQ ID NO: 218776 - DNA, 747 bp, Homo sapiens
  misc_feature: GYAE6OF01B4MGK.18.53.E09.1.454.CMB.1.raw
  modified_base (97)..(97): a, c, t, g, unknown or other
  misc_feature (97)..(97): n is a, c, g, or t
  modified_base (736)..(736): a, c, t, g, unknown or other
  misc_feature (736)..(736): n is a, c, g, or t
tcagtacgagtatgcacgaccggtgctcgatttagagagagtgtgttgggtttggggcagtctcagtcaggacacagcatggacatgagggtccccnctcagctccgtggggctcctgctactctggctccggaggtgccagatgtgacatccagatcgacccagttcctcccacttcccctccctgtctgcctatcgtagtacgggagacgagtacgtccaacctagtcctaaccggttcgggacccgggactaaaggtccgaaggacactaagttacgacaagttactttaaagttttaaagttggtaactacgaacgtacgaaaacggaaaaccggaacggggaacccgtaccccgtaacgtcctaccgtagtacttacgtagtacgtacctactaccgttaccgttaaggttaccgaacggtaaacgggttccgggggttaaccctacggtaacgttaaacggttcggtaggtacggacgtaggtacggtacgtccgtaacgggtaactacggttacttaccgtacccgtacctaaccctaacgtacgtacgtaacgtacgtacgtaccgtacctacccgtaactagtactttacgttacgtacctaacttactacgtactactaacgtacgtaacgttaccgtaccgttcccgtacgtttacgtccggaaccggtacggaaccgtggtacgtagtaacggtacgtaacgtaacggtacgtacggtcgaccncgtccacgttc

SEQ ID NO: 218777 - DNA, 179 bp, Homo sapiens
  misc_feature: GYAE6OF01BI0DX.18.53.E09.1.454.CMB.1.raw
  modified_base (175)..(179): a, c, t, g, unknown or other
  misc_feature (175)..(179): n is a, c, g, or t
tcagtacgagtatgcacgaccggtgctcgatttagagagagtgtgttgggtttggggggaagaggaagactgacggtcctcccaggagttcaggtgctgggcacagcggccctgggctgcctggtcaaggactacttcccatactcgtactgagcgggctggcaaggcgcatagnnnnn

SEQ ID NO: 218778 - DNA, 660 bp, Homo sapiens
  misc_feature: GYAE6OF01CSEYG.18.53.E09.1.454.CMB.1.raw
  modified_base (196)..(196): a, c, t, g, unknown or other
  misc_feature (196)..(196): n is a, c, g, or t
tcagtacgagtatgcacgaccggtgctcgatttagagagagtgtgttgggtttggggcagtctcagtcaggacacagcatggacatgagggtccccgctcagctccgtggggctcctgctactctggctccggaggtgccagatgtgacatccagatcgacccagtctccatccctccctgtctgcatctgagganacagagtccaccatccacgttcggccggggactaagtcgagagctagttagcagtacttaatttaaattggtatcagacaagaaaacgagggaaacgcccctaagtcctcctgacttctagtcgacctactacttacctagtttacgaacgtaacgggttcgggtaccctaagtacgtaacggtttcgaaggtaggcgtagggtacgtagttacggtaggggacctaggttacctttacgaaccttacctacaaccgtattacacggtactacggtccgtcgtaccaaaccggttagttaaacgttcgttttacaaccgttaacttttacctacttcgtaactaaacgtacgtacgtttaacgtaccgttacccggttacgtttaccgtttacgggaccggtacgggtaacccagtaccgtagggactaactacggaaacgtacgtggtacgctcgactctacg

SEQ ID NO: 218779 - DNA, 851 bp, Homo sapiens
  misc_feature: GYAE6OF01D3DMP.18.53.E09.1.454.CMB.1.raw
  modified_base (176)..(176): a, c, t, g, unknown or other
  misc_feature (176)..(176): n is a, c, g, or t
tcagtacgagtatgcacgaccggtgctcgatttagagagagtgtgttgggtttggggggaagaggagcccagcactgggattccgaggtgtttccattcggtgatcagcactgaacacagaggactcaccatggagttttggctgagcgtggtttcttgtagctattacaaaggtntcagtgtgaggtgcagttggtggagactggaggaggcttgatcagccgtgggggtcctggagcctctcgtagtgctagtctcgtggttcgtacgtagtggacgactacgatcggtacgtcgtacggggtcccgaccgtacgggtccgtaccgggaacggggggtaacgggtccccgttaggggaacggttacggggtaacttccgttaaccgtaacgtttttaacgtttaagtacgggttacggttaccgggttaacctaactaacgttaacgtaacctaaacgtaccggtaaccgttacccgggttagggaaaccgggtacccgttaactttaccgacccgtattaccgtaacgaaacggtaaacgtaaccgtaaacgttaccccgaacgggaaactaacggtttaacgtttacgttaacgttttaacctaaacgtaaacgttaaccggtaaacttaaacccgggttaggaaacggttaaccgggaacccgaacgggtaaccgtaccgggtaaccttaaggttacgtttaagtacggttcggttagggtacgggttaaccttacggttttaccggacccgggttaacccgggttcccgggggaaacccggggtcccttaccggtcccggtaccccgtccccttacccccggtaacccgtcccgaaaccccgggg

SEQ ID NO: 218780 - DNA, 645 bp, Homo sapiens
  misc_feature: GYAE6OF01A3D8M.18.53.E09.1.454.CMB.1.raw
  modified_base (147)..(147): a, c, t, g, unknown or other
  misc_feature (147)..(147): n is a, c, g, or t
  modified_base (491)..(491): a, c, t, g, unknown or other
  misc_feature (491)..(491): n is a, c, g, or t
tcagtacgagtatgcacgaccggtgctcgatttagagagagtgtgttgggtttggggcagtctcagtcaggacacagcatggacatgagggtcccgctcagctcctggggctcctgctactctggctccgaggtgccagatgtgacntccagatgacccagtctccatcctcctgtctgcatctgtaggagacagatcaccatcacttgccgggacaagtcgagagctagttagcacgtacttaatttaaacgttggtactcgaagactaaacggaaaacggaagggtaaaccgccccttaaaaggccttaccgtaggtaacttcgtaactcggtacctaactacgttacccgtaggttttacggaacgtaacggttcggggtaccctagtacgtaaacggttcgaggtcggacgtagtggactcgtagggactagtacttcactctacctactactcgacgctacgtctagacctaacgtagtaacgttntttaccgacttaacttaccgtaacgtcgtaactaacgtacgtacggtttaaccgacggttaaccccgttgttacccgtttacgggaccgtaacggacctacggtccgtagggtactacgtacgaaacgtgtcgtacgacctagtccacgttacg

SEQ ID NO: 218781 - DNA, 786 bp, Homo sapiens
  misc_feature: GYAE6OF01A0E5H.18.53.E09.1.454.CMB.1.raw
tcagtacgagtatgcacgaccggtgctcgatttagagagagtgtgttgggtttggggcagtctcagtcaggacacagcatggacatggagggtcccccgctcagctcctggggctcctgctactctggcctccggaggtcgccagatgtgacatccaggatcgacccagtcctccactccctccctgtctgcacttcgtggtaggagacagagtccacctatcctacgttcggacccgggtacaaggtccgaaggaacgtcctaaagtttacgaccgtaaggtacttttaaattttaaaagtttgggttaatacgaacgaacgaaaaggtaaaaaccggaacggggaaaccgtcccccgtaaacggtccttaccgtagtacttacgtagttacggaccttactacgttccgttaaggttttacgaaccgttaaccgggtccggggtacccttaagtcgttaaaacggggttcaagggttcgggtactaagggttcggtaaacttcgggtacggaacgttaggttacttacctacctacctaccaccgtaacgtccgactacggtcgtacgtaccacgtaaaccttagggtaaactttagtttacggaaccctttaacttaacccgttgtaacgtacgaaacgtacgttacgtaccgttaccgttaccgtttagttaccggttccggaacggtaccggtaacgagtacggtacggtaaacgtaaccggtaacgttaaaaccggacgggtttaggacccggttaccgacgttaccgtaacccttacgg

SEQ ID NO: 218782 - DNA, 744 bp, Homo sapiens
  misc_feature: GYAE6OF01BBE0B.18.53.E09.1.454.CMB.1.raw
  modified_base (242)..(242): a, c, t, g, unknown or other
  misc_feature (242)..(242): n is a, c, g, or t
  modified_base (342)..(342): a, c, t, g, unknown or other
  misc_feature (342)..(342): n is a, c, g, or t
tcagtacgagtatgcacgaccggtgctcgatttagagagagtgtgttgggtttggggcagtctcagtcaggacacagcatggacatgagggtcccccgctcagcctccgtggggcctcctgctactctggctccgaggtgccagatgtgacatccagatcgacccagtcctccatccctcccgtgtctgctattcgtaggtaggacacgagacgtccacctatcctacgttcggcccggganacgtcagagctaattacgcagtacttaatttaacgttgtactacagacaaacgaaacggaacggaacgaccccgtaagcctcgagtatctactgacctanaccttcgtagtttacgaacggtaacggtccggggtacctagttaacgtacggttacgaggtcggtacgtagggttggtacgtacggtacggggaacctaggttacttaccgtactcctacccaccgtaactaccgagtaaccgttcgtacgtaccgaacctaaccggttagtaaacgtttcgtttacgtaaccgttaactttaccgttaaccgttacgtaaccgtaacgtaaccggttaacgttaaccgtaccccggttacccgtttaaccggtttaccgttaccggggtaccggtaaccgggaacccgtacgggtacggttacggaacggtttacccgtaaacccggtaaacggtccggttacgggtaccggtaccgtacggtaccccctaaccgttccgg

SEQ ID NO: 218783 - DNA, 614 bp, Homo sapiens
  misc_feature: GYAE6OF01A6SL6.18.53.E09.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagtacgagtatgcacgaccggtgctcgatttagagagagtgtggttgggtttggggcagtctcagtcaggacacagcatggacatgagggtccccgctcagctcctggggctcctgctactctggctccgaggtgccagatgtgacatccagatcgacccagtctccatcctccctgtctgctatctgtacgganacagagtcaccatcacttgccgggntaagtcgagagctattagcagactatttaaattggtatctagcaagaaaacgaagggaaacgaccctaagctacctagatactatcgactactatccgtagtttagacgtaaacgtcggggtacccagttacgtaacggttacaaggtcggacgtacggtggaagttcgtagggactagtactttacgactcctcacctatacgacgactagtctacgtactaacctagtaacgttatttgtactaactttaacttactacgtacaacgtagtacgttaactacggttacccgttacgttacgtttcggaccgtacggggtaaccaaggtccgtaggtacgtacgtaacctaaaacggtacgtacggtacggacgttcgcgtaacccttacg

SEQ ID NO: 218784 - DNA, 228 bp, Homo sapiens
  misc_feature: GYAE6OF01EMH16.18.53.E09.1.454.CMB.1.raw
  modified_base (223)..(228): a, c, t, g, unknown or other
  misc_feature (223)..(228): n is a, c, g, or t
tcagtacgagtatgcacgaccggtgctcgatttagagagagtgtgttgggtttgggggaagaggaagactgacggtcctcccaggagttcaggtgctgggcaccgtgggcagtggggggaggtgtgtcacaagatttgggctcgtgggcacagccggccctgggctgcctggtcaaggactacttcccatactcgtactgagcgggctggcaaggcgcatagnnnnnn

SEQ ID NO: 218785 - DNA, 752 bp, Homo sapiens
  misc_feature: GYAE6OF01BK96L.18.53.E09.1.454.CMB.1.raw
  modified_base (98)..(98): a, c, t, g, unknown or other
  misc_feature (98)..(98): n is a, c, g, or t
  modified_base (214)..(214): a, c, t, g, unknown or other
  misc_feature (214)..(214): n is a, c, g, or t
  modified_base (372)..(372): a, c, t, g, unknown or other
  misc_feature (372)..(372): n is a, c, g, or t
  modified_base (544)..(544): a, c, t, g, unknown or other
  misc_feature (544)..(544): n is a, c, g, or t
tcagtacgagtatgcacgaccggtgctcgatttagagagagtgtgttggggtttggggcagtctcagtcaggacacagcatggacatgagggtccccnctcagctccgtggggctcctgctactctggcctccgaggtgccagatgtgactatccagatccgaccctagtcctcccacgtcccctcccgtgtcctgctacttcgtaggtagganaaccagacgtacaccatccgtaacgtcggaccgggactaaggtccagacgtacgtattacgaccagttactttaattaacgttgtactagacaacgaaagaaaaccgacggggtaaccacccgtagtacctaccgtgtaactcgtactacgtcctaancgtttaccgtaggttacgtaacggtaaccggttccgggtacctacggttacgtaggtaccgagggtcgacgtaggtcgtacgtggtaagtactcgtacgtttcgacccttcgtaccacgtacacgtacgacctacgttacgtaacctaaccgtacgtaggttaaaccgtttnttaaccgactttaaccgttacctaacggttaccaaagtaccttaagttaccggttaacccgtacggttttaaccccccggtttacgttttaaccgggttccggaaaccccgggttaaaggggaaccctacgggttcccaaggggtaacctaaacggttaacgaaacccgtagggtttcacccgggttataaccgtctaaccggttccg

SEQ ID NO: 218786 - DNA, 812 bp, Homo sapiens
  misc_feature: GYAE6OF01CNBTN.18.53.E09.1.454.CMB.1.raw
  modified_base (98)..(98): a, c, t, g, unknown or other
  misc_feature (98)..(98): n is a, c, g, or t
  modified_base (208)..(208): a, c, t, g, unknown or other
  misc_feature (208)..(208): n is a, c, g, or t
  modified_base (289)..(289): a, c, t, g, unknown or other
  misc_feature (289)..(289): n is a, c, g, or t
tcagtacgagtatgcacgaccggtgctcgatttagagagagtgtgttgggtttggggcagtctcagtcaggacacagcatggacatgagggtccccgntcagctccgtgggctcctgctactcgtggctccggaggtcgccagagtgtagacactccagactcgacccagttcctaccacttccctcctgtctgctatcgtggagganacagtacgtacaccatctacggtcggccggataagcgagcgactaagtacgacgacgtacttaaagtttaagtcgttaacncgaacgtaacgaaaacggaaaacgaacgggtaaaccctaccccgtaagtccctaccgtacggtacttaccgtaacgtaccgtaccttaactacccgttacgttaacggttacggaaccgttaaacgggttaccgggttaacctacggttaaccgttaagggttaaccgacggtaacggtacgtaaggttacggacgttacggtaggaaccttagttacctttaccgtactacctaaccgtacgtaccgtacgtaagacccgttacgtaccgtcgtaacccgttaacgttaacgttaacgtttacgttacgttaaaccttaaccgttaaccttaacgttaaccgtaactaaacggttaacgtttaaccgttaaacccggtaacccggtttacccgtttaccggttaacgggtttacccggaacggtaaccgggtaactaacgggtacgtaagggaacctaaacggtaaccggtaaaccgttacggtacggtacggaacctaccggttaacccgtgtttaacccg

SEQ ID NO: 218787 - DNA, 833 bp, Homo sapiens
  misc_feature: GYAE6OF01D3TVM.18.53.E09.1.454.CMB.1.raw
  modified_base (99)..(99): a, c, t, g, unknown or other
  misc_feature (99)..(99): n is a, c, g, or t
  modified_base (205)..(205): a, c, t, g, unknown or other
  misc_feature (205)..(205): n is a, c, g, or t
tcagtacgagtatgcacgaccggtgctcgatttagagagagtgtgttgggtttggggcagtctcagtcaggacacagcatggacatgacgggtccccgntcagctccgtggggcctcctgctactctggctccgaggtgccagatgtgacagtccaagatcgacccagtcctccacttccctcctgtctgcctatcgtgacgganacagagtccacctatcctacgttcggaccgggacaagtcagtagctaagttaggactaacgtactttaaagttttaaagttagggttaactacgtaacgacgaaaaacggaaaaacggaaccggggtaaaaccctaccccgtaaacgtacccttaccgtagtaacttacgtacgtacgtaccttaactacgtaccttagtttacggaacgttaacgggtaccggggtaccctaagtaacgttaacggttacgacgggttagacgtagggtaggacgttacgggtacgggtaactacgtttacttaccctacttacccgtaaccctaaccgtcgttaacgaaccggtcgtaacgttacgtcccgtaaccgtacgttaaagttaaccggtttaacgttttaccgaaacctttaacctttaaccgtacgttaaccgttaccgtaaacggttaagttaacccgttaaacggttacccgtttaacccggtttacggtttaacccggtttaccgggaaaccggttaaccgggtaaaccgaacgggttaccgttaagggaaacttaaacggtaaaacccggttaaacgtaaaccggttcgggttacccggacctttaaccgccgttaccggttaa

SEQ ID NO: 218788 - DNA, 557 bp, Homo sapiens
  misc_feature: GYAE6OF01AOXYG.18.53.E09.1.454.CMB.1.raw
  modified_base (255)..(255): a, c, t, g, unknown or other
  misc_feature (255)..(255): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagnagaaaacagggaaagcccctaagctcctgatctatgctacatccagtttgcaaaggtggggtcccatcaaggttcagtggcagtgatcgtggacagatttcactctcaccatcagcagtctgccaacctagaacgtattttgctaacttactactgtacaacagaacgttaaccgacgtttaaccccgtacgtttaaccgttttcgggacccgtaagggggaacccaaaggtccgttagggaacgtaacttaaccgaaaacccgtaacgttcggttacggacctcgacctaaccgttaaccg

SEQ ID NO: 218789 - DNA, 251 bp, Homo sapiens
  misc_feature: GYAE6OF01EZHDK.18.53.E09.1.454.CMB.1.raw
  modified_base (231)..(251): a, c, t, g, unknown or other
  misc_feature (231)..(251): n is a, c, g, or t
tcagtacgagtatgcacgaccggtgctcgatttagagagagtgtgttgggtttggggggaagaggaagactgacggtccctcccaggagttcaggtgcgtgggcaccggtggcagtggggggagtgtgtcacaagtatttgggctgtgggcacaggccggccctgggctcgcctggtacaaggactaccttccaatactcgtactgagcgggctggacaaggcgacatagnnnnnnnnnnnnnnnnnnnnn

SEQ ID NO: 218790 - DNA, 690 bp, Homo sapiens
  misc_feature: GYAE6OF01ERY5S.18.53.E09.1.454.CMB.1.raw
tcagtacgagtatgcacgaccggtgctcgatttagagagagtgtgttgggtttggggcagtctcagtcaggacacagcatggacatggacgggtccccgctcagctccgtggggcctcctgctactctggctccgaggtcgccagatgtgacactccgagatcggaccctagtcctaccacttccctcccgtgtctgctactcgtaggtaggagacagtacgtccaccatctacgttcggccgggactaacgtcgagacgactagttacgactagtactttaaagtttaaagttcggtaactacgaagtaacgaaaaggaaaacgaacgggtaaacccgtaccctaacggtccttacgtagtacttactatcgtacctacgtacttccgtaaggttacgaacggtaacggtccggtaccaagttacgtaagttacgaggtcggacgtaggtgtacgtcggtaggaactagttacttacacttacctacgactactacgacgtcgtacgttcaacgtaccgtaagttaggtaacgtttacgttaccgtaacttaactttctaacgttacgtaaccgaacgtacgtaaccgttacgtaccgtttaccggttacgttaccggtacggaccggtacggtaacgcggtacgtagacaacgtaaccgaagttcgtacgtacgtacacgtactcgtc

SEQ ID NO: 218791 - DNA, 685 bp, Homo sapiens
  misc_feature: GYAE6OF01B1GL2.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgaccagtctccatcctcctgtctgcatctgtaggagacagagtcaccatcacttcggccgggacaagtcagagactattagcacgtacttaatttaagtgtatacagacgaaagaaaacggaggaaaccgtacccgtaagtcctactagtacgttacacgtcgtaactactaactccgttaggtttacgaacggtaaacggtcgggttaccctaagtacgtaaggttcgaggtacggcgtaggtacggtacgtccggtaggaacttagttacgtttcaccgttccaacccgtactacgttacgagtaccgtacgttaccggacgtaccctaacggttagtaacggtttactttacgtaacttaacccggtttaacctacgttacgtaacctaacgtaacgttaaccggttaaccgttaacggttaccccggtttacgttacgttccgggaaccggtaccgggaacgttagcggtaaggacgtaacgtaacgtaaacggcgttcgggtacgacgtcggtaccctagttcg

SEQ ID NO: 218792 - DNA, 742 bp, Homo sapiens
  misc_feature: GYAE6OF01DOSDX.18.53.E09.1.454.CMB.1.raw
  modified_base (210)..(210): a, c, t, g, unknown or other
  misc_feature (210)..(210): n is a, c, g, or t
tcagtacgagtatgcacgaccggtgctcgatttagagagagtgtgttgggttggggcagtctcagtcaggacacagcatggacatgacgggtccccgctcagctccgtggggctcctgctactctggcctccgaagtcgccagtatgtgacactccagtactcgaccagttcctaccacttccctcctgtctgctactcgtaggtagganacgagtacctcacctactcgtaccgttcggaccgggtactaacgtcaggactactaagttacgctagttactttaagtttaagtcggtactacgaagaaccgaaggaaaacgtacgggtaacctaccccgtaagtccttaccggtatacttcgtaagttaccgtacctacgtacttacgtttaggtacgaacgggttaacggtccggggtaacctaggtacgttaacggtcgagggtcgtacgtaggtggtactacgggacgtacgttagtacttaccgtacttccgacctacctataccgtacgtacgtacgtaccggtactaaccgtacgttaagtaacgtttaactttacgtaccttaacgttacgtaaccgttcgtaacgtacgtaacgggtttaccgtaaccgttaacccggttaccgtttacggtaccgttaccgggtacggtaaaccggtacgtaacgggtacgtacggtaacgtaacttaacccggaaacgtcgtacgggtatacccgtagtaccctgttaccg

SEQ ID NO: 218793 - DNA, 849 bp, Homo sapiens
  misc_feature: GYAE6OF01ANFMQ.18.53.E09.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagtacgagtatgcacgaccggtgctcgatttagagagagtgtgttgggtttggggcagtctcagtcaggacacagcatggacatgacgggtccccgctcagctccgtggggctcctgctactctggctccgaggtgccagatgtgacatccagatcgaccctagtcctccatccctcccgtgtctcgctatctggagggnacgagagtcaccatctacttggccggcaagtcagancattagcagttacttaattttaaacgttgggtaacttcgaacgacgaaaacggaaaacgaacggggaaaacctaccccccgttaaaggtcccttaccgtacgtaacgttactttacggtcgttacctaacgtaaccttacccgtttaagtttaacgggtaccgtaaaaccggggttccgggggtttaccccctaagttaaccgggttaaacgggttcgtacggggtttaccgggtaaccggtaggggttacggggttactaccggggttaacgggggtaacttaaccgggttttactttacccggttaaccgttacccgtaaccctaaccgtacgtttaacccgaacgttacggtttaaccttaccgttaacggtacctaaaccggttaagggtaaactttacgtttttaaccggaaccctttaaacgttttacccgttacgttacccgtaactaaacgtacgggtttacggttaacctaccggtttaccccggttacgtttaccgttacgggaccggttaaccgggaaccgtaggtccggtaagggtaacaacggttaaacaccggtttaccggtcggttacggtacggtcctaaccgtaaccgtttacg

SEQ ID NO: 218794 - DNA, 836 bp, Homo sapiens
  misc_feature: GYAE6OF01E0TAF.18.53.E09.1.454.CMB.1.raw
tcagtacgagtatgcacgaccggtgctcgatttagagagagtgtgttgggtttggggcagtctcagtcaggacacagcatggacatggagggtcccccgctcaggctccgtggggctcctgctactctggctccgaggtgccagatgtgacatccagatcgaccctacgtccccttcttccgtgtctgcgtcgtgtaggagaccgagtccaccatctacgttcggtcgggacgaactcgaaggaattaaagttaaaaccgttggtttagtttaggtactacgagacgaaacgaaaaccgaaggaaaaccgtaccccgtaagctacgacgagtagttacggtagtttccgggttcccgttaccgtaaccgttaccgtaaacggacggtacccgggtaaccccgtagttacccgggaagttaccggtttaccggtaccgttaaccggaggtttacggtaagtaccgggttagggaaaccgtacggttaacgttttacctaaccggttcccttaacccgtaacccgtaactacgaaccggtaccgtacggtaccccttacggacgtaacgtacccgttaaaggttaacgtttaagttttaccgtaaccttaaacccgtttacttaagtttacgtccgtaagcgacgttaccgaccttaaccgttactacccgtacgtcttacgggttaccggtacggaaccgggtacgtaaacggggttaggtaaccgtaacgtaaacgtaaaccggggtaactttagggtacgaccccggttacgacccgtaaaccgttaccgtttaccgttaccggttaaccttacccgttacccgtttacccccgg

SEQ ID NO: 218795 - DNA, 918 bp, Homo sapiens
  misc_feature: GYAE6OF01B5HLM.18.53.E09.1.454.CMB.1.raw
  modified_base (99)..(99): a, c, t, g, unknown or other
  misc_feature (99)..(99): n is a, c, g, or t
  modified_base (140)..(140): a, c, t, g, unknown or other
  misc_feature (140)..(140): n is a, c, g, or t
  modified_base (213)..(213): a, c, t, g, unknown or other
  misc_feature (213)..(213): n is a, c, g, or t
tcagtacgagtatgcacgaccggtgctcgatttagagagagtgtggttggggttggggcagtctcagtcaggacacagcatggacatgacgggtccccnctcagctcgtggggctcctgctactctggctccggaggtcnccagagtgtgacatccagtatcgaaccctagtcctaccactccctcctgtctcgctagtcgtaggtaacgganacgtaagcgtaccaactacgttacctaccggttcgggacccggggtactaaacggtcgaacgggtacgtaccttaaagttacgacgtaacggttaacctttaaagtttaaaacgttcggttaactacgaacgtaaacgaaaacggaaaaccgtaacggggaaaccctaccccgtaacggtaccctacgtagtacttacgtacgtacgtaaccttaccgtacgttaccgttaaggttacggaaacggttaaacggggtccggggttacctaaacggttaccgggtaaacggttacggtacgggtacggtaacgtacgggttacggtaacgtccgggttaaaggtacgtaaacgtttaccgtttacccgtaaccgttccgtaaccctaaccgtactaaccgtacggacccgttacggtacccgtaagaacccgtaaccgttaaaggtaacgttttaacgtttacccggtaaactttaaaccggtttacccgtagtaacccgtaaacgtaaacggttaacgttaccgttaaaccgttaacccgggtttacccgtttaagggttttacccggttaaccgggggtaacccgggtacggggtaaaccgttaaccgggtccggggttaaagtacccgggttaaaactaaaaccggggtaaaccttacgggtacggtacggtaacctaccggtaaacttacccgtttacccgg

SEQ ID NO: 218796 - DNA, 760 bp, Homo sapiens
  misc_feature: GYAE6OF01BDU5H.18.53.E09.1.454.CMB.1.raw
  modified_base (97)..(97): a, c, t, g, unknown or other
  misc_feature (97)..(97): n is a, c, g, or t
  modified_base (164)..(164): a, c, t, g, unknown or other
  misc_feature (164)..(164): n is a, c, g, or t
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
tcagtacgagtatgcacgaccggtgctcgatttagagagagtgtgttgggtttgggcagtctcagtcaggacacagcatggacatgagggtccccgntcagctcgtgggctcctgctactctggctccggaggtgccagatgtgacatccagatgacccagtcnccatcctcctgtctgcatcgtgagganacagagtcaccatctacgttggaccggganaagtaacgagacaagtttaggcctaaggtacctttaaagttttaaaacgttgggtaactacgtaagaccgaaaaggaaaaaccggaacggggaaaaccgtaccccctaaaacgtccgttacccttaggtacttacgttaacgtcggtacctaactacgtaccgtaaggttttacgtaccgtaaaagggtcgggtaccctagtacggtaacgttacgaaggttcggacgtaggtaggtacgttaccgggtagggttaacaggttacctttacgaaccgttactaccgtaaccgtacttacgaacgtaccgtacgttaccgtagtaccgtaactttacggtaaacgtttactttaacgaccgtttaaacgtttaacgtacctttacggacctaagggccgtaacgggtaccgtaacgtaacccttaccggttaccccgtacgttaccgtaaccgggtttccggaaccgggtaaccgggaaccgtacgggtaggaacgtacgtaaaccgaacgtaccgtcgtaccggctacgtacctaaccg

SEQ ID NO: 218797 - DNA, 670 bp, Homo sapiens
  misc_feature: GYAE6OF01ADHG1.18.53.E09.1.454.CMB.1.raw
  modified_base (150)..(150): a, c, t, g, unknown or other
  misc_feature (150)..(150): n is a, c, g, or t
  modified_base (379)..(379): a, c, t, g, unknown or other
  misc_feature (379)..(379): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
  modified_base (473)..(473): a, c, t, g, unknown or other
  misc_feature (473)..(473): n is a, c, g, or t
tcagtacgagtatgcacgaccggtgctcgatttagagagagtgtgttgggtttggggcagtctcagtcaggacacagcagtggacatggacgggtccccgctcagctccgtggggcctcctgctactctgctcggagtcgccagatgtanacatccgagtactaccgaccccagttcctccacttcccctccgtggtactgctagttcgtaggaggacgacgagacgtaccgacctatccgtacgtcgggccggactaagtcgaacgagtactagttacgactagttaactttaagttttaagtggtactacgagaacgaaaacggtaaacggaaccgggtaaccctaccctagtccctacgttacgtacttagtaccncgtacctacgtactacgtagtacggacgtacgggtccgactagtaccgagtgagngagngtgatcggagtatagttactacnctcgactaccgntaccgtagtccgtatacgtaccgtactaggtagttaactttctaacgtaccttattaccgtaacgctaacgaacgtagttaaccgttacctaccgggttactttaccggtacggttacggacggtaaaccggtcgtcggtaccggtaggtaccaccgtaacggtacggcgttcggaccgacctactaccgttagtcc

SEQ ID NO: 218798 - DNA, 241 bp, Homo sapiens
  misc_feature: GYAE6OF01BHA1W.18.53.E09.1.454.CMB.1.raw
  modified_base (219)..(219): a, c, t, g, unknown or other
  misc_feature (219)..(219): n is a, c, g, or t
  modified_base (225)..(241): a, c, t, g, unknown or other
  misc_feature (225)..(241): n is a, c, g, or t
tcagtacgagtatgcacgaccggtgctcgatttagagagagtgtgttgggtttgggggaagaggaagactgacggtcctcccaggagttcaggtgctgggccaccgtgggcagtggggggaggtgtgtcaacaagatttgggctctgggcacagcggccctgggctgcctggtcaaggactacttcccatactcgtactgagcgggctggcaaaggcgnaatagnnnnnnnnnnnnnnnnn

SEQ ID NO: 218799 - DNA, 592 bp, Homo sapiens
  misc_feature: GYAE6OF01BMFI3.18.53.E09.1.454.CMB.1.raw
  modified_base (98)..(98): a, c, t, g, unknown or other
  misc_feature (98)..(98): n is a, c, g, or t
tcagtacgagtatgcacgaccggtgctcgatttagagagagtgtgttgggtttggggcagtctcagtcaggacacagcatggacatgagggtccccgntcagctcctggggctcctgctactctggctccgaggtgccagatgtgacatccagatgacccagtcctccatccctcctgtctgcattcgtggtaggagacagacgtaccaccatcacgttggcccgggacaagtcagagctattagcagtacttaatttaaattggtatacaagacaagaaaacgaacgggaaacgtcccctaaagcctcctagtatactatacgactactatacctagtttacgaacgtaaaggtccgggtacccaagtacgtaacggttcgagtacggactaggtaggacgtcgtagggactagtacttacactctacaccatacgagactagtactacgacctaaccgtagtaacttagtttcgaactaactttacctatgtaacaacagtacttaacgacgttacccgttacgttacgttaggaccgtacgggactagcgtagaagtacgacaaacgtacgtagtggatcgcacgtacg

SEQ ID NO: 218800 - DNA, 735 bp, Homo sapiens
  misc_feature: GYAE6OF01CHZLP.18.53.E09.1.454.CMB.1.raw
  modified_base (97)..(97): a, c, t, g, unknown or other
  misc_feature (97)..(97): n is a, c, g, or t
  modified_base (122)..(122): a, c, t, g, unknown or other
  misc_feature (122)..(122): n is a, c, g, or t
  modified_base (155)..(155): a, c, t, g, unknown or other
  misc_feature (155)..(155): n is a, c, g, or t
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (347)..(347): a, c, t, g, unknown or other
  misc_feature (347)..(347): n is a, c, g, or t
tcagtacgagtatgcacgaccggtgctcgatttagagagagtgtggttgggtttggggcagtctcagtcaggacacagcatggacatgaggtccccntcagctcgtgggctcctgctactcnggcctccggaggtgccagatgtgacatccaagntcgaccctagtcctccatccctcctgtactgctatcgtagaggacacngtagtaccactaatctacgtcggccgtanaagtcgaggcatatagctagtactttaagttaaagttggacctaggacgtaacgaaacggtaaaaccgacgggtaaaccctacccgtaaagccgtactaacgactcgtttaaacncgtaccctataccgttacgtaggttacacggttaacggtccggtacctaacgacggtttacgtagtacgtcggaagacggttaggacgtccggttaagaccttaagtttaaccttcccactccgtaaccactacgacgtacgtctacggtcgtacgacctaacggttaacgtaagtttacgttaacgtaccttaacgttaccgtacgttacgtaacgtaaccgtaacggttaaccgtaccgttaacgtttacccggttaacgtttacccgggtacggtaaccgggtacggtaacccgtaggtaccggtaaagtacggtaaccgttaaaccggtaaaccgtaccgggttaggttcccggttaccggacctttaaccgaccgtttaccgg

SEQ ID NO: 218801 - DNA, 253 bp, Homo sapiens
  misc_feature: GYAE6OF01BSSGU.18.53.E09.1.454.CMB.1.raw
  modified_base (86)..(86): a, c, t, g, unknown or other
  misc_feature (86)..(86): n is a, c, g, or t
  modified_base (184)..(184): a, c, t, g, unknown or other
  misc_feature (184)..(184): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (215)..(217): a, c, t, g, unknown or other
  misc_feature (215)..(217): n is a, c, g, or t
  modified_base (219)..(253): a, c, t, g, unknown or other
  misc_feature (219)..(253): n is a, c, g, or t
tcagtacgagtatgcacgaccggtgctcgatttagagagagtgtgttgggtttgggggaagaggaagactgacggtcctcccaggngttcaggtgcgtgggcaccgtgggcagtgggggagtgtgtcacagatttgggctctgggcacagcggcctgggctgcctggtcaaggctatccatacngtatgagcgggctggcaaggcgcatgnancnnngnnnnnnnnnnnnnnnnnnnnnnnnnnnnnnnnnnn

SEQ ID NO: 218802 - DNA, 752 bp, Homo sapiens
  misc_feature: GYAE6OF01DZB3O.18.53.E09.1.454.CMB.1.raw
  modified_base (194)..(194): a, c, t, g, unknown or other
  misc_feature (194)..(194): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtcctccatcctccctgtctgcatctgtagganacagatccacatctacttggccggacaagtcaagagtcattagctaagtacttaaattttaaagttgggttaactacgaaggaacgaaaaggaaaaaccgaacggggaaaaccgtacccccgttaaaggtccctttaccgtaggtaacttaccgttaagtaccgtaaccttacacgtttacccggttaaggttttacggaaccgtaaaacggggttccggggtaccctaaggttaccgtaaaggggttcctaaggggttcggacgtaagggtacgtacgttacggtaaggggaacctagttacgttttaccaccttaccgtacccaacctacgtaccgacgtaccgtaccgtacccgtaaccgtaaccgtagtaacgttacgttttacgaaccttaacgttaactacgtactaactaacgtacggtaacgttaccgtacgtttacccgttacgtttaccggtttacggacccggtacgggtaaccgagttaccggtaaggtacgtaactaaccggaaacgtacgttcggtacggtactagtacccacgtcgtttaccg

SEQ ID NO: 218803 - DNA, 699 bp, Homo sapiens
  misc_feature: GYAE6OF01BQUUV.18.53.E09.1.454.CMB.1.raw
  modified_base (98)..(98): a, c, t, g, unknown or other
  misc_feature (98)..(98): n is a, c, g, or t
  modified_base (320)..(320): a, c, t, g, unknown or other
  misc_feature (320)..(320): n is a, c, g, or t
  modified_base (685)..(685): a, c, t, g, unknown or other
  misc_feature (685)..(685): n is a, c, g, or t
tcagtacgagtatgcacgaccggtgctcgatttagagagagtgtgttgggtttggggcagtctcagtcaggacacagcatggacatgagggtccccgntcagctcctggggctcctgctactctggctccggaggtcgccagatgtgacatccagatcgacccagtcctaccactccctcctgtctgctactctaggtaggacgacagacgtaccaccatccaccgttcggcccgggacaacgtcaggtacactaattacgatacgtactttaaagtttaacgtgtactacgagacgtaaacgaaaggaacgggtaaccnccccgttaagccttccgtagtacgttactagtaccgtactaacaccgttactaggttacgaaccggttaagggtccggtacctaagttacggaacgggtttacaagggtcggacgttaaggtacgtacgttacgggacgtactaagtttaccctcgacccttagtacccctagtacgactacgacgtacgttacaccgtaccgtacgttagaactttagttctaacctttaactactactagtaaccgaagtacgtacgttaccgttaccgttacccggttagttaccggttacggaccggtaacggtaacctacggtcggttaagaacgtaccgtaaaacgacgttaacggtcgtacgggtacnccgtacgtcttccg

SEQ ID NO: 218804 - DNA, 701 bp, Homo sapiens
  misc_feature: GYAE6OF01ETKBA.18.53.E09.1.454.CMB.1.raw
  modified_base (98)..(98): a, c, t, g, unknown or other
  misc_feature (98)..(98): n is a, c, g, or t
tcagtacgagtatgcacgaccggtgctcgatttagagagagtgtgttgggtttggggcagtctcagtcaggacacagcatggacatgaacggtccccntcagctccgtggggctcctgctactctggctccgaggtgccagatgtgacatccaagatcgaccctagtcctaccacttccctcctgtactgctactcgtaggtaaggacgaacaggacgtaccaccaatctacgttcggccgggacaaggtcagacgtactaattacgactaagtacttaaattttaaagttaggtatacaagaacgaaaggaaaacgaacgggtaaacccgtaccccaacgtcctacgtagtacttactatacgactactactacgttagttagaacgtaaggtccggtacagtacgacgttacgaggtggacgtaggtcgtacgtacgtaggaatagtacttaccgactcctaactacgactacgagaactacgtcgtaaccgtacctaaacgtagtaaacgttactttaccgaacctttaaccgttactacgtaacgtaacaaccgttaagtacgttaaacctacggttacccgttacgttaccggtttacggaccggtaacggtaacctaggtaccgtaaagggaactaacggtaaacgtaaaccgttaggttaccggtaacggacctaacgtaaaccgtccttaacg

SEQ ID NO: 218805 - DNA, 671 bp, Homo sapiens
  misc_feature: GYAE6OF01B9C7Q.18.53.E09.1.454.CMB.1.raw
  modified_base (97)..(97): a, c, t, g, unknown or other
  misc_feature (97)..(97): n is a, c, g, or t
  modified_base (137)..(137): a, c, t, g, unknown or other
  misc_feature (137)..(137): n is a, c, g, or t
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (441)..(441): a, c, t, g, unknown or other
  misc_feature (441)..(441): n is a, c, g, or t
  modified_base (622)..(622): a, c, t, g, unknown or other
  misc_feature (622)..(622): n is a, c, g, or t
tcagtacgagtatgcacgaccggtgctcgatttagagagagtgtgttgggtttgggcagtctcagtcaggacacagcatggacatgagggtccccgntcagctccgtggggctcctgctactctggcctccgaggtnccagatgtgacatccagatcgaacccagtcctccacttccctccgtgtctgcctatctaggagganacagtacgtaccaacatccacgttcggaccgganaagtcaagagactattacgctagtactttaaagttttaaaagttcggtaactacgaacggacaaaacggtaaaaacggaacgggtaaacccgtacccccgttaaagtcccgttacccgtagtaacttacgtaacgtcgacctaacgtacttacgttaggttacgaacgtaaggtccggtacctagtacgtaggtcaagtgacgngtagatcgaggactagtacttccgacctcgtaacctactagtaccgagtaccgtgttacacgtacgtaaccgttggaaatttcgttactactttaaaccttacttacgtactaaccgtaacgtacggttacttaaccgtacgttacccgtttacgttacggttcggaacgtacgggtaacncgtagggtacacggtacaacgaagtacgtcggactctacacgtcgtacg

SEQ ID NO: 218806 - DNA, 680 bp, Homo sapiens
  misc_feature: GYAE6OF01BRCHH.18.53.E09.1.454.CMB.1.raw
  modified_base (453)..(453): a, c, t, g, unknown or other
  misc_feature (453)..(453): n is a, c, g, or t
  modified_base (507)..(507): a, c, t, g, unknown or other
  misc_feature (507)..(507): n is a, c, g, or t
tcagtacgagtatgcacgaccggtgctcgatttagagagagtgtgttgggtttgggcagtctcagtaaggacacagcatggacatgagggtccccgctcagctcctggggctcctgctactctggctccggaggtcgccagatgtgacatccagatcgacccagtcctccacttccctccctgtctgctattcgtaggtaggagacagacgtaccaacctactcgacgttcggacccggtactaagtcgaagacgtactagttacgctaacgttacttttaaaagttttaaacgttggtaactacggaagtaaccgaaaaggaaaaaccggtaggggtaaaacccgtacccccttaaaggtcctacccgttagtactttacgtacgtcgtaacctacctacgttaccggttaagttacggtaacgtaacgggtccgtaccagtcgtaaacgtnacggtcgagaggtcggatcgggtacgactagttacctacgaccttcacaacctntacgagtcgtaacgttcaacgtacctaacgtgttaattacgtttacgaacctttaccgttaactcgtaacctacaacgttagttaccgtaccctaggttaccccgttgttacggtcgaacgtacggacagtgtacgataccgtagaaccgtgtcgacgcacgctacctgtccg

SEQ ID NO: 218807 - DNA, 878 bp, Homo sapiens
  misc_feature: GYAE6OF01EFLFP.18.53.E09.1.454.CMB.1.raw
  modified_base (98)..(98): a, c, t, g, unknown or other
  misc_feature (98)..(98): n is a, c, g, or t
  modified_base (394)..(394): a, c, t, g, unknown or other
  misc_feature (394)..(394): n is a, c, g, or t
tcagtacgagtatgcacgaccggtgctcgatttagagagagtgtgttgggtttgggcagtctcagtcaggacacagcatggacatgacgggtccccgntcagctccgtgggctcctgctactctggctccggaggtcgccagatggtagacatccagactcgacccctagtcctccacttccctcccgttagtcgtgtactattcgtaggtaaggacacgacgtacgtccaacctgtcctacgttcgggaccggtacaaaggtccgaaggactacttaagttacggactaacgttaacttttaaaattttaacggttcggtaactacgaacgaaaccgaaaacggtaaaaccggaaccgggtaaaccctaccccgtaagtcccgttaaccggtnttaaccttcgtaacgtcgtaactacgttacgttccgttaaggtttacgacgttaacggttccggacctagtacggtagtcgaggtcgacgtagtgtacgtcgtaggaactagtttacttccgactaccgtaaccaacgtcgttacgaacggtccttaacttccgacgtaacccgttacggttaaacgttaacgtttaccgtttaacgtacccttttaaaaccggttacgttaacgtacccgttaaacggaaaacctttcgggggtttaaaccctttaaccccgggttaaccgggtttaccccggtttttaaccggtttaaccgggttaccgggggaaaccccgggttaaaccgggggtaaaccttacccgggttaacgggttaacccgtaaacggttaaaccggttaaaacccccgtaaggggtttaacccgtttcgggttacccgggtaacctttacccgggaaacctttaaccggttaccgg

SEQ ID NO: 218808 - DNA, 685 bp, Homo sapiens
  misc_feature: GYAE6OF01C6JXK.18.53.E09.1.454.CMB.1.raw
  modified_base (97)..(97): a, c, t, g, unknown or other
  misc_feature (97)..(97): n is a, c, g, or t
  modified_base (137)..(137): a, c, t, g, unknown or other
  misc_feature (137)..(137): n is a, c, g, or t
  modified_base (454)..(454): a, c, t, g, unknown or other
  misc_feature (454)..(454): n is a, c, g, or t
  modified_base (528)..(528): a, c, t, g, unknown or other
  misc_feature (528)..(528): n is a, c, g, or t
  modified_base (669)..(669): a, c, t, g, unknown or other
  misc_feature (669)..(669): n is a, c, g, or t
tcagtacgagtatgcacgaccggtgctcgatttagagagagtgtgttgggttgggcagtctcagtcaggacacagcatggacatggacgggtccccntcagctccgtgggctcctgctactctggcctccggaggtnccagatgtgtaacactccgaagatcggaccctagtcctccattccctccgtgtcctaggctagttccgtaggtaggacgtacgaggtactaccacctattaccgtaccgttcggaccgggtactaagtcgaagcgtactagtacgctagtactttaatttaacgtgtactacgacgtacgaaaagaaacggtacggaaccctacccgtaaagtccgtacctaggtacttacgtagttacgaaccttaacgtaccgttacgtagtttacggaaccgtaacgggttccggacctaagttacgtaacgtcgaggtgacgngtcgatcggaggactagttccttaccacgtttccacgtaacctagtcacggtctacggtccagacctaacgttntaaactttcttaaccgaacttacgttacgtacttagaaccctagttagtactaccgtaccgttaccgtggttaacgtccgaacggaggtacgtaggtccgtaagaacgttaccttaacggaagttcgggttcacccgttanacggtcctaacgttcg

SEQ ID NO: 218809 - DNA, 217 bp, Homo sapiens
  misc_feature: GYAE6OF02FLWZ0.18.53.E09.1.454.CMB.1.raw
  modified_base (216)..(217): a, c, t, g, unknown or other
  misc_feature (216)..(217): n is a, c, g, or t
tcagtacgagtatgcacgaccggtgctcgatttagagagagtgtgttgggtttgggaagaggaagactgacggtcctcccaggagttcaggtgctgggcaccgtgggcatggggaggtgtgtcacaagatttgggctctgggcacagcggccctgggctgcctggtcaaggactacttcccatactcgtactgagcgggctggcaaggcgcatagnn

SEQ ID NO: 218810 - DNA, 239 bp, Homo sapiens
  misc_feature: GYAE6OF02HPEUW.18.53.E09.1.454.CMB.1.raw
  modified_base (221)..(239): a, c, t, g, unknown or other
  misc_feature (221)..(239): n is a, c, g, or t
tcagtacgagtatgcacgaccggtgctcgatttagagagagtgtgttgggtttgggggaaggaggaagactgacggtcctcccaggagttcaggtgctgggcaccgtgggcatgggggaggtgtgttcacaagatttgggctctgggcacagcggccctgggctgcctggtcaaggactacttcccatactcgtactgagcgggctggcaaggcgcatagnnnnnnnnnnnnnnnnnnn

SEQ ID NO: 218811 - DNA, 240 bp, Homo sapiens
  misc_feature: GYAE6OF02JIPJA.18.53.E09.1.454.CMB.1.raw
  modified_base (219)..(240): a, c, t, g, unknown or other
  misc_feature (219)..(240): n is a, c, g, or t
tcagtacgagtatgcacgaccggtgctcgatttagagagagtgtgttgggtttggggaaggaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnnnnnnnnnnnnnnnnnnnnn

SEQ ID NO: 218812 - DNA, 175 bp, Homo sapiens
  misc_feature: GYAE6OF02IJBAU.18.53.E09.1.454.CMB.1.raw
  modified_base (174)..(175): a, c, t, g, unknown or other
  misc_feature (174)..(175): n is a, c, g, or t
tcagtacgagtatgcacgaccggtgctcgatttagagagagtgtgttgggtttgggggaagaggaagactgacggtcctcccaggagttcaggtgctgggcacagcggccctgggctgcctggtcaaggactacttcccatactcgtactgagcgggctggcaaggcgcatagnn

SEQ ID NO: 218813 - DNA, 481 bp, Homo sapiens
  misc_feature: GYAE6OF02GHJVM.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtcccatcaaggttcagtggcagtggatctgggacagatttcactctcacatcagcagtctgcaacctgaagattttgactaacttactactgtacaacagagttacagtaccctgtactttggcctagggaccaagctaggagatacaacgactgtgctgcacta

SEQ ID NO: 218814 - DNA, 218 bp, Homo sapiens; identical to SEQ ID NO: 218610
  misc_feature: GYAE6OF02HQIK0.18.53.E09.1.454.CMB.1.raw
  modified_base (217)..(218): a, c, t, g, unknown or other
  misc_feature (217)..(218): n is a, c, g, or t

SEQ ID NO: 218815 - DNA, 219 bp, Homo sapiens; identical to SEQ ID NO: 218622
  misc_feature: GYAE6OF02HND3E.18.53.E09.1.454.CMB.1.raw
  modified_base (219)..(219): a, c, t, g, unknown or other
  misc_feature (219)..(219): n is a, c, g, or t

SEQ ID NO: 218816 - DNA, 483 bp, Homo sapiens
  misc_feature: GYAE6OF02GGK38.18.53.E09.1.454.CMB.1.raw
  modified_base (271)..(271): a, c, t, g, unknown or other
  misc_feature (271)..(271): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaanccctaagctcctgatctatgctacatccagtttgcaaagtgggtccatcaaggttcagtgcagtgatctgggacagatttcactctcacatcagcagtctgcaacctgaagtattttgactaacttactactagtcaacagtagttacagtacccgtcgttactttggcctagggaccaagctggagatacgaagactgtggctcgcactac

SEQ ID NO: 218817 - DNA, 220 bp, Homo sapiens; identical to SEQ ID NO: 218613
  misc_feature: GYAE6OF02FF7AU.18.53.E09.1.454.CMB.1.raw
  modified_base (219)..(220): a, c, t, g, unknown or other
  misc_feature (219)..(220): n is a, c, g, or t

SEQ ID NO: 218818 - DNA, 220 bp, Homo sapiens; identical to SEQ ID NO: 218613
  misc_feature: GYAE6OF02F8Z1H.18.53.E09.1.454.CMB.1.raw
  modified_base (219)..(220): a, c, t, g, unknown or other
  misc_feature (219)..(220): n is a, c, g, or t

SEQ ID NO: 218819 - DNA, 220 bp, Homo sapiens; identical to SEQ ID NO: 218613
  misc_feature: GYAE6OF02IBLOK.18.53.E09.1.454.CMB.1.raw
  modified_base (219)..(220): a, c, t, g, unknown or other
  misc_feature (219)..(220): n is a, c, g, or t

SEQ ID NO: 218820 - DNA, 220 bp, Homo sapiens; identical to SEQ ID NO: 218613
  misc_feature: GYAE6OF02G8T2Y.18.53.E09.1.454.CMB.1.raw
  modified_base (219)..(220): a, c, t, g, unknown or other
  misc_feature (219)..(220): n is a, c, g, or t

SEQ ID NO: 218821 - DNA, 218 bp, Homo sapiens
  misc_feature: GYAE6OF02H129H.18.53.E09.1.454.CMB.1.raw
  modified_base (216)..(218): a, c, t, g, unknown or other
  misc_feature (216)..(218): n is a, c, g, or t
tcagtacgagtatgcacgaccggtgctcgatttagagagagtgtgttgggtttgggaagaggaagactgacggtcctcccaggagttcaggtgctgggcaccgtgggcatggggaggtgtgtcacaagatttgggctctgggcacagcggccctgggctgcctggtcaaggactacttcccatactcgtactgagcgggctggcaaggcgcatagnnn

SEQ ID NO: 218822 - DNA, 138 bp, Homo sapiens
  misc_feature: GYAE6OF02IHC9B.18.53.E09.1.454.CMB.1.raw
  modified_base (137)..(138): a, c, t, g, unknown or other
  misc_feature (137)..(138): n is a, c, g, or t
tcagtacgagtatgcacgaccggtgctcgatttagagagagtgtgttgggtttgggctctgggcacagcggccctgggctgcctggtcaaggactacttcccatactcgtactgagcgggctggcaaggcgcatagnn

SEQ ID NO: 218823 - DNA, 219 bp, Homo sapiens; identical to SEQ ID NO: 218622
  misc_feature: GYAE6OF02HZ67H.18.53.E09.1.454.CMB.1.raw
  modified_base (219)..(219): a, c, t, g, unknown or other
  misc_feature (219)..(219): n is a, c, g, or t

SEQ ID NO: 218824 - DNA, 176 bp, Homo sapiens
  misc_feature: GYAE6OF02JNK3I.18.53.E09.1.454.CMB.1.raw
  modified_base (172)..(176): a, c, t, g, unknown or other
  misc_feature (172)..(176): n is a, c, g, or t
tcagtacgagtatgcacgaccggtgctcgatttagagagagtgtgttgggtttggggaaggaggaagactgacggtccccaggagttcaggtgctgggcacagcggccctgggctgcctggtcaaggactacttcccatactcgtactgagcgggctggcaaggcgcatagnnnnn

SEQ ID NO: 218825 - DNA, 219 bp, Homo sapiens
  misc_feature: GYAE6OF02GSCRJ.18.53.E09.1.454.CMB.1.raw
  modified_base (218)..(219): a, c, t, g, unknown or other
  misc_feature (218)..(219): n is a, c, g, or t
tcagtacgagtatgcacgaccggtgctcgatttagagagagtgtgttgggtttgggggaagaggaagactgacggtcctcccaggagttcaggtgctgggcaccgtgggcatgggggaggtgtgtcacaagatttgggctctgggcacagcggccctgggctgcctggtcaggactacttcccatactcgtactgagcgggctggcaaggcgcatagnn

SEQ ID NO: 218826 - DNA, 485 bp, Homo sapiens
  misc_feature: GYAE6OF02FRXHT.18.53.E09.1.454.CMB.1.raw
  modified_base (415)..(415): a, c, t, g, unknown or other
  misc_feature (415)..(415): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtcccatcaaggttcagtggcagtgatctgggacagatttcactctcaccatcagcagtctgcaacctgaagtattttgactaacttactactgtacaanagagttacagtacccgtcgttactttgcctagggaccagctaggagatacgaacgactgtggctgcacta

SEQ ID NO: 218827 - DNA, 506 bp, Homo sapiens
  misc_feature: GYAE6OF02HXZHN.18.53.E09.1.454.CMB.1.raw
  modified_base (269)..(269): a, c, t, g, unknown or other
  misc_feature (269)..(269): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctattaaattggtatcagcagaaaacagggaaancccctaagctcctgatctatgctacatccagtttgactaaaggtcggggtacccagtacaaaggttcaaggttggcaggtggatcgtgggacagtatttcactctcaccatcagcagtctgacaacctgaagtatttgactaacttactactgtacaactagagttacacgttacccgtcgtacgtttacggcctagggaccaagtcgtggagatacaaacgactgtgctcgcacta

SEQ ID NO: 218828 - DNA, 177 bp, Homo sapiens
  misc_feature: GYAE6OF02IB5RS.18.53.E09.1.454.CMB.1.raw
  modified_base (172)..(177): a, c, t, g, unknown or other
  misc_feature (172)..(177): n is a, c, g, or t
tcagtacgagtatgcacgaccggtgctcgatttagagagagtgtgttgggtttgggggaagaggaagactgacggtcccccaggagttcaggtgctgggcacagcggccctgggctgcctggtcaaggactacttccctactcgtactgagcgggctggcaaggcgcatagnnnnnn

SEQ ID NO: 218829 - DNA, 221 bp, Homo sapiens; identical to SEQ ID NO: 218634
  misc_feature: GYAE6OF02IPP30.18.53.E09.1.454.CMB.1.raw
  modified_base (220)..(221): a, c, t, g, unknown or other
  misc_feature (220)..(221): n is a, c, g, or t

SEQ ID NO: 218830 - DNA, 484 bp, Homo sapiens
  misc_feature: GYAE6OF02FIAW8.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaacaggaaagcccctaaagctcctgatctatgctacatccagtttgcaaagtggggtcccatcaaggttcagtggcagtggatctgggacagatttcactctcaccatcagcagtctgcaacctgaagattttgctaacttactactgtacaacagagttacagtacccgtcgtactttggcctagggaccaagctggagatacaaacgactgtggctgcactac

SEQ ID NO: 218831 - DNA, 494 bp, Homo sapiens
  misc_feature: GYAE6OF02F61N2.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtccatcaaggttcagtggcagtggatctgggacagatttcactctcaccatcagcagtctgcaacctgaagtattttgactaacttactactgtacaacagtagttacacgttacccgtacgttactttggacctagggaccaagctaggagatacaacgactgtagctgacactacg

SEQ ID NO: 218832 - DNA, 220 bp, Homo sapiens; identical to SEQ ID NO: 218613
  misc_feature: GYAE6OF02F3XAM.18.53.E09.1.454.CMB.1.raw
  modified_base (219)..(220): a, c, t, g, unknown or other
  misc_feature (219)..(220): n is a, c, g, or t

SEQ ID NO: 218833 - DNA, 500 bp, Homo sapiens
  misc_feature: GYAE6OF02I0AEG.18.53.E09.1.454.CMB.1.raw
  modified_base (270)..(270): a, c, t, g, unknown or other
  misc_feature (270)..(270): n is a, c, g, or t
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaacagggaaancccctaagctcctgatctatgctacatccagtttgcaaagtggggtccatcaaggttcagtgcagtgatntgggacagatttcactctcacatcancagtctgcaactgaagtatttgactaacttactactgtacaactagagttacacgttacccgtcgttactttggccgtaggggacctaaggcttaggacgtatacgaaacgtactggtcggctcgacaccgtac

SEQ ID NO: 218834 - DNA, 174 bp, Homo sapiens; identical to SEQ ID NO: 218638
  misc_feature: GYAE6OF02IVFGQ.18.53.E09.1.454.CMB.1.raw
  modified_base (173)..(174): a, c, t, g, unknown or other
  misc_feature (173)..(174): n is a, c, g, or t

SEQ ID NO: 218835 - DNA, 503 bp, Homo sapiens
  misc_feature: GYAE6OF02F8GMZ.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtccatcaaggttcagtgcagtggatcgtgggacagatttcactctcaccatcagcagtctgacaactgaagtattttagactaacttactacttgtacaacagagttacacgttacccgttcgttaacgtttcggaccgtaggggaccaaggctaggagatacgaaacgactggtgactgacactac

SEQ ID NO: 218836 - DNA, 593 bp, Homo sapiens
  misc_feature: GYAE6OF02HX20C.18.53.E09.1.454.CMB.1.raw
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggnaagtcagagcattagcagctaattaaattggtatcagcaagaaaacagggaaacncccctaaagctcctgatctatgctacatccagtttgacgtaaaggtcggggtaccctagtacgtaaaggttcaaggtgggcgtaaggtggactcgtgggacagtatttcactctacaacctatacagcagtctacgacaaccttgaaagttattttacgactaaactttacctaactacgtacaaactagtaacgttaaccgacgttaacccgttacgttaacgttttcgggaccgtacgggggaacctaacggacgttagggaagtaacgtacgaaaaccgtaacgttacggtagggacctacggacctaccgtaacg

SEQ ID NO: 218837 - DNA, 204 bp, Homo sapiens
  misc_feature: GYAE6OF02H2EGA.18.53.E09.1.454.CMB.1.raw
  modified_base (177)..(204): a, c, t, g, unknown or other
  misc_feature (177)..(204): n is a, c, g, or t
tcagtacgagtatgcacgaccggtgctcgatttagagagagtgtggttaggggtttgggggaagaggaagactgacggtcctcccaggagttcaggtgcctgggcacagcggccctgggctgcctggtcaaggactacttcccatactgtactgagcgggctggcaaggcgcatagnnnnnnnnnnnnnnnnnnnnnnnnnnnn

SEQ ID NO: 218838 - DNA, 220 bp, Homo sapiens; identical to SEQ ID NO: 218613
  misc_feature: GYAE6OF02GBTJY.18.53.E09.1.454.CMB.1.raw
  modified_base (219)..(220): a, c, t, g, unknown or other
  misc_feature (219)..(220): n is a, c, g, or t

SEQ ID NO: 218839 - DNA, 220 bp, Homo sapiens; identical to SEQ ID NO: 218613
  misc_feature: GYAE6OF02HY5WB.18.53.E09.1.454.CMB.1.raw
  modified_base (219)..(220): a, c, t, g, unknown or other
  misc_feature (219)..(220): n is a, c, g, or t

SEQ ID NO: 218840 - DNA, 540 bp, Homo sapiens
  misc_feature: GYAE6OF02HNJ3N.18.53.E09.1.454.CMB.1.raw
tcagtacgagtatgcacgaccggtgctcgatttagagagagtgtgttgggtttggggcagtctcagtcaggacacagcatggacatgatggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaacagggaaagcccctaagctcctgatctatgctacatccagtttgcaaagtgggtcccatcaaggttcagtggcagtggatctgggacagtatttcactctcaccatcagcagtctgacaacctgaatatttgactaacttactactagtacaacagtagttacacgttacccgtacgttacttttggaccgtaggggtaaccctaaggccgttagggaacgtaacgttaaccgaaaaccggtaaccgttaggttacgggtaccttacggacctaacccg

SEQ ID NO: 218841 - DNA, 483 bp, Homo sapiens
  misc_feature: GYAE6OF02HEL4U.18.53.E09.1.454.CMB.1.raw
  modified_base (375)..(375): a, c, t, g, unknown or other
  misc_feature (375)..(375): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtgggtccatcaaggttcagtggcagtgatcgtgggacagtatttcactctcacatcagcagtcngcaacctgaagtatttgctaacttactactgtacaacagagttacacgttacccgtgttactttggaccgagggacagctaggagatacgaagactgtgctgcactac

SEQ ID NO: 218842 - DNA, 521 bp, Homo sapiens
  misc_feature: GYAE6OF02H40XO.18.53.E09.1.454.CMB.1.raw
  modified_base (268)..(268): a, c, t, g, unknown or other
  misc_feature (268)..(268): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctcctgtctgcatctgtaggagacagatcaccatcacttgccgggcaagtcagagcattagcagctatttaaattggtatcagcagaaaacaggaaancccctaagctctgatctatgctacatccagtttgacaaaggtcgggtaccatcgaagttcagtgcagtggatcgtagggacagtatttcactctcacctatcagcagtctcgactaactgtaatatttgactaacttactactcgtacaacgtaagtacgtaactacgttaacccggtcgtttacgtttcggaccgtaggggaacctaggacgtaggagtaactacgaaacgtactcggtagctacgcactac

SEQ ID NO: 218843 - DNA, 558 bp, Homo sapiens
  misc_feature: GYAE6OF02F7MJU.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaacgaccctaagctcctagatctatgactacatcctagtttgactaaaggtcggggtacccatacgtaaggttcagtggactagtgatcgtagggactagtatttcactctacacatcagcagtctcgacaaccgtgaagttatttcgaactaacttaactactgtactaacgtagtaacgttacgaacgttacccgttacgttaacgttttcggacccgtacggggaacctaaggtcgtaggacgtaactaaccgaaacgtacgtaggtaggtcctcgaccacgtacg

SEQ ID NO: 218844 - DNA, 519 bp, Homo sapiens
  misc_feature: GYAE6OF02G7603.18.53.E09.1.454.CMB.1.raw
  modified_base (271)..(271): a, c, t, g, unknown or other
  misc_feature (271)..(271): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaancccctaagctcctgatctatgctacatccagtttgactaaagtggggtccatcaagttcagtgcagtgatcgtggacagtatttcactctcaccatcagcagtctgacaactgaatattttgctaacttactactgtacaatagaattacacgttacccgtcgttaacctttggacccgtaggggaacctaaggtcgtagggtaagactacgaaaacgtacgtggtacggcctcggacctaccgtacg

SEQ ID NO: 218845 - DNA, 622 bp, Homo sapiens
  misc_feature: GYAE6OF02I8NWT.18.53.E09.1.454.CMB.1.raw
  modified_base (194)..(194): a, c, t, g, unknown or other
  misc_feature (194)..(194): n is a, c, g, or t
  modified_base (279)..(279): a, c, t, g, unknown or other
  misc_feature (279)..(279): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacgttggccggacaagtcagagcattagcagctaatttaaagttggtatcagacaagaaaacgaggaaacncccctaagctccgtagatctatcgactacactcctagtttgacgtaaaggtcgggtacccagtacgtaaggttcaggtggactaggtgactcgtagggactagtacgtttacacgttcctacaccatcagcagtctcgaccaactagtaagttattttcgaacttaaccttactacttagtacctaacgtagtaacgttaaccgtacgttaacccggttacgtttaaccgtttcgggaacccggtacggggaacccgtaacggtcggttaaggaacgtaaccgtaaccgaaaaccggttaacgttacggttacggtaccgtacggtacccctaccgttaaccg

SEQ ID NO: 218846 - DNA, 551 bp, Homo sapiens
  misc_feature: GYAE6OF02HPWGK.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagctattaaattggtatcagcagaaaacagggaaagcccctaagctcctgatctatgctacatccagtttgacaaagtggggtacccatacaaggttcagtggcagtgatcgtagggacagtatttcactctacacatacagcagtctgacaacctagaagtattttagactaactttactacttactactaacagtaacgttaactaacgttaacccgttacgttacgtttggacccgtaggggtaccaacggtacgtcgggaagtaagtaccgtaaaacggtaacgttaggtacggtacgtacgtaccacctaacg

SEQ ID NO: 218847 - DNA, 494 bp, Homo sapiens
  misc_feature: GYAE6OF02F3ZF6.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtcccatcaaggttcagtggcagtggatctgggacagatttcactctcaccatcagcagtctgcaacctgaagtattttgctaactttactactgtcaacagagttacagttacccgtgttacttttggccaggggaccaaggctaggagatacgaaacgactggtaggctgacactac

SEQ ID NO: 218848 - DNA, 710 bp, Homo sapiens
  misc_feature: GYAE6OF02IM84D.18.53.E09.1.454.CMB.1.raw
  modified_base (277)..(277): a, c, t, g, unknown or other
  misc_feature (277)..(277): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatcacttggccggcaagtcagagcattagcagctaatttaaattggtatcagacaagaaaacagggaaacncccctaagcctacctgatctatgctacatcctagtttacgacgtaaaaggttcggggtacccctaagtaccgtaaacgggtttacctaagggttcgggtacaagggttcgggtaaacgttccggtaggggaacctaaggtaacgtttttaccaaccgtttcctaccgaacccctaagttaccgaagtaccgtacgttacgtaccgtaaccgttaaaccgtagtaaacgtttactttacgtaaccttaaacgttacttaactacgtaactaaccgtaaggttaaccgttaacgttaccgttaacccggttacgtttaacccgtttacgggaacccggtacgggaacccgtaacggtaacggtacgggtaaacgtaacgttaaccgtaaaacggttacgttacgggtacgtaccgtaccgtaccgtaccttaacg

SEQ ID NO: 218849 - DNA, 491 bp, Homo sapiens
  misc_feature: GYAE6OF02FM2VX.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtccatcaaggttcagtgcagtgatctgggacagatttcactctcaccatcagcacgtctgcaacctgaaagtattttgactaacttactactagtacaacagagttacagtacccgtcgttacgtttgcctaggggacaagcgtggagactcaaacgactggtaggctgccactac

SEQ ID NO: 218850 - DNA, 497 bp, Homo sapiens
  misc_feature: GYAE6OF02GOV4H.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacaggaaagcccctaaagctcctgatctatgctacatccagtttgacaaagtgggtcccatcaaggttcagtggcagtgatctgggactagattcactctcacatcagcagtctcgacaacctgaagattttgactaacttactactgtacaacagtacgttacacgtaccgtcgttactttcggacctagggaccaagtctaggagatacgaacgaactggtagctgacactacg

SEQ ID NO: 218851 - DNA, 576 bp, Homo sapiens
  misc_feature: GYAE6OF02INTVU.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaaggtcagagcattagcagctatttaaattggtatcagacaagaaaacagggaaacgcccctaagcctctgatctatgctacactcctagtttgacgtaaagtggggtacccaagtactaaggttcaagtggacaggtgatcgtagggactagtatttcactctacaccatacagctacgtctacgacctaactagtaaagtatttagacctaaacttacctaactgtacaactagtaacgttaacaacgttacccggttcgtttaacgtttacggacccgtaacgggggaacctaacggcgttagggaagtaacgttacgaaaacgtacgtcggtacggtcgtacgaccgacctacg

SEQ ID NO: 218852 - DNA, 174 bp, Homo sapiens; identical to SEQ ID NO: 218649
  misc_feature: GYAE6OF02IEI52.18.53.E09.1.454.CMB.1.raw
  modified_base (174)..(174): a, c, t, g, unknown or other
  misc_feature (174)..(174): n is a, c, g, or t

SEQ ID NO: 218853 - DNA, 531 bp, Homo sapiens
  misc_feature: GYAE6OF02GDB4N.18.53.E09.1.454.CMB.1.raw
  modified_base (270)..(270): a, c, t, g, unknown or other
  misc_feature (270)..(270): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaacagggaaancccctaagctcctgatctatgctacatccagttttgactaaaagtggggtcccatcaaggttcagtggcagtggatcgtgggacagatttcactctcaccatcagcagtctgaccaacctgaagtatttgactaacttactactgtacaactagacgttacacgttaccgtcgttaacgttttcggaccgtaggggaccaaggtccgtagggaacgtaacgtacgaaaacgacgttaggtacggtctcgaccgtacctacg

SEQ ID NO: 218854 - DNA, 666 bp, Homo sapiens
  misc_feature: GYAE6OF02I0WUE.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacaggaaagcccctaagctcctgatctatgactacactaccagttttagacgtaaaaggtcggggttaccccaagtacgtaaaggtttccaaggtagggacgtaggttaggtaattcgtaggggtaaccgtaagtacttttcaccttcctaccaacctaatccgaagtacctacggttctacgacctaacccgttagaaacgttattttacgaccttaaactttaacctaacgttagttaccaaacgtaacggtaacgttaacctaaccggtttaacccgttacgtttaaccgttttcgggacccgtaacggggtaccaacgggtccgttaagggaaccggtaacttaaccgtaaaaccggtaaccgttcgggttacggtaccgtacggtaccgtaacctaccg

SEQ ID NO: 218855 - DNA, 514 bp, Homo sapiens
  misc_feature: GYAE6OF02JC580.18.53.E09.1.454.CMB.1.raw
  modified_base (389)..(389): a, c, t, g, unknown or other
  misc_feature (389)..(389): n is a, c, g, or t
  modified_base (508)..(508): a, c, t, g, unknown or other
  misc_feature (508)..(508): n is a, c, g, or t
tcagtacgagtatgcacgaccggtgctcgatttagagagagtgtgttgggtttggggcagtctcagtcaggacacagcatggacatgagggtccccgctcagcccctgggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaagcccctaagctcctgatctatgctacatccagtttgacaaagtgggtcccatcaaggttcagtggcagtggatcgtgggacagatttcactctcacatcagcagtctgcaactgaagtntttagactaacttactactgtacaacagtagttacacgttacccgtgttactttggaccgagggacaaggcgtaggagtaataccgaaacgtacgttcgtcggacctggcctaaccgtnttaccg

SEQ ID NO: 218856 - DNA, 222 bp, Homo sapiens; identical to SEQ ID NO: 218616
  misc_feature: GYAE6OF02HJR1O.18.53.E09.1.454.CMB.1.raw
  modified_base (219)..(222): a, c, t, g, unknown or other
  misc_feature (219)..(222): n is a, c, g, or t

SEQ ID NO: 218857 - DNA, 236 bp, Homo sapiens
  misc_feature: GYAE6OF02IVTCA.18.53.E09.1.454.CMB.1.raw
  modified_base (219)..(236): a, c, t, g, unknown or other
  misc_feature (219)..(236): n is a, c, g, or t
tcagtacgagtatgcacgaccggtgctcgatttagagagagtgtgttgggtttagggggaagaggaagactgacggtcctcccaggagttcaggtgctgggcaccgtgggcatgggggaggtgtgtcacaagatttgggctctgggcacagcggcctgggctgcctggtcaaggactacttcccatactcgtactgagcgggctggcaaggcgcatagnnnnnnnnnnnnnnnnnn

SEQ ID NO: 218858 - DNA, 576 bp, Homo sapiens
  misc_feature: GYAE6OF02HJ73G.18.53.E09.1.454.CMB.1.raw
  modified_base (200)..(200): a, c, t, g, unknown or other
  misc_feature (200)..(200): n is a, c, g, or t
tcagtacgagtatgcacgaccggtgctcgatttagagagagtgtgttgggtttgggcagtcggtcagtcaggacacagcatggacatgacgggtccccgctcgacgcgtcctggggctcctgctactctgctccgagtgccagatgtgacagtccagatgacccagtcctccatcctccctgtcctgcagtctgtagganacagagtcaccatcacttgccggcaaggtcagagctattagcagacttaatttaaattggtatcagacaagaaacgaggaaacgcccgtaagacctccctagatactatgtctacatccagtttgcgaacgtggtaccatcagtcagtgcagtcgatcgtggacagtacttcactctacacctatcgacgctacgtactcgacaaccgtagtaagtacttttgaactaactttacctacgtcgtacaacgtacgtaacgttacgaccgttaccgtacgttacgttttcggaccgttacgggacctaacggtccgtaggtaacgtacgtaaccgaaaccggtacgttacggtacgtaccgtacgtaccgaccgtacg

SEQ ID NO: 218859 - DNA, 176 bp, Homo sapiens
  misc_feature: GYAE6OF02G1ULZ.18.53.E09.1.454.CMB.1.raw
  modified_base (174)..(176): a, c, t, g, unknown or other
  misc_feature (174)..(176): n is a, c, g, or t
tcagtacgagtatgcacgaccggtgctcgatttagagagagtgtgttgggtttgggggaagaggaagactgacggtcctcccaggagttcaggtgctgggcacagcggccctgggctgcctggtcaaggactacttcccatactcgtactgagcgggctggcaaggcgcatagnnn

SEQ ID NO: 218860 - DNA, 287 bp, Homo sapiens
  misc_feature: GYAE6OF02J2IDR.18.53.E09.1.454.CMB.1.raw
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (231)..(232): a, c, t, g, unknown or other
  misc_feature (231)..(232): n is a, c, g, or t
  modified_base (234)..(234): a, c, t, g, unknown or other
  misc_feature (234)..(234): n is a, c, g, or t
  modified_base (236)..(237): a, c, t, g, unknown or other
  misc_feature (236)..(237): n is a, c, g, or t
  modified_base (239)..(239): a, c, t, g, unknown or other
  misc_feature (239)..(239): n is a, c, g, or t
  modified_base (241)..(287): a, c, t, g, unknown or other
  misc_feature (241)..(287): n is a, c, g, or t
tcagtacgagtatgcacgaccggtgctcgatttagagagagtgtgttgggtttgggggaagaggtagactgacggtcctcccaggagttcgaggtgctgggcaccgtgggcagtgggggagtgtgtcacaagatttgggctctgggcacagcggccctgggctgacctggtccaaaggctacttcccatacctcgtactgagccgggntagggccaaggccgtnataggcnngntnntnannnnnnnnnnnnnnnnnnnnnnnnnnnnnnnnnnnnnnnnnnnnnnn

SEQ ID NO: 218861 - DNA, 254 bp, Homo sapiens
  misc_feature: GYAE6OF02JADIP.18.53.E09.1.454.CMB.1.raw
  modified_base (226)..(254): a, c, t, g, unknown or other
  misc_feature (226)..(254): n is a, c, g, or t
tcagtacgagtatgcacgaccggtgctcgatttagagagagtgtgttggggtttggggggaagaggaagactgacggtccttcccaggagttcaggtgcgtggggcaccgtgggcatggggggaggtgtgtcacaagatttgggcctctgggcacagcggccctgggctgcctggtcaaggactacttcccatactcgtactgagcgggctggcaaggcgcatagnnnnnnnnnnnnnnnnnnnnnnnnnnnnn

SEQ ID NO: 218862 - DNA, 662 bp, Homo sapiens
  misc_feature: GYAE6OF02I8FF8.18.53.E09.1.454.CMB.1.raw
tcagtacgagtatgcacgaccggtgctcgatttagagagagtgtgttgggtttgggggcagtctcagtcaggacacagcatggacatgagggtccccgctcagctcctggggctcctgctactctggctccgaggtgcccagatgtgacatccagatgacccagtcgtccatccctccctgtctagcatctgtaggagacagagtcaccatcacttggccgggacaacgtcagacgcattagcagctaatttaaagttggtatcagcaagaaaacgagggaaacgcccctaaagcctcctgactctatgactacatcctagtttgactaaagtggggtacctatacaaggttcagtggcgtagtggatcgtagggactagtattccgtactcctacgaccagtacagctagtctacgactaacgttagaagtagttttagacctaaccgtttacttacgttacgttacctaaacgtacgtaacgtttaccgtaaaccgtttaccccgtttaccggtttaaccgtttttaccggggaccccggttaacgggggtaaccctaacggggtaccggttagggtaacggtaaccgttaaccggaaaaccgggttaaccggttacgggttaccgggtaaccggtccggtaacccgtaccgtaacccgg

SEQ ID NO: 218863 - DNA, 518 bp, Homo sapiens
  misc_feature: GYAE6OF02H4AMP.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaattaaattggtatcagcagaaaacaggaaagcccctaaagctcctgatctatgactacatcctagtttgacaaaagtcggggtacccatacgaaggttcagtggcagtggatcgtgggacagtatttcactctcaccatcagcagtctgacaacctgtaagtattttagactaacttactaactgtacaactagtattactacgtacccgttgtactttggccgtagggacctaaggcgtaggaacgtataacaacgtactcggtagctgcctactacg

SEQ ID NO: 218864 - DNA, 500 bp, Homo sapiens
  misc_feature: GYAE6OF02FIY6F.18.53.E09.1.454.CMB.1.raw
  modified_base (378)..(378): a, c, t, g, unknown or other
  misc_feature (378)..(378): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgacaaaggtggggtcccatcaaggttcagtggcagtgatcgtgggacagatttcactctcacatcagcagtcngaccaactgaagtattttgactaacttactactgtacaacagtacgttacagtacccgtcgttactttcggcctaggggacccaaggtctaggagactacaaacgactggtgctagcactac

SEQ ID NO: 218865 - DNA, 524 bp, Homo sapiens
  misc_feature: GYAE6OF02I6UEM.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatgacccagtctccatccctccctgtctgcatctgtaggagacagagtcaccatcacttgccgggcaagtcagagcattagcagctaatttaaattggtatcagcaagaaaacagggaaagcccctaagctcctgatctatgctacatccagtttgacaaagtcggggtacccagtcaaggttcaggtggctagtaggatcgtagggacagtactttcactctacaccatcagcagtctagctaacctgaagtattttcgactaacttactactgtaccaacagtacgttacacgttacccgttcgttacgtttgaccgtacgggacagtctaggagtaactacgaaacgtaactggtgactgaccactacg

SEQ ID NO: 218866 - DNA, 659 bp, Homo sapiens
  misc_feature: GYAE6OF02I6IXF.18.53.E09.1.454.CMB.1.raw
  modified_base (221)..(221): a, c, t, g, unknown or other
  misc_feature (221)..(221): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttcggccgggnaagtcagagcattagcagctatttaaattggtatcagacaagaaaacgagggaaacgacccctaagctacctagactctatcgactactactactagtttcgacgtaaggtcgggtacctatacgaacggttcaggtgacagtgatcgtagggactagtactttcactcctacacatcagctacgtctacgacctaacgtagaacgttattttacggaccttaaaccttacttaacgtaggttaacccaaacgtaacggttaaaccgttaccgtaaaccgggtttacccgtttaccggtttaaccgtttaccggggtacccgtaaccggggtaaccgtaacggtccgggtttaagggaacgtaaacgttaacccggtaaaaaccggtacggtttacggttaccgggtaccggttaaccgtacccggtaacccttaacg

SEQ ID NO: 218867 - DNA, 257 bp, Homo sapiens
  misc_feature: GYAE6OF02FNUEI.18.53.E09.1.454.CMB.1.raw
  modified_base (151)..(151): a, c, t, g, unknown or other
  misc_feature (151)..(151): n is a, c, g, or t
  modified_base (190)..(190): a, c, t, g, unknown or other
  misc_feature (190)..(190): n is a, c, g, or t
  modified_base (221)..(222): a, c, t, g, unknown or other
  misc_feature (221)..(222): n is a, c, g, or t
  modified_base (224)..(257): a, c, t, g, unknown or other
  misc_feature (224)..(257): n is a, c, g, or t
tcagtacgagtatgcacgaccggtgctcgatttagagagagtgtgttggggtttggggggaagaggaagactgacggtcctcccaggagttcaggtgctgggcaccgtgggcatgggggaggtgtgtcacaagatttgggctctgggcacngcggcctgggctgcctggtcaaggactacttcccatacncgtactgagcggggctggcaaggcgcatagnngnnnnnnnnnnnnnnnnnnnnnnnnnnnnnnnnnn

SEQ ID NO: 218868 - DNA, 203 bp, Homo sapiens
  misc_feature: GYAE6OF02FSTT9.18.53.E09.1.454.CMB.1.raw
  modified_base (178)..(203): a, c, t, g, unknown or other
  misc_feature (178)..(203): n is a, c, g, or t
tcagtacgagtatgcacgaccggtgctcgatttagagagagtgtgttggagtttgggggaagaggaagactgacggtccccccaggagttcaggtgctgggcaccagcggccctgggctggcctggtcaaggactacttcccatactcgtactgagcgggctggcaaggcgcaatagnnnnnnnnnnnnnnnnnnnnnnnnnn

SEQ ID NO: 218869 - DNA, 144 bp, Homo sapiens
  misc_feature: GYAE6OF02J3N1T.18.53.E09.1.454.CMB.1.raw
  modified_base (125)..(125): a, c, t, g, unknown or other
  misc_feature (125)..(125): n is a, c, g, or t
  modified_base (129)..(130): a, c, t, g, unknown or other
  misc_feature (129)..(130): n is a, c, g, or t
  modified_base (132)..(133): a, c, t, g, unknown or other
  misc_feature (132)..(133): n is a, c, g, or t
  modified_base (135)..(135): a, c, t, g, unknown or other
  misc_feature (135)..(135): n is a, c, g, or t
  modified_base (137)..(144): a, c, t, g, unknown or other
  misc_feature (137)..(144): n is a, c, g, or t
tcagtacgagtatgcacgaccggtgctcgatttagagagagtgtgttgggttggctcgtggcacagcggcctggctgcctggtcaaggactacttccatactcgtactgagcggctggcaaggcnatgnnannancnnnnnnnn

SEQ ID NO: 218870 - DNA, 519 bp, Homo sapiens
  misc_feature: GYAE6OF02GMMKH.18.53.E09.1.454.CMB.1.raw
  modified_base (218)..(218): a, c, t, g, unknown or other
  misc_feature (218)..(218): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctatttaaattggtatcagcagaaaacagggaaagcccctaagctcctgatctatgctacatccagtttgcaaagtgggtcccatcaaggttcagtgcagtggatcgtgggacagatttcactctcaccatcagctagtctgacaactagaagtattttgactaacttactactgtacaacagtagttactagtacccgtcgttactttacggccgaggggaccaaaggccgtagggacgtaataccgaaaacgaacgttggtcggactcggaccacctaacg

SEQ ID NO: 218871 - DNA, 527 bp, Homo sapiens
  misc_feature: GYAE6OF02IXRZE.18.53.E09.1.454.CMB.1.raw
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
  modified_base (310)..(310): a, c, t, g, unknown or other
  misc_feature (310)..(310): n is a, c, g, or t
  modified_base (435)..(435): a, c, t, g, unknown or other
  misc_feature (435)..(435): n is a, c, g, or t
tcagtacgagtatgcacgaccggtgctcgatttagagagagtgtgttgggtttggggtcgagtctcagtcaggacacagcatggacatgagggtccccgctcagctcctgggctcctgctactctggctccgaggtgccagatgtgacatccagatgacccagtctccatcctccctgtctgcatctgtaggagacagtagtcaccatcacttgccggnaagtcagagcattagcagctattaaattgtatcagcaagaaaacagggtaaacnccctaagctcctagatctaatgactacatccagtttnacgtaaaagtcggggtacccatacgtaaggttcagtgcagtggatctgggacagtatttcatctacacaagtcacgcagtctgactaacctagtagtattttcgactaacttactactgtacaanacgaagtttacgacgtacccgttgtacctttggaccagggacctaagctaggacgtactacgaaacgtacgtcgtaggctagtaccgaccta

SEQ ID NO: 218872 - DNA, 585 bp, Homo sapiens
  misc_feature: GYAE6OF02I1FBW.18.53.E09.1.454.CMB.1.raw
  modified_base (193)..(193): a, c, t, g, unknown or other
  misc_feature (193)..(193): n is a, c, g, or t
  modified_base (310)..(310): a, c, t, g, unknown or other
  misc_feature (310)..(310): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctaatttaaattggtatcagcaagaaaacagggaaacgcccctaagcctcctgatctatgctacatccagtttnacgaaagtggggtcccatcaaggttcagtggcagtggatcgtgggacagtatttcgacttctcaacctatacgagctagtacctagacctaaacgttgaagttattttacgacctaaacctttactaccgttagtactaaacgaagtacgttaacacgtttaacccgtcgtttaacgttttcgggacccgtaggggaacctaacggtcgtacggaacgtaacgttaaccgaaaaccggtaacgttacggttccggtactcggaccctacctaacg

SEQ ID NO: 218873 - DNA, 501 bp, Homo sapiens
  misc_feature: GYAE6OF02GLXDC.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaacaggaaagcccctaagctcctgatctatgctacatccagtttgcaaagtggggtcccatcaaggttcagtggcagtggatctgggacagatttcactctcacatcagcagtctgcaaccttgaagattttgctaacttactacttgtacaacagagttacagtacccgtcgtacttttggccaggggaccaaggtctagggacgtaagtaccgaaacgtaacttgtgggctgccacctac

SEQ ID NO: 218874 - DNA, 516 bp, Homo sapiens
  misc_feature: GYAE6OF02FIIM2.18.53.E09.1.454.CMB.1.raw
  modified_base (394)..(394): a, c, t, g, unknown or other
  misc_feature (394)..(394): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaacaggaaagcccctaagctcctgatctatgctacatccagtttgacaaggtcggggtccatcgaaggttcaggtggcagtggatcgtgggacagtagttcactctcacatcagcagttctgcaacctagaagttnttttacgactaacttactactgtacaacagtagttacacgtacccgtcgttacgtttcggaccgtacgggaccgaagtccgtaggactagtacaaacgtactggtacggctcggacacctac

SEQ ID NO: 218875 - DNA, 221 bp, Homo sapiens; identical to SEQ ID NO: 218617
  misc_feature: GYAE6OF02H1OSD.18.53.E09.1.454.CMB.1.raw
  modified_base (219)..(221): a, c, t, g, unknown or other
  misc_feature (219)..(221): n is a, c, g, or t

SEQ ID NO: 218876 - DNA, 738 bp, Homo sapiens
  misc_feature: GYAE6OF02J3IDI.18.53.E09.1.454.CMB.1.raw
  modified_base (723)..(723): a, c, t, g, unknown or other
  misc_feature (723)..(723): n is a, c, g, or t
tcagtacgagtatgcacgaccggtgctcgatttagagagagtgtgttgggtttggggtcgagtctcagtcaggacacagcatggacatgagggtccccgctcagctcctgggctcctgctactctggctccgaggtgccagatgtgacatccagatgacccagtcctccatcctccctgtctgcatctgtagagacagacgtcaccatcacgttcggcccgggtacaacgtcgaagacgtacctaagttacggcctaaggtacctttaaagttttaaaagttgggttaactaccgaaggaaccgaaacggaaaaaccggacgggtaaaacccgtacccccgtaaaggtcccttaccgtagtacttaccgtaagttacggtaaccttaactaacgttacccgtaaggttttacgaaccgtaaaacgggttccggggtacccagttaaccggaaggtttcgaacggttcggacgtaagggtacggtacgttacggtacggggtaactacggttaacttttccaaccgttcacctaaccacgttacgacgtcgtaacgttctacgacctaacgttagtaacgttagtttacgaccttaacttactacgtacgtactaagtacgtaacgttaccgtaacgtttaccggttacgttacgtttacggaaccgtacggggtaacctaggtctaaggacgtaactaccgaacgttacgtcggacggttacncggtacctacgtacg

SEQ ID NO: 218877 - DNA, 505 bp, Homo sapiens
  misc_feature: GYAE6OF02GPCXT.18.53.E09.1.454.CMB.1.raw
  modified_base (218)..(218): a, c, t, g, unknown or other
  misc_feature (218)..(218): n is a, c, g, or t
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (413)..(413): a, c, t, g, unknown or other
  misc_feature (413)..(413): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccggnaagtcagagcattagcagctattaaattggtatcagcaagaaaacaagggaaacgacccctaagctacctgatctatnctacatccagtttgacaaagtcgggtccatcaagtcagtgcagngatcngggacagtattcactctacacactcagcagtctagcaactagagttatttgtactaacttactacttnactaactagagttactagttacccgtagtacgtttcgacgtacggaccagcgtagagatacaacgtacgtacggtgacgtgtaccgactacg

SEQ ID NO: 218878 - DNA, 634 bp, Homo sapiens
  misc_feature: GYAE6OF02H8NWA.18.53.E09.1.454.CMB.1.raw
  modified_base (284)..(284): a, c, t, g, unknown or other
  misc_feature (284)..(284): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttggccggacaagtcagagcattagcagctatttaaattggtatcagcaagaaaacaggaaacaccctaagctccngatctatgctacatcctagtttgactaaaagtcggggtacccagtactaaggttcaaggttcggacaggtcggatcgtagggacctagtactttcaactctccaaccgtatacacgagtaacgtctacgaccaaaccgttaggtaaacgttacgttttagaccttaaactttaaccgtagttacgttaaccaaactaaggtaacgttaacgtaaccgttacccggttaccgtttaaccgttttcgtaaccgggtaccggggtaaaccaacggtaacggttacgaacggtaaacttaaccgaaaacggttaacctacgggttacggtaccgttacgacctaaccttaaccg

SEQ ID NO: 218879 - DNA, 555 bp, Homo sapiens
  misc_feature: GYAE6OF02HJ6X5.18.53.E09.1.454.CMB.1.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
tcagtacgagtatgcacgaccggtgctcgatttagagagagtgtgttgggtttgggctctgggcaccgtgggcatgtgtgagttgtgtcaccaagtggggttttgagctcaactctcttctgcttgctggctgtagctccaggtgctcactcccaggtgcggctggtgcagtctggggctgaggtgaagaagccgtggggcctnagtgaagtctttccngcaaaggcatctggatacaccttcaccagctactatatgcactgtgtgcgacaggcccctggacaagggcttgagtggatgggattaactcaaccctagtggtcgtacacaagctacgcacagacgtcgaggcagagtcacatgaccgagggaccacgtaccagacgcacagtcctacgagtgggaagtctaggagcgaacgcctagagtacttcgaggtacggacgacgggtccgttagtaacgttacgtggtgtacgtaggtaaggagggtaacgtaagtagggtacgggacgtccgttccgtttggtaaccgtttcgggtcggggtaacccgg

SEQ ID NO: 218880 - DNA, 218 bp, Homo sapiens
  misc_feature: GYAE6OF02H0ZGN.18.53.E09.1.454.CMB.1.raw
tcagtacgagtatgcacgaccggtgctcgatttagagagagtgtgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatag

SEQ ID NO: 218881 - DNA, 521 bp, Homo sapiens
  misc_feature: GYAE6OF02HS54O.18.53.E09.1.454.CMB.1.raw
  modified_base (268)..(268): a, c, t, g, unknown or other
  misc_feature (268)..(268): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctatttaaattggtatcagcagaaaacaggaanccctaagctcctgatctatgctacactcagtttgacaaagtggggtcccatcaaggttcagtggcagtgatctgggacagtattcactctcaccatcacgcagtctcgactaacctagtaagtattttcgactaactttactacttcgtacaacagtagttacacgttacccgtcgtacgttttcggaccgtacggggacctaacggcgtacggtaacgatacgaaacgacgtcggtacgctacgcaccgtac

SEQ ID NO: 218882 - DNA, 514 bp, Homo sapiens
  misc_feature: GYAE6OF02HWCVA.18.53.E09.1.454.CMB.1.raw
tcagtacgagtatgcacgaccggtgctcgatttagagagagtgtgttgggtttggggcccagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtcccatcaaggttcagtggcaggtggatcgtgggacagatttcactctcaccatcagcagtctgcaacgtgaagtattttagactaaactttactaacttgtacaacagtacgttacagttacccgtagttacttttggccgtagggaccaaggctaggagacgttacaaacgtacgtggtgtcgtagccacgtac

SEQ ID NO: 218883 - DNA, 542 bp, Homo sapiens
  misc_feature: GYAE6OF02HS023.18.53.E09.1.454.CMB.1.raw
  modified_base (270)..(270): a, c, t, g, unknown or other
  misc_feature (270)..(270): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaattggtatcagcagaaaacagggaacncccctaagctctgatctatgctacatccagttgacaaagtcgggtaccatcaaggttcagtgcagtgatcgagggacagtactttcactctcaccatcagctagtctaggacaaccgtagtaacgtatttacgactaacttacttacttacgtactaactagtaacgttactacgttacccgtacgttacgttttcggaccgtagggaacctaacggtcgtacggacgtaactaacgaacgtaacgtaggtacggacgtacgacctactacg

SEQ ID NO: 218884 - DNA, 619 bp, Homo sapiens
  misc_feature: GYAE6OF02IZKFQ.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcattagcagcttaatttaaattggtatcagacaagaaaacagggaaacgacccctaagcctcctgatctatgctacactcctagtttacgacgtaaagggttcggggtacccagtacgtaacggttcgaggttggacgtaggtgggtacttcggtagggaacctagtactttaccgaccttccgtaccaacctatcagtctacgttcctagaccctaacgttagtaacgttattttacgaccttaaccttaacgttacgttacgtaacaacgtagtaacgttaaccgaccgttttacccggtacgtttacgtttacggacccggtagggacctaaggcgtacggaagtacgtaacgaacgtacgtcggtaccgtacgtacgacaccttacg

SEQ ID NO: 218885 - DNA, 641 bp, Homo sapiens
  misc_feature: GYAE6OF02J0O9B.18.53.E09.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (501)..(501): a, c, t, g, unknown or other
  misc_feature (501)..(501): n is a, c, g, or t
tcagtacgagtatgcacgaccggtgctcgatttagagagagtgtgttgggtttggggtcgagtctcagtcaggacacagcatggacatgagggtcccgctcagctcctgggctcctgctactctggctccgagtgccagatgtcgacatccagatgacccagttctccatccctccctgtctagctactctgtagganacagagtccaccatcattcgccgggacaagtcaaggancaattacgcagacttaatttaaagttcggtatacagacgaaacaacgggaacgtacccaacgactctacatactatcgactacactacgtacgtttagacaacggtacggtaccactacgtaagtacgtacgtggcgtagtaggtactactcgggggactacgtagttttaccacttacctcgtaacctacgttacacgtacacgttaccgtagtacccaaccgtagttaataacgttttactaccgtaaactttacttaacgtnttaacgaactaggtacttaacgtacgtttacccgtacgtttacctttagggtacccggaggtaccgtaacgtcggtaacgtaacgttacgaacgtaacccgtaagttcgtacggtaccgtccgtactaccgaccgttacg

SEQ ID NO: 218886 - DNA, 538 bp, Homo sapiens
  misc_feature: GYAE6OF02HO9A3.18.53.E09.1.454.CMB.1.raw
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttgccgggcaagtcagagcattagcagctatttaaattggtatcagcagaaaacagggaaaacgcccctaaagcctcctgactctatgctacatccagtttgcaaaagtggggtcccatcaaggttcaggtgcgagtggatcgtgggaccagtactttcacttctacaccaatcagctacgtctgacaacctgaaagtnttttagctaacttactactgtacaaanacgtagttaactacgttacccgttcgttacgttttcggaccgtacggggtaccaaggctagggagacgtaccgaaagtacgtaggcggctacgctacctacg

SEQ ID NO: 218887 - DNA, 220 bp, Homo sapiens; identical to SEQ ID NO: 218613
  misc_feature: GYAE6OF02FR6LL.18.53.E09.1.454.CMB.1.raw
  modified_base (219)..(220): a, c, t, g, unknown or other
  misc_feature (219)..(220): n is a, c, g, or t

SEQ ID NO: 218888 - DNA, 570 bp, Homo sapiens
  misc_feature: GYAE6OF02HVS7A.18.53.E09.1.454.CMB.1.raw
  modified_base (270)..(270): a, c, t, g, unknown or other
  misc_feature (270)..(270): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcaagaaacaggaaacnccctaagctcctgatctatcgctacatctagtttgacaaaggtcggggtaccatacaagttcagtggcaggtggatcgtagggactagtactttcactctacacctatacagctacgtctacgacctaaccgtagtaagtacgttttagaccttaaactttacttaactcgttactaactagtaacgttaccgacgtttaacccgttcgttaacgtttcggaccgtacgggtaacctaacggtcgtaggacgtaacgtaacgaaacgtacgttacggtcggtacgtacgacctacctacg

SEQ ID NO: 218889 - DNA, 616 bp, Homo sapiens
  misc_feature: GYAE6OF02IEOPD.18.53.E09.1.454.CMB.1.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagacttatttaaattggtatcagacaagaaaacagggaaancccctaaagcctacctgactactatcnctacactcctagtttcgacgtaaaggtcggggtacccagtacgaacgggttcaagtcggtacaggtggactcgtagggacagttactttcacttccgtacaaccctatccagtaccgagtacctaggacctaaccgttaggtaacttagttttacgaccttaacttaaccgtacgttagtaactaacgtaaggtaacgttaaccacgttaaccccgttacgtttaccgtttacgggaccgtacgggaacccgtaaggtcgtacggaagtacctaaccgtaaacgacgttaggtacgtaccgtcgtacctactacg

SEQ ID NO: 218890 - DNA, 221 bp, Homo sapiens
  misc_feature: GYAE6OF02HUNJQ.18.53.E09.1.454.CMB.1.raw
  modified_base (220)..(221): a, c, t, g, unknown or other
  misc_feature (220)..(221): n is a, c, g, or t
tcagtacgagtatgcacgaccggtgctcgatttagagagagtgtgttgggtttggggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnn

SEQ ID NO: 218891 - DNA, 175 bp, Homo sapiens
  misc_feature: GYAE6OF02IN9K3.18.53.E09.1.454.CMB.1.raw
  modified_base (174)..(175): a, c, t, g, unknown or other
  misc_feature (174)..(175): n is a, c, g, or t
tcagtacgagtatgcacgaccggtgctcgatttagagagagtgtgttgggtttgggggaagaggaagactgacggtcctcccaggagttcaggtgctgggcacagcggccctgggctgcctggtcaaggactacttcccatactcgtgctgagcgggctggcaaggcgcatagnn

SEQ ID NO: 218892 - DNA, 641 bp, Homo sapiens
  misc_feature: GYAE6OF02I1Q1K.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaattggtatcagcaagaaaacgagggaaacgcccctaagcctcctgactctatgactacatcctagtttagactaaaggtcggggtaccctagtacgtaaggttccagtggacgtaggtaggagtcgtagggactagtatttccacttcctactaccatccgagactacgtcctacgacctaacccgttagtaacgttactttacgacctaaactttacctaacgttacgttaacctaaacgtacgtaacgtttaaccgtaacggtttaaccccggttcgtttaaccgttttacgggacccggtaacggggacctaacgggtacgtacgggtaacggtaacttaaccggaaaaccgtacgttagggtacggacgtttacggaccctaccgttaaccg

SEQ ID NO: 218893 - DNA, 782 bp, Homo sapiens
  misc_feature: GYAE6OF02JWZDT.18.53.E09.1.454.CMB.1.raw
  modified_base (277)..(277): a, c, t, g, unknown or other
  misc_feature (277)..(277): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgacccagtcctccatcctccctgtctgcatctgtaggagacagagtcaccatcacttggccggcaagtcagagcattagcagcttaatttaaattggtatcagcaagaaaacagggaaacnccctaagctcctagatctatgactacatcctagttacacgtaagtacggggtacccgtactacgtaacggttaccgtaagtcggtacgtacggtagggtaacgtcggttaacgggacgtaacgtttaacgtttccgttaacctccgtttacccacccttaacgtaccgtaacgtaccgtaacgttaccgtaccgaaccgttaaccggttaacgtaaacggtttaacgtttttacgtaaccgtttaaaccctttaaaccgtttaacgtttaaccgttaaccgtaaaccgttaaaccgggttaaacgttttaaacccgggttaaaccggttttaaaccccggtttaccggtttaaccgggttttttaacccgggtacccgggttaacggggttaacccggtaaaccggttaccgggtaaccgggttaacggtaaaccttaaccggtaaaaccggttaacggttacggttacgggttacccgtaccggtacccgtaccctttaaccgg

SEQ ID NO: 218894 - DNA, 601 bp, Homo sapiens
  misc_feature: GYAE6OF02GVIIH.18.53.E09.1.454.CMB.1.raw
  modified_base (193)..(193): a, c, t, g, unknown or other
  misc_feature (193)..(193): n is a, c, g, or t
  modified_base (276)..(276): a, c, t, g, unknown or other
  misc_feature (276)..(276): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccggacaagtcagagcattagcagcttatttaaattggtatcagacaagaaaacagggaaacncccctaagctacctgatctatgactacactcctagtttgaacgtaaggtcgggtaccctagtacgtaaggttcaggtggacgtaggtgactcgtagggactagtactttcactctacaactatcagtctacgttcacgactaacgttagaagttactttagaaccttaaccgttactacgtacgtaactaacgtaacgtaacgttaacctaccgtttacccggttacgtttaaccgtttcggacccggtaagggtacctaaggtcgtaaggaacgtaacgtaaccgtaaacggtacgttggtacggtactacgtaccaacttacg

SEQ ID NO: 218895 - DNA, 522 bp, Homo sapiens
  misc_feature: GYAE6OF02FQ2U1.18.53.E09.1.454.CMB.1.raw
  modified_base (390)..(390): a, c, t, g, unknown or other
  misc_feature (390)..(390): n is a, c, g, or t
tcagtacgagtatgcacgaccggtgctcgatttagagagagtgtgttgggtttgggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaacgcccctaaagctcctgatctatgctacatccagtttgacaaaggtcgggtacccatacaaggttcaggtggcagtggatcgtagggactagatttcactctcaccatcgagcagtcngcacctagatatttgctaacttactactgtacacagtagttacacgtaccgtcgttactttgggaccgtagggaccaggtcgtaggactaacgtaccaaacggtacgtcggtggtcctcggacctacctacg

SEQ ID NO: 218896 - DNA, 557 bp, Homo sapiens
  misc_feature: GYAE6OF02ISUZT.18.53.E09.1.454.CMB.1.raw
  modified_base (216)..(216): a, c, t, g, unknown or other
  misc_feature (216)..(216): n is a, c, g, or t
  modified_base (268)..(268): a, c, t, g, unknown or other
  misc_feature (268)..(268): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
tcagtacgagtatgcacgaccggtgctcgatttagagagagtgtgttgggtttggggcagtctcagtcaggacacagcatggacatgagggtcccgctcagctcctgggctcctgctactctggctccgaggtgccagatgtgacatccagatgacccagtctccatcctccctgtctgcatctgtaggagacagagtcaccatcacttgccgggnaagtcagagtcattagcagctatttaaatgtatcagcaagaaaacaggaaanccctaaagctgcagatgattggtccgtacagtttccaaagactcgggcccatcgagactccgcgtcagtgatcgtggggacaggtatttcgactctcgaccatcaagnagcctgcgacncctagaacgtattttacgctaaacttacttaattgtacctaggaccacgggtacgactaactaaacgttttcccgacctttaccgacccgttttcgggaccgggtaagggaacccgaaggttcgggaacgtattacgaaacgtaaccgttggtcggtttagccgtaaccg

SEQ ID NO: 218897 - DNA, 222 bp, Homo sapiens; identical to SEQ ID NO: 218616
  misc_feature: GYAE6OF02GL8AN.18.53.E09.1.454.CMB.1.raw
  modified_base (219)..(222): a, c, t, g, unknown or other
  misc_feature (219)..(222): n is a, c, g, or t

SEQ ID NO: 218898 - DNA, 175 bp, Homo sapiens; identical to SEQ ID NO: 218812
  misc_feature: GYAE6OF02IPQWG.18.53.E09.1.454.CMB.1.raw
  modified_base (174)..(175): a, c, t, g, unknown or other
  misc_feature (174)..(175): n is a, c, g, or t

SEQ ID NO: 218899 - DNA, 598 bp, Homo sapiens
  misc_feature: GYAE6OF02H7UFQ.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctcatcctcctgtctgcatctgtaggagacagagtcaccatcacttggccgggcaagtcagagcattagcagctaatttaaattggtatcagacaagaaaacaggaaacgcccctaaagcttcctgatctatgactactactcctagtttcgacgtaaaggtcggggtacccaattcgaaggttcaggtgcaggtggatcgtgggacagtatttcactctacgaccatacagcagtcctgaacctaacctagtaaagttctttacgaactaaactttaacctacttacgtaccaaactagttaacgttaccgtaaacgtttcccggacgtttaaccgtttacgggaccctaacggggtaccaaacggtcgttaagggaactaacgtaaccaaaccggtacgttacggtacggtaccgtacggtaccctaactacg

SEQ ID NO: 218900 - DNA, 172 bp, Homo sapiens
  misc_feature: GYAE6OF02FUWIS.18.53.E09.1.454.CMB.1.raw
tcagtacgagtatgcacgaccggtgctcgatttagagagagtgtgttgggtttgggggaagaggaagactgacggtcccccaggagttcaggtgctgggcacagcggccctgggctgcctggtcaaggactacttcccatactcgtactgagcgggctggcaaggcgcatag

SEQ ID NO: 218901 - DNA, 581 bp, Homo sapiens
  misc_feature: GYAE6OF02I696E.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaacagggaaacgccctaagctcctgatctaatgctacatccagtttgcaaagtggggtcccatcaaggttcagtggcagtggatcgtgggacagtatttcactctcaaccatacagctacgtctcgaccaaccttagaacgttattttacggacttaaacctttacttaaccttagttaaccaacgtaagtaacgttaacctacgtttaaccccgttacggttacctttttacgggacccgtacggggaccctaacggtacctgggtaacgaacttaaccgaaacgtaaccgttcggtaggtacctaggtaccaccttaacg

SEQ ID NO: 218902 - DNA, 231 bp, Homo sapiens
  misc_feature: GYAE6OF02H1UK8.18.53.E09.1.454.CMB.1.raw
  modified_base (219)..(231): a, c, t, g, unknown or other
  misc_feature (219)..(231): n is a, c, g, or t
tcagtacgagtatgcacgaccggtgctcgatttagagagagtgtgttgggtttgggggaagaggaagactgacggtcctcccaggagttcaggtgctgggccaccgtgggcatgggggagtgtgtcacaagatttgggctctgggcagagcggccctgggctgcctggtcaaggactacttcccatactcgtactgagcgggctggcaaggcgcatagnnnnnnnnnnnnn

SEQ ID NO: 218903 - DNA, 552 bp, Homo sapiens
  misc_feature: GYAE6OF02HEJC0.18.53.E09.1.454.CMB.1.raw
  modified_base (272)..(272): a, c, t, g, unknown or other
  misc_feature (272)..(272): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcaagaaaacagggaaacncccctaagctcctgatctatgctacatccagtttgactaaaggtcgggtcccatcgaaggtcagtgcaggtgatcgtaggacagtatttcactctcaccatcagcagtctacgacaaccgtagtaacgttactttgtacctaactttactactagtacaacgtaagtagttactacgttaacccgttcgttacgttttcggaccgtacgggtaaccgaacggtccgtaggacgtaacgtacgaaaccggtacgttacggtacggtcgtcgacctactacg

SEQ ID NO: 218904 - DNA, 597 bp, Homo sapiens
  misc_feature: GYAE6OF02FFJZ7.18.53.E09.1.454.CMB.1.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatgacccagtctccatcctccctgtctgcatctgtagganacagacgtcaccatccacgttgccggganaagtcagagctattagcagtcttaatttaaatggtatcagacaagaaacgaggaacgcccctaagctcctgatctatgctacatccagtttcgacaaggtcgggtcccagtcgtaaggttcgaagtcggactaggtggacttcggtagggactagtactttacacctctacaccatccagactagtcctagacctaaccgtagaacgttatttcgacttaacttactacgttacgacctaaacgtacgtaacgtttaccgaaccggttacccttacgtttaccgttttcggaacccgtacggggtaaccacggtccgtaagggactaacgttaccgaaaccggtacgttggtaaccgtcgtaccgctacccttacg

SEQ ID NO: 218905 - DNA, 577 bp, Homo sapiens
  misc_feature: GYAE6OF02G7KMJ.18.53.E09.1.454.CMB.1.raw
tcagtacgagtatgcacgaccggtgctcgatttagagagagtgtgttgggtttgggctctgggcaccgtgggcatgtgtgagttgtgtcaccaagtggggttttgagctcaactctcttctgcttgctggctgtagctccaggtgctcactcccaggtgcggctggtgcagtctggggctgaggtgaagaagcctggggcctcagtgaagctttcctgcaaggcatctggatacaccttcaccagctactatatgcactgtgtgcgacacggcccctggacgaagggcttggagtggatgggattaatcaaccctagtggtggtaccacaagctacgcacgagaacgttcgagggcagacgtcacatcgaccgaggaccacgtaccacgacgacacgacgtacctacgagtggacgcgtaggacgcgacgccgtagaacgactccgtaggaacggaccgtaccgggtccgttagttaacgtttacgtggtcgtacgtaaggaagggaacgggtacgttaagtagggtagggtacgtccgtttcccgtttaggtaccgtttcgggtacgggtacccgg

SEQ ID NO: 218906 - DNA, 584 bp, Homo sapiens
  misc_feature: GYAE6OF02HM4TA.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcattagcagcttaatttaaattggtatcagacaagaaaacgaagggaaacgacccctaaaggctacctgatctatgctacatcctagtttgactaaaggtcggggtacccagtcgtaaggttcaggtcggctaggtggattcgtagggactagtatttcactctacacctactacacgcagtctacgacctaactagtaagtattttagactaacttacttactacgtacaacacgtacgttaacgtacgttacccgttacgttaacgtttcggaccgtaacggggacctaacggtcggtaggaacgtaacgtaaccgaaacggtacgtaggtacggactacggaccaccgttacg

SEQ ID NO: 218907 - DNA, 563 bp, Homo sapiens
  misc_feature: GYAE6OF02IEE2G.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattgcagtctaatttaaattggtatcagacaagaaaacgagggaaaacgccccctaagcctcctagactctatgctacactcctagtttacgacgtaaaggtcgggtacccatacgaaggttcagtggacaggtgatcgtagggacagtacttcactctacaccatcagacagtctgacctaaccgttagtaacgttgttttacgacctaacttacttactacgtacaactagtacgttacgaacgttacccgtcgttacgtttacggaccgtacgggacctaaggtcgtaggactaacgtaaccaacgtaagtcggtacgctacgtaccactacg

SEQ ID NO: 218908 - DNA, 220 bp, Homo sapiens; identical to SEQ ID NO: 218613
  misc_feature: GYAE6OF02HKP7G.18.53.E09.1.454.CMB.1.raw
  modified_base (219)..(220): a, c, t, g, unknown or other
  misc_feature (219)..(220): n is a, c, g, or t

SEQ ID NO: 218909 - DNA, 560 bp, Homo sapiens
  misc_feature: GYAE6OF02FU1S6.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaacgcccctaagctcctgatctatgctacactcagtttgacaaaggtggggtcccatctaaggttcaggtggctaggtggatcgtgggacagtacttctactctcaccatcagctagtctgaccaactagaagtattttagactaactttactactgtacaactaagtacgttaactacggtacccgttacgttacgttttcggaccgtaggggaaccctaaggtcgtagggaacgtacgtaacgtaaaccggtaacgttacggtacggtaccgtacgtaccgaccttacg

SEQ ID NO: 218910 - DNA, 620 bp, Homo sapiens
  misc_feature: GYAE6OF02HW6KD.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccactcctccctgtctgcatctgtaggagacagagtcaccatcacttcggccggcaagtcagagcattagcagtcttaatttaaattggtatcgagacaagaaaaacgaggggaaaacaccccgtaagccttacctgacttctatgtactacattccgtagtttacgactaaacgggtcggggtaccctaatacgaagggtttcaagggttggcggtaaggtggaatcgggttacgggactaggtactttacgactcctcaaccatcaagctacggttctcgactaacccgtagtaacgttattttacgaacttaacgtttacctaacttcgtaactaacgtactaacggttaacctacgttaccccgttagttacgtttacggacggtacgggtactagcggtaggagtaaactaaccgtaaagtacgttagggcgtacgtacgaccacgttac

SEQ ID NO: 218911 - DNA, 569 bp, Homo sapiens
  misc_feature: GYAE6OF02IK0N8.18.53.E09.1.454.CMB.1.raw
  modified_base (216)..(216): a, c, t, g, unknown or other
  misc_feature (216)..(216): n is a, c, g, or t
tcagtacgagtatgcacgaccggtgctcgatttagagagagtgtgttgggtttggggcagtctcagtcaggacatagcatggacatgagggtccccgctcagctcctggggctcctgctactctggctccgaggtgccagatgtgacatccagatgacccagtctccatcctcctgtctgcatctgtaggagacagagtcacatcacttggccggnaagtcagagcattagcagctatttaaattggtatcagcaagaaaacagggaaagcccctaagcctcctgatctatgactactactcctagtttgactaaaggtcggggtaccagtacaaggttcagtggacagtgagtcgtagggacagtatttcactctcacctatacagactagtccgtagacctaacctaggtaagttacttttacgacttaacctttactacttcggtaacctaagtacgtaacgtttaccgaaccgttacccgtacgtttacgtttacgggccgtacgggtaccaaggtccgtaggagtaactacgaaacgtcgttgtaggtcctggtaccacctacg

SEQ ID NO: 218912 - DNA, 581 bp, Homo sapiens
  misc_feature: GYAE6OF02I5PR8.18.53.E09.1.454.CMB.1.raw
  modified_base (319)..(319): a, c, t, g, unknown or other
  misc_feature (319)..(319): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcattagcagtacttaatttaaattggtatcagacaagaaaacgagggaaacacccctaagctgcagatgattggtccgtcagtttacaagngtcgggacccagtcgagtacttccgcgtcgaggtggactcgtagggactagtactttcacttccgtaccaaccactccagcacgtcctgccacgccgttagtaagttattttcgaacttaaccttacgttattagtactagacgacggtcactacctaacgtttcccgcttacgttaccgtttcggggaccggtaacggggtaaccgttaaggggtacggaacggtaataccgaaacggtactgggtacgtcgtacgacccg

SEQ ID NO: 218913 - DNA, 621 bp, Homo sapiens
  misc_feature: GYAE6OF02G17TU.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagacttaatttaaattggtatcagacaagaaaacgaagggaaacgcccctaagcctcctagactctatgactacacttcctagtttacgacgtaaaggtcggggtacccagtacgtaaggttcaggtggacgtaggtgatcgtagggactagtactttcacttcctacaccactacgagtacgtacgtcgtacgacctaacgttaggtaaacgtttacgttttacgaaccttaaacctttacttacttacgtacctaaacgtgttaaacgttaaccgaccgtttacccggttacgtttaaccgtttcggaccggtacgggtaacctaacggtcgttaggaacgtacgtaaccgaaacgtacgttggtacgacgtacgaccacctacg

SEQ ID NO: 218914 - DNA, 511 bp, Homo sapiens
  misc_feature: GYAE6OF02GI5XS.18.53.E09.1.454.CMB.1.raw
  modified_base (428)..(428): a, c, t, g, unknown or other
  misc_feature (428)..(428): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaacgcccctaagcctcctgatctatgctacatccagtttgactaaaggtcgggtacccatcaaggttcagtggcaggtgatcgtgggacagtatttcgactctcaccatcagcagtctcgacaaccgtgaagttatttgactaacttactactgtacanagtagttacacgttaccctcgttactttcgggaccagggtacacggctaggagtaatacgaacgtactgtgactgccactacg

SEQ ID NO: 218915 - DNA, 731 bp, Homo sapiens
  misc_feature: GYAE6OF02ITPMP.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgaccagtctccatcctcctgtctgcatctgtagagacagagtcaccatacacgttgccgggactaagtcgagagcattaggctacgtacttaagtttaaaattggtaataccgaagaccgaaaggaaaaaccgaaggggaaaacgacccccgtaaaggtccttaccgtacggtaacttccgttaaacgttcgtaccttaactacgttaccgtacggttttacgaacgttaaacggtacggggttaccctaagtacgtaaaggtttccgaaggtcggacgtaggttacggactcggtagggaactagtactttactaccgtcctaccacctaactaccgacgaccgtacgttacctacgacccgtaaacgttacgtaaacgttacgttttaccgaactttaaccgttaaccttaacgtacgttaacctaataaggttaacgtttaaccgaccgtttaacccggtttaccgtttaacgttttcgggaaccgtacgggacccgtaaacggtacgtacgggtaataaccggtaaccgtaaacgtaacttacgggtacgtaccgtacgaccgtaccgtac

SEQ ID NO: 218916 - DNA, 622 bp, Homo sapiens
  misc_feature: GYAE6OF02HNGI4.18.53.E09.1.454.CMB.1.raw
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagngcattagcagtcttaatttaaagttggtatcagacaagaaaacagggaaacgcccctaagctacctgatctatgacctacatcctagtttgacgtaaaggtcggggtacccatcgtaaggttcaggtcggactaggtggattcgtagggactaaggtactttcacgtctaccaacctatacgagtctaagttcctagacctaaccgttagtaaagttacgttttacgaaccgtaaacctttaaccgtaacgttcgttaaccaaacgtagtaacgtttaactaacggttaaccccgttaggtttaaccttttcgggacccgtaggggtaccctaaggtcgtacgggtaacgtaactaaccggaactaacggttcgacggtactacgtactaccgtacg

SEQ ID NO: 218917 - DNA, 629 bp, Homo sapiens
  misc_feature: GYAE6OF02GYN2D.18.53.E09.1.454.CMB.1.raw
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccggganaagtcagagcattagcagtcttaatttaaatggtatcagacaagaaacaggaacnccctaagctctagactactatcgactactatcgtagttgacgtaaggtcggtaccagtacgtaaggttcgaggtcggacgtaggtagtacgtcggtagggactaacgtagtttaccacttacctaccaacctactaccgacgtacgtacgttacctacgaccctaaaccgttaggtaaacgtttagtttacgaaccttaaactttacgtacttacgtaactaacgtagtaacgttacgtaacgttacccgttacgttacgtttacgggaccgtacggaacctacggtacggtaaggaacgtaaccgtaaccgaacggtacgttacggtcggtaccgtacgtacccgaccttacg

SEQ ID NO: 218918 - DNA, 223 bp, Homo sapiens
  misc_feature: GYAE6OF02GPF6W.18.53.E09.1.454.CMB.1.raw
  modified_base (220)..(223): a, c, t, g, unknown or other
  misc_feature (220)..(223): n is a, c, g, or t
tcagtacgagtatgcacgaccggtgctcgatttagagagagtgtgttgggtttgggggaagaggaagactgacggtcctcccaggagttcaggtgctgggcaccgtgggcatggggggaggtgtgtcacaagatttgggctctgggcacagcggccctgggctgcctggtcaaggactacttcccatactcgtactgagcgggctggcaaggcgcatagnnnn

SEQ ID NO: 218919 - DNA, 670 bp, Homo sapiens
  misc_feature: GYAE6OF02H994T.18.53.E09.1.454.CMB.1.raw
tcagtacgagtatgcacgaccggtgctcgatttagagagagtgtgttgggtttgggggcagtctcagtcaggacacagcatggacatgagggtccccgctcagctcctggggctcctgctactctggctccggaggtgccagatgtgacatccagatgacccagtctccatccctccctgtctgcatctggtaggagacagagtccaccatccacgttcggccgggacaagtcaaggacgactaattagacagtactttaatttaaatttaggttagtacagacaagaaaacgaaggaaacgacccctaacgtactcctagactactatgtactactactcgtagttagtacgtaaaggtacgggtaccgtactacgtaacgtacgtaggtaggacgaggtggtagtacgtagggacccccccccgtagtactttactactactacctaccactacacgtctacgtactacgacgtaacctaacgtaagttacgtttacgtactaaaccttaacttacgttacgtaactaacaagtaacgttaacgtaaccgttacccggttaccgttaccgtttacggtaccggtacgggtaaccgtaacggtacggtaacggacgtaacgtaaccgtaaaccgtaacgtacggtacggtacgtacgtacctacctacg

SEQ ID NO: 218920 - DNA, 664 bp, Homo sapiens
  misc_feature: GYAE6OF02IKYKZ.18.53.E09.1.454.CMB.1.raw
  modified_base (177)..(177): a, c, t, g, unknown or other
  misc_feature (177)..(177): n is a, c, g, or t
  modified_base (224)..(224): a, c, t, g, unknown or other
  misc_feature (224)..(224): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctntctgcatctgtaggagacagatcacatcacttgccggcaagtcaagncaatagcagcttaatttaaattggtatcagacaagaaaacgaagggaaacgacccctaaagctcctagaattctaatgactacactacctagtttgacgaaagtcgggtaccatcaaggttcagtgcagtgatgtaggacagtacttcgacttctacacatacgatcgattcgtgaccaaccgttagtaagtacgttttcgaacttaacttaccgttaattaccgaacttaaaccgaaacggttaacgtttaacccgtaacgtttaacccccgggtttacgttttaaacccggttttaccgggtaaccggttaaccgggggaaaccgttaacccgggtaacggttttaacggggaaccgttaaacgttaacccggtaaaaaccgttaccggtttacggggtaacgggttacccttaccggttaccctaacccgtttaccg

SEQ ID NO: 218921 - DNA, 542 bp, Homo sapiens
  misc_feature: GYAE6OF02I1FI2.18.53.E09.1.454.CMB.1.raw
  modified_base (273)..(273): a, c, t, g, unknown or other
  misc_feature (273)..(273): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaacagggaaacncccctaagctcctagatctatcgctacacttcctagtttgactaaaggtcggggtcccatacaaggttcagtggcagtgatgtagggactagtatttcgactctcactatcagcatctcgactaacctagaagtattttagacctaacttactactgtacaacgtagtacgttaacacgttacccgttcgtttacgtttacggcgtacggggactaacggcgttaggagtaactaaccgaaacgaacgtggtacggctcgaccactacg

SEQ ID NO: 218922 - DNA, 220 bp, Homo sapiens; identical to SEQ ID NO: 218613
  misc_feature: GYAE6OF02IY7MU.18.53.E09.1.454.CMB.1.raw
  modified_base (219)..(220): a, c, t, g, unknown or other
  misc_feature (219)..(220): n is a, c, g, or t

SEQ ID NO: 218923 - DNA, 649 bp, Homo sapiens
  misc_feature: GYAE6OF02GC9FM.18.53.E09.1.454.CMB.1.raw
  modified_base (637)..(637): a, c, t, g, unknown or other
  misc_feature (637)..(637): n is a, c, g, or t
tcagtacgagtatgcacgaccggtgctcgatttagagagagtgtgttgggtttggggcagtcttcagttcaggacacagctatggacatgagggtccccgctcagctcctggggctcctgctactctggctccggagggtgccagattggtgacatcccagattcgacccagtcctccattccctccctgtctcgcactctgtacggagacagtacgtccaaccatacctaccttcggaccgggactaaggtacaggacgactaattagcgagtacttaactttaaagttgtaatacgagactaagaaacgacggaaaccgacccgtaacgtcctctagacttctagttcgtactactacgtccgtacgttagacgtaacggtacggggtacctagtacgtaacggttcgtaggtcggacgaggtacgtatacggtacggtacgtagttacttactacgtactaccacgtagtacgacgtactacgttacgtacgtacgtaacgttagtaagtttctttacgtactaacttacgtacttcgaactacgtacgtacgttacgtacggtaccgttacggttacgttacggacggtacggaactaggtcgtaggactacgtaacgtatacgtacgtcgtnacgtactacgtc

SEQ ID NO: 218924 - DNA, 620 bp, Homo sapiens
  misc_feature: GYAE6OF02G3GL3.18.53.E09.1.454.CMB.1.raw
  modified_base (74)..(74): a, c, t, g, unknown or other
  misc_feature (74)..(74): n is a, c, g, or t
  modified_base (215)..(215): a, c, t, g, unknown or other
  misc_feature (215)..(215): n is a, c, g, or t
tcagtacgagtatgcacgaccggtgctcgatttagagagagtgtgttggggttgggcagtctcagtcaggacanagcatggacatgacggtcccgctcagctcctgggctctgctactctggctcgagtgccagagtgtgacatccaagatgacccagtctcagtcctcctgtctgcatctagtaggagacagagtcaccatcacgttcgccggnaagtcagagcattagcagtctaattaaattggtatacagctaagaaaacaggaaacgccctaaggctccgtagactcctagtgctaactatccgtagtttagacgtaaaggtcggggtaccctagtaaccgtaaaggttcaaggtgacgaagtcgggaacttcgtagggaactagtaacgtttacgaaccgttacgtaccgaaccgtaacttaccgaagtaccgagttccgtagaccgtaaccgttagaaacggttattttacgaaccttaaactttacgtacttacggtaactaacgtagtaacgttaactaacgttaaccgtacgttaacgtttcggacgtacgggtactaaggtcgtaaggacgagtaccaagtacggtcggacgtactacggtcactacgg

SEQ ID NO: 218925 - DNA, 588 bp, Homo sapiens
  misc_feature: GYAE6OF02HXX6C.18.53.E09.1.454.CMB.1.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
tcagtacgagtatgcacgaccggtgctcgatttagagagagtgtgttgggtttggggcagtctcagtcaggtacacagcatggacatgagggtcccgctcagctcctggggctcctgctactctggctccgaggtgccagatgtgacatccagatgacccagtctcatcctcctgtctgcatctgtaggagacagagtcaccatcgacttgccgggacaagtcagagcattagcagctattaaattgatcagcagaaacgaggaaancccctaagctctgatntangtctacatactagtttagactaaaggtcggggtacccaagttactaaaggttcaggttacggacgaaggttgggaacttcgtaggggactaggttatttacgactctcaaccatcagcagtctagaccaactgaacgttatttacgactaactttaactacgttacgtacaacgtacgtaacgttacctaacgttacccgtacgttaacgttttcggacccgtacggggtaccgaaggtcgttagggaacgtaacgttaaccgaaacgtaccgtacggtacggaccgtaggaccgacctacg

SEQ ID NO: 218926 - DNA, 549 bp, Homo sapiens
  misc_feature: GYAE6OF02HE5D2.18.53.E09.1.454.CMB.1.raw
  modified_base (383)..(383): a, c, t, g, unknown or other
  misc_feature (383)..(383): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctatttaatggtatcagcaagaaacagggaaacgacccctaagctcctgactctatcgctacatccagtttcgactaaagtcggggtacccagtacgaaggttcaaggttggactaggtgtactcgtgggacagtatttcacttcncaccatcagcagtcngacaacgtnaacgttatttcgactaacttactacgtgtacaacgtagtaacgttacacgttacccgttacttacgttttcgaccgtacgggaacctaacggtctaggtacgaactaacgaacgtacgtacggcgtacgtacgactactacg

SEQ ID NO: 218927 - DNA, 596 bp, Homo sapiens
  misc_feature: GYAE6OF02GI2BK.18.53.E09.1.454.CMB.1.raw
  modified_base (436)..(436): a, c, t, g, unknown or other
  misc_feature (436)..(436): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaattggtatcagacaagaaaacagggaaacgcccctaagcctacctgatctatgactacatcctagtttgacgtaaaggtcggggtaccctagtacgtaaaggttcaggtggctaggtggatcgtagggactagtactttacacttctacctaacctatccgagtcacgttctcgacctaaccgtgtaattnttttacgacttaactttactactacgtacaacgtagtacgttactaacgttacccgttacgttacgtttacgggacccgtacgggtaaccaacggtcggtagggtaacgtacgttaaccgaaaccggtacgttcggtacggtacgtacgtaccacttacg

SEQ ID NO: 218928 - DNA, 616 bp, Homo sapiens
  misc_feature: GYAE6OF02IG1CT.18.53.E09.1.454.CMB.1.raw
  modified_base (277)..(277): a, c, t, g, unknown or other
  misc_feature (277)..(277): n is a, c, g, or t
  modified_base (405)..(405): a, c, t, g, unknown or other
  misc_feature (405)..(405): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgctatctgtaggagacagagtcaccatcacttgccggcaagtcagagcattagcagcttaatttaaattggtatcagacaagaaaacagggaaacncccctaaagctcctgactctaatgctacactcctagtttgactaagtcggggtcccaatcgaaggttcaggtggacgtaggtggaatcgtagggactaaggtatttacgacttctaccacctataccngtacctagtcctacgaccgtaaccttagtaacgttattttcgaacttaacttaacctacttagtaacctaaacgtagtaacgttaaccgtacgttaacccgttggtttaacctttaccgggaccgtaacggggtacctaacggacgtaggtacgtaaacgttaaccgaaaaccgtacgttcggtaccggtcgttaacgtccaaccgttacg

SEQ ID NO: 218929 - DNA, 225 bp, Homo sapiens
  misc_feature: GYAE6OF02H2GZY.18.53.E09.1.454.CMB.1.raw
  modified_base (220)..(225): a, c, t, g, unknown or other
  misc_feature (220)..(225): n is a, c, g, or t
tcagtacgagtatgcacgaccggtgctcgatttagagagagtgtgttgggtttggggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnnnnn

SEQ ID NO: 218930 - DNA, 662 bp, Homo sapiens
  misc_feature: GYAE6OF02GQL85.18.53.E09.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtcctccatccctcctgtctgcatctgtagganacagagtcaccatcacgttggccggcaagtcaganctattagcagtacttaatttaaattggttatacagtacgaaagaaaaacgaacggggaaaacgaccccgtaaacgtccttaccgtagtaactcgtaattacgacctaactacttaccgtagtttagaacgtaaaggtcggggttaccctaagtacgtaaggttcgtaggtacggtacgtaggtaggtagtcgtagggtaacagtttactttaccgaacttcctacccgtaacctatccgtaagctacgtcgtacgaacctaaccttaggtaacgttagtttacgacttaaacttaacctattacgtaacaacgtagtacgttaaccgtacgttacccgttaggttaaccgtttcgggacgtagggtactacgtaaggtcgttaggaacgtaacgtaactaacggtacgtggttacggtcgtaccgactaaccg

SEQ ID NO: 218931 - DNA, 633 bp, Homo sapiens
  misc_feature: GYAE6OF02IPWA9.18.53.E09.1.454.CMB.1.raw
  modified_base (230)..(230): a, c, t, g, unknown or other
  misc_feature (230)..(230): n is a, c, g, or t
tcagtacgagtatgcacgaccggtgctcgatttagagagagtgtgttggggtttggggcagtctcagtcaggacacagcatggacatgagggtccccgctcagctcctggggctcctgctactctggctccgaggtgccagatgtgacatccagatgacccagtctccatccctccctgtctgcatctggtaggagacagagtcaccatcacttgccgggacaagtcagngctattagcagcttaatttaaattggtatcagacaagaaaacgagggaaacgcccctaaagcctcgtagatctatgactacatcctagttgacgtaaagtcggggtacccatactaaggttcaaggtcggacaaggtaggtaattcgtagggtactaaggtactttcactactacaacctatacacgactacgtcgtagacctaaacctaggtaaacgtattttacgaaccttaaacttaacctaacttagtaacctaaacacggttaattaaccgtaacgttaacccgttacgtttaaccggttttacggaccggtacggggtaacctaacggtacggttacggaagtaacgttaacgaaaaccgaacgttaggtacgaccggttagtaccaaccgttaacg

SEQ ID NO: 218932 - DNA, 734 bp, Homo sapiens
  misc_feature: GYAE6OF02IRGTE.18.53.E09.1.454.CMB.1.raw
  modified_base (278)..(278): a, c, t, g, unknown or other
  misc_feature (278)..(278): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccgggcaagtcagacgcattagcagtactaatttaaattggtatcagacaagaaaacacgggaaacncccctaagctacctagactactatcgtctacatacctagtttacgacgtaaacggtcggggtaccctaagtacgtaaacgggtttcgaaggttacgggtacgtagggttacggtacgttaccggttacggggaaaccgtaacgggtttaactttttaccgaaccgtttccgttaaccaaccccgtacttacccgaaagtaccgtaacggttccgtacggtaaccttaaacccgttaaggtaacgttaacgttttacgaacctttaaacctttaccgttaacgttacgtaaccgtaacgttaaacggttaacgttaaccgtaaccggtttaaccccggttacggtttaaccgttttccgggaacccggtacggggaacctaacggtacggtacggtaaacgtaacttaacgaaacggtacgttacgggtaccgtacgtacggtacctaccgttaacg

SEQ ID NO: 218933 - DNA, 712 bp, Homo sapiens
  misc_feature: GYAE6OF02IR92U.18.53.E09.1.454.CMB.1.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctggtaggagacagagtcaccatcacttggccggganaagtcaagngacattagcagtacttaatttaaattggtatcagacaaagaaaacgaaggggaaaacgtacccctaaacggccttaccgtagtactactatgtactaactattcctaagtttacgaacgtaaagggttcgggggtacccctaagtacgtaaacgggttcgaacggtggacgtagggttagggaacgttcggtacggggtaactaagggtttacttttaccgaaccttccgtacctaaccctaactaccgagtacgtaacgttcctacggacctaaaccgttaggtaaagttacttttacggaacctaaccttttaaaccgtacgttacgttaacgaaacctaggtaacgttaaccgtaccgtttaacccggttacggttttaacgttaccggtaccggaaccggggtaacaacggtcgtaagggaagtaaccgtaacgaaacccgtaaggttcggtacgaacgtcgaccgtaacttaccgg

SEQ ID NO: 218934 - DNA, 756 bp, Homo sapiens
  misc_feature: GYAE6OF02JO86L.18.53.E09.1.454.CMB.1.raw
  modified_base (217)..(217): a, c, t, g, unknown or other
  misc_feature (217)..(217): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctcgaggtgccagatgtgacatccagatcgacccagtctccatcctcctgtctgcatctgtaggacgacagacgtcaccatcacttgccgancaagtcagacgcaattagcagcttaatttaaagttggtatcagacaagaaaacgaagggaaaccgccccgtaaagccttaccgtagtacttacgtaacttcggaccttaaccgacgttacccttaaggttacgtaccggtaaaaggtacccggggttaccctaacgttacgtaaacggtttacgaaggttcgggaccgtaagttcgggtaaacgttcggttaacgggaacgtaacggtttactttaccgtaaccgtttccctaaaccgtacctaacgtaccgtaacgggaccttaacggttaccgtacgaaacccgttaaacccgtaggttaaaaccgtttacgttttcgtaaaccgtaaacccttttaacggttaaccttaccgtaacgtaaacgtaaccggttagtttaaaccgtaacccggtttaaccggttaccgttttaacgtttacccgggacggtaacggaccgtaacggttaccgaggtaactaccgtaaacgtaaccggtacgttggtacgtccgttacgtaccctaacg

SEQ ID NO: 218935 - DNA, 610 bp, Homo sapiens
  misc_feature: GYAE6OF02GU3P8.18.53.E09.1.454.CMB.1.raw
  modified_base (194)..(194): a, c, t, g, unknown or other
  misc_feature (194)..(194): n is a, c, g, or t
  modified_base (285)..(285): a, c, t, g, unknown or other
  misc_feature (285)..(285): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttcggccgggacaagtcagagacattagcagtacttaatttaaattggtatcgagacaagaaaacgagggaaacncccctaagcctccgtagatctatcgactacatcctagtttcgacgtaaggtcgggtaccatacgtaaggttcgaggttcggcgtaggtaggtattcggtagggaactagtactttccacttacctacaaccatacacgctacgtctacgactaaccgtagtaacgttatttacgacttaaacctttactactagtaacaacgtagtaacgttaacgtaccgttacccgttacgtttaacgtttcgggaccgtacgggtactaggcgttaggacgtaacgtaccgtaaacggttacgtaggttacgtaccgtacgacctacttacg

SEQ ID NO: 218936 - DNA, 568 bp, Homo sapiens
  misc_feature: GYAE6OF02JFP1V.18.53.E09.1.454.CMB.1.raw
  modified_base (102)..(102): a, c, t, g, unknown or other
  misc_feature (102)..(102): n is a, c, g, or t
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (425)..(425): a, c, t, g, unknown or other
  misc_feature (425)..(425): n is a, c, g, or t
  modified_base (465)..(465): a, c, t, g, unknown or other
  misc_feature (465)..(465): n is a, c, g, or t
tcagtacgagtatgcacgaccggtgctcgatttagagagagtgtgttgggtttggggcagtctcagtcaggacacagcaagtagggacatgagggtccccgntcagctcctgggctcctgctactctggctccggaggtgccagatgtgacatccagatgacccagtctccatcctcctgtctgcatctgtagganacagagtcaccatcacttgccgggnaagtcagagcattagcagtctaatttaaattggtatcagactaagaaaaacgagggaaacgcccctaaagcctacctagatcgtatgactaacatccgtaagtttggacctaaaaggtcggggtacccagttactaagggttcaggtggacgaggttggaacttccgtagggaactagtatttcactctacacatcagcagtcngacacctagtaagtatttgactaactctaactgtaccaanagtacttaactacgtaccgtcgttacgtttggaccgaggggtaccaaggcgtaggaactaagtaacgaaaccgtagttacggtagtactacgtacctactacg

SEQ ID NO: 218937 - DNA, 176 bp, Homo sapiens
  misc_feature: GYAE6OF02GONDX.18.53.E09.1.454.CMB.1.raw
  modified_base (175)..(176): a, c, t, g, unknown or other
  misc_feature (175)..(176): n is a, c, g, or t
tcagtacgagtatgcacgaccggtgctcgatttagagagagtgtgttgggtttggggggaagaggaagactgacggtcctcccaggagttcaggtgctgggcacagcggccctgggctgcctggtcaaggactacttcccatactcgtactgagcgggctggcaaggcgcatagnn

SEQ ID NO: 218938 - DNA, 623 bp, Homo sapiens
  misc_feature: GYAE6OF02GAGBO.18.53.E09.1.454.CMB.1.raw
  modified_base (362)..(362): a, c, t, g, unknown or other
  misc_feature (362)..(362): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatcctacttcggccgggcaagtcagagcattagcagacttaatttaaattggtatcgagcaaagaaacgaagggaaacgcccctaagcctaccgtgatactatgactactactcctagtttcgacgtaaaggtcggggtacccatacgtaacggttnaggtggacgtaggtggagtcgtacgggactagttacttcgacctctaccacctactcgagctacgtctacgactaaccgttagtaactttcgtttacaacttaacctttacgtaacttcgtaactactaagttaccgttacgtaaccgtttaccgttacggtttacgtttaccgggacccgggtacggtaccgaacggtcgttaaggaacggtacgtaaccgtaaccgtacgttggtcggtactacggtaccaccgttacg

SEQ ID NO: 218939 - DNA, 659 bp, Homo sapiens
  misc_feature: GYAE6OF02I9NA1.18.53.E09.1.454.CMB.1.raw
  modified_base (533)..(533): a, c, t, g, unknown or other
  misc_feature (533)..(533): n is a, c, g, or t
tcagtacgagtatgcacgaccggtgctcgatttagagagagtgtgttgggtttggggcagtctcagtcaggacacagcatggacatgacgggtccccgctcagctccgtgggctcctgctactctggctccgaggtgccagatgtgacatccagatcgacccagtctccactccctccctgtctgctatcgtaggtaggagacagagtcacctatctacgttcggccgggacaagtcaagagctatagcagtacttaatttaaattggtatcagacaacgaaaacgaagggaaacgacccctaaaggccttaccgtagacttacgtactacgacctactacttaccgtaggtttacggaacgtaaagggttccggggtacccaagttaaccggtaacggttacgtagggtacggacgtaggtacggtacgtcggtacgggactagttacttctactccctacaaccagtctagacgtacgtacgcgtacctaacgtagtaattacgtttagacttaactacttacgtactaanacgtaagtacgttaccgtaccgttaccgttcgtttacgtttacggtacgaccggtaacgtacggtacgtaggacgtaaccgtaacgtaacggtacggtcggtacggtaccaccgtacgaccttacg

SEQ ID NO: 218940 - DNA, 671 bp, Homo sapiens
  misc_feature: GYAE6OF02H0F6M.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctcatccctcctgtctgcatcgtagtaggagacagagtccaaccatcacgttcggacccgggacaaggtcaggacgctagttagcagtacttaatttaaagttggtatcgagacaagaaaacgagggaaaccacccctaagccgttaccgtagtacttactacgtcgtactaactacgttaccgtagtttacgaacgtaaacgggttccggggtaccctagtacgtaacgggttctagggtcgacgtaggtaggtacttcggaggtacgtagtactttacacttcctaccacctacgtacacgtacgtacgtctaccgaacctaaccgttagtaacgttactttaccgaactaccttaactactacgtacgtaactagtaacgttacgtacgttaacccggttcgttaacggtttacgtaccgggtacggtaaccggtacgtacggtacggtaacggtaactaaccgtaacgtaacggtacgttacggacggtactaccgtacttacg

SEQ ID NO: 218941 - DNA, 725 bp, Homo sapiens
  misc_feature: GYAE6OF02H7BU5.18.53.E09.1.454.CMB.1.raw
  modified_base (229)..(229): a, c, t, g, unknown or other
  misc_feature (229)..(229): n is a, c, g, or t
  modified_base (312)..(312): a, c, t, g, unknown or other
  misc_feature (312)..(312): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctacttgccgggacaagtcaagngctattagcagacttatttaaacttggtatctagacaagtaaaacgaagggaaactccccgtaaagcctcctagatacctaancgtctaacatcctagtttcgactaaaggtggggtacccagtacgtaaggttccaggtacggactaggttcgggattcggtagggaactaggtactttacgtactaccgtactaacctactcaacggtacctagttccgtagtacctaaaccgtacgttaaacgttacggttttactaccgttaaacctttaaccgtaacgtttacgtaaccgtaaccgtaacgtttaaccgttaacccggttaacgtttaaccccggtttaccggtttaacccgttttttaccggggaacccgtaaccgggggtaacccgtaacgggtccggttaacgggtaacggtaaacgttaaccggtaaaaaccggtaaccgtttacgggtaccggttacccggtaccgtacccgttacgttaaccccg

SEQ ID NO: 218942 - DNA, 693 bp, Homo sapiens
  misc_feature: GYAE6OF02IPR76.18.53.E09.1.454.CMB.1.raw
  modified_base (225)..(225): a, c, t, g, unknown or other
  misc_feature (225)..(225): n is a, c, g, or t
tcagtacgagtatgcacgaccggtgctcgatttagagagagtgtgttgggttggggcagtcctcagtcaggacacgagctatggacatgagggtccccgctcagctcctggggctcctgctactctggtctcgaggtgccgtagatgtgactatccagatgacccagtctccatcctccgtgtctgcgatcgtgtacggagacaggagtcacatcacttgccggnaagtcagcgcagttagcagctaattaaagttggatcagcaagaaacgacgggaaacacccctaagcctaccgtagactcgtaatggtactacacgttaccgtagtttagacgtaaaggtcggggtaccctagtacgtaagttacgtaggttaggcgtagtcggtacgttacggtagggaacgtacgtatttacctaactcttacgaaccgtatacgacgtacaacggtcgtacgaacctaaacgttaggtaaacgttagttttaccgaacttaaaccttaacgttacctaacgttaaccgaaacgtaaacggtaacggttaaccgttaacggttaacccgtttaacggtttaaccgtttacgggaaccggttacgggggaacccgtaaggtacggtacgggaattaaccgtaaacgttaacggtaacgtttcggaccgggtacttaccgggacctaaccggttaccgg

SEQ ID NO: 218943 - DNA, 702 bp, Homo sapiens
  misc_feature: GYAE6OF02IMES6.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtcctccatccctcctgtctgcatctgtaggagacagagtcaccatcacttcgccgggacaagtcagagacattagcagtcttaatttaattggtatcagacaagaaaacgagggaaacctaccccgtaagtcctaccgtaggacttacctagtacgacttaacctacgttaccgtagttttcgaacgtaaacgggtccgggggtaccctaagtaccgtaaagggttccgtaaggtggtacgtaaggttacggtacgttaccgggtagggtaacttaacgggttacttttacccgacgttccctacaacccgtatacgacgtccgacgttcgtacgtacctaaccgtaggttaattacgttttacgaacccttaacctttacttaccgtagtaacctaacgtaacgttacgttaaccgttaccgttacccgtttacgtttaaccgtttccgggaccggtacggggtaacctaacgggtcgtaggaacgtaccgtaaaccgtaaacgtacggttcggtagtaccgtccgacctacgttaccg

SEQ ID NO: 218944 - DNA, 754 bp, Homo sapiens
  misc_feature: GYAE6OF02IL2QS.18.53.E09.1.454.CMB.1.raw
  modified_base (239)..(239): a, c, t, g, unknown or other
  misc_feature (239)..(239): n is a, c, g, or t
tcagtacgagtatgcacgaccggtgctcgatttagagagagtgtgttggggtttgggggcagtctcagtcaggacacagcatggacatggagggtccccgctcagctccgtggggctcctgctactctggctccgaggtgccagatgtgacatccagatacgacccagtctccatccctccctgtctgctatcgtggtaggagacagacgtccacctaactctacgttcggaccggganaacgtcaggacgtactaattacgacaagtacttaaattttaaagttggtatacgagacaaaaggaaaacgaacgggaaaaccgtacccgtaaacgtccgtacgttaacgacttacgttaagtcgtacctaacctacgttacccgttaagtttaccggaacgtaaaacgggtccggggttaccctaagtacgttaaacggttcgaagggttcggacgtaagggttcgacgttacgggtagggtaacgtaacgtttactttcctaaccgttcctaaactaacctaacgtacgacgtacgtacgtactacgaccgtaactaggttaaacgttactttacgaactttaaccttaaccttagtactaaccgaagtaacgttacgttacgaaaccgttcccggttacgtttacggttaccggaccgggtaacgggtaacctaagggtcgtaacggtacgtaaacgtaaccgtaaaacggtaccggttacggttacgggaccctacggtacccgtattaccg

SEQ ID NO: 218945 - DNA, 546 bp, Homo sapiens
  misc_feature: GYAE6OF02FM504.18.53.E09.1.454.CMB.1.raw
  modified_base (218)..(218): a, c, t, g, unknown or other
  misc_feature (218)..(218): n is a, c, g, or t
  modified_base (288)..(288): a, c, t, g, unknown or other
  misc_feature (288)..(288): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaatggtatcagacagaaacagggaagcccctaagctcctagatctangctacatcctagtttgacaaagtcggggtcccagtcaaggttcagtggcaggtggatcgtagggactagtatttcactctacaccatcagctagtctgacaacctagaagtattttgactaactttactactcgtacaacagtaacgttactacgttacccgttacgttacgtttcggaccgtacggggaccaaggtcgtagggaacgtaacgtaacgaaacggtaacgtgggtacggacgtacggacctaccgtacg

SEQ ID NO: 218946 - DNA, 621 bp, Homo sapiens
  misc_feature: GYAE6OF02GUWZ3.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatcacgttcggccgggacaagtcagagcaattagcagtacttaatttaaattggtatcagactaagaaaacgaagggaaacgacccctaagcctcctagatctatcgactacactctagtttgacgtaaaggtcgggtaccagtacgtaaggtacaggtcggactaggtggtatcggtagggaactacggtactttaccgtactacctacctaaccaacgtaccagtactaacgtcgtacgacctaacgttagtaaacgttactttagtaactaaccgtttaactacgtacgttaacaacgtagtaacgttactacggttaccgttacgttacgtttacgaccgtacgggaactacggtacgtacggaagtaacgtaaccgaaacgtacgttcggtacgtcgtacgacctaccgtac

SEQ ID NO: 218947 - DNA, 183 bp, Homo sapiens
  misc_feature: GYAE6OF02G269V.18.53.E09.1.454.CMB.1.raw
  modified_base (174)..(183): a, c, t, g, unknown or other
  misc_feature (174)..(183): n is a, c, g, or t
tcagtacgagtatgcacgaccggtgctcgatttagagagagtgtgttgggtttgggggaagaggaagactgacggtcctcccaggagttcaggtgctgggcacagcggccctgggctgcctggtcaaggactacttcccatactcgtactgagcgggctggcaaggcgcatagnnnnnnnnnn

SEQ ID NO: 218948 - DNA, 609 bp, Homo sapiens
  misc_feature: GYAE6OF02FF0NB.18.53.E09.1.454.CMB.1.raw
  modified_base (98)..(98): a, c, t, g, unknown or other
  misc_feature (98)..(98): n is a, c, g, or t
  modified_base (231)..(231): a, c, t, g, unknown or other
  misc_feature (231)..(231): n is a, c, g, or t
tcagtacgagtatgcacgaccggtgctcgatttagagagagtgtgttgggtttggggcagtctcagtcaggacacagcaatggacatgagggtcccgntcagctcctggggctcctgctactctggctccgaggtgccagatgtgacattccagatgacccagtctccgactccgtccctgtctgcatctgtaggacgaccaggacgtcaccgattccacgttcgccgggnaagtccaggagcattacgcagtctaatttaaatggtactcgagtacaacgtaaacgacggaaacgcccctaaagtcctaccgtagatcgtatcggacctacgtacttccgtagtttacggacgtaaacggttcggggtacccaagtcgtaaaggttcaaggttggacgtaggtggtaacttcgtagggactagtacttcacttcacacatcagtcacgttcacgactaaccgtagaacgttactttacgacttaacgttactacttcgtaacaacgagttacgttaacctacgttacccgttacgttacgtttacggaccgtacgggaaccagtcgtagacgtactaacgaaacgacgtcggtcgctcgacctatacg

SEQ ID NO: 218949 - DNA, 778 bp, Homo sapiens
  misc_feature: GYAE6OF02F8XCL.18.53.E09.1.454.CMB.1.raw
  modified_base (274)..(274): a, c, t, g, unknown or other
  misc_feature (274)..(274): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggacaagtcagagcattagcagctatttaaattggtatcagcaagaaaacagggaaacnccccgtaagctcctagatctatgctacatcctagttttgactaaaaggtcggggtaccctagtactaaaggttcaggttcgggactaaggtgggtaattcgtaggggaactaggtaacttttccgaaccttccgtaccaaaccctactaccgaacgtacctaagttaccgttacggaccctaaacccgttaacggtaaaagtttaacgttttttaacggaacctttaaaaccgttttaaccgtttaaaccgttacggttaaccgtaaaaccggtaacgttaaacggttttaacccgttaaaccgggttttaaacccccgtttaaccgggtttttaaacccgtttttttacggggaaccccgttaacggggggtaaaccccgtaaacggggttaaccgtttaacggggtaaacggtaaacctttaaacccggaaaaaaccggtttaaaccggttacggggttaccgggttaaccgttaccggtaacccgtacccgtttaaaccgg

SEQ ID NO: 218950 - DNA, 615 bp, Homo sapiens
  misc_feature: GYAE6OF02FJR3T.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaacaggaaacgcccctaagctcctagatctatgctacatccagtttgacaaagtggggtcccatcgaagttcaggtgcgagtggatcgtagggacagtatttcacttctacaccatcagctagtcctacgctaaaccgtgtaaacgttacgttttcgaacctttaaacctttaccttaacttcggttaacctaaacgtaacgtaacgttttaaccgtaaccggttaaccccggttacgtttaaccgttttcggggacccgtaacgggggtacctaacgggtccggtaggtaacgtaacggttaaccgtaaaaccggtaccgttacggtaccgggtacctagtaccgtacccgttacg

SEQ ID NO: 218951 - DNA, 694 bp, Homo sapiens
  misc_feature: GYAE6OF02G9YTF.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtccaccatccacgtttggaccgggcaagtccaggagcattagcagcttaatttaatggtatcagacaagaaaacgagggaaacgacccctaagcctacctgatcctatgactacactcctagtttgactaaggtcggggtaccctagtacgtaaaggttcaaggttcggctaggtacgtagtaccgtagggaacctaggttacttttacaccgttcctaccgaaccttacgtaccgtaaggccttaaggtccttacggaccctaaaccgttaggtaaaacgtttcggtttttccaaactttaaacccttaaccgttacgttacgtaacctaaaccgaaggttaacctttaacgtaaccggtttacccgtttaccgttttacggttttaccgggaacccgtacgggggtaaaccctaggtacccggttaggaacgtaaccttaaccggtaaacccgtacggttacggtcggtaccgtaccggtacctacgttacg

SEQ ID NO: 218952 - DNA, 596 bp, Homo sapiens
  misc_feature: GYAE6OF02IJ68S.18.53.E09.1.454.CMB.1.raw
tcagtacgagtatgcacgaccggtgctcgatttagagagagtgtgttggggtttggggcagtctcagtcaggacacagcatggacatgagggtccccgctcagctcctggggctcctgctactctggctccgaggtgccagatgtgacatccagatgacccagtctccatcctccctgtctgcatctgtagagacagagtcaccatcacttggccggacaagtcagagcattagcagcttaatttaaattggtatcagcaagaaaacgagggaaacgccctaagctacctgatctatgctacattcctagtttacgacgtaaagtcggggtaccagtcgtaaggttcgagtggacaggtggatcgtagggactagtactttacacttctacacctataccgtacgactaacgtctacgacgtaaccttaggtaaacgttattttacgactaaactttactaacttacgtaactaacgtagtagttacgaacgttaacccgttcgtttaaccgttttcgggaccgtacgggtaactaacggtcgtaggagtaactacgaaaacggtacgtaggtacggtacgtacgacctactaacg

SEQ ID NO: 218953 - DNA, 331 bp, Homo sapiens
  misc_feature: GYAE6OF02IBJED.18.53.E09.1.454.CMB.1.raw
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (250)..(253): a, c, t, g, unknown or other
  misc_feature (250)..(253): n is a, c, g, or t
  modified_base (255)..(331): a, c, t, g, unknown or other
  misc_feature (255)..(331): n is a, c, g, or t
tcagtacgagtatgcacgaccggtgctcgatttagagagagtgtgttggggtttggggggaagaggaagactgacggtcctcccagggagttcaggtgctgggcaccggtgggcagtggggggaggtgtgtcacaagatttggggcctcgtggggcacaggccggccctggggcttgcccgtgggtcaaggacctacttcccaatactcgtactgagcgggctgggcaaaggtccgactaatagcngncnnnnannnnnnnnnnnnnnnnnnnnnnnnnnnnnnnnnnnnnnnnnnnnnnnnnnnnnnnnnnnnnnnnnnnnnnnnnnnnn

SEQ ID NO: 218954 - DNA, 639 bp, Homo sapiens
  misc_feature: GYAE6OF02FZ4XI.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctcctgtctgcatctgtaggagacagagtcacctatcacttgccggacaagtcagagacattagcagacttaatttaaagttggtatcaagtacgaagaaaacgaagggaaaccgtacccctaaaggtcctccgtagaacttactagtcgacctacgtacttccgtagtttacgacgtaaacgggtcggggtaccctaagtcgtaaggttccgaggtcggacgtagtcggtacgtacgtacgggactagtacgtttccaccttacctactaacctagtacgagtaccgtacgtctacgtacctaacgttaggtaagtttacgtttacgaacttaactttacttacgtacgtaactaacgtagttaacgttacgtaccggttacccgttacgtttaaccgtttcggacgtacgggtacacggtcgtaggacgtaactaacgaacgtcgttaggcgtcacgtacacgtcg

SEQ ID NO: 218955 - DNA, 843 bp, Homo sapiens
  misc_feature: GYAE6OF02IX1UI.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgacccagtctccattcctccctgtctgctatctaggtaggacgacagacgtcaacctatctacgttcggccgggactaagtcaggtagctagtagctaagtccttaattttaaagttcggtatacgaagtacgaaaggaaaaacgtaacggggaaaaccgtacccctaaagtcctaccgttagtacttacgtatacggtactacacttacgttacgttacggaacgttaaacggtcgggtaccctaagttacgtaaacggttcgtaaggtccggtagtaacgggttcggtacgttacggtaacgggtaaaccgacgtttaacgtttacgtaaccctccgtttaaccgaaaccccgtaacgttacccggaacgttaaccgtaccggttaacccgttcgaaacccgttaaacccggttaggtaaacggttttaaccttttacgaaacccgtttaaacctttaaacgtttcccgtttaaaccgtaaccggttaaaaccgtaacgggttaaaccgtttaacccgtttaaccggttacccccggtttaacgtttacccggttttacgggaaccccgggtacggggttaaacccgtacgttaaaccgggtaacggttaacggtaaaccgttaccggaaaacggttccggttaccggttacggtacccggttaacgtacccgtaacttaacccg

SEQ ID NO: 218956 - DNA, 769 bp, Homo sapiens
  misc_feature: GYAE6OF02FZP5H.18.53.E09.1.454.CMB.1.raw
  modified_base (321)..(321): a, c, t, g, unknown or other
  misc_feature (321)..(321): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctcgaggtgccagatgtgacatccagatgacccagtctccatccctcctgtctgacatctgtagagacagagtccaccatccacttcggaccgggacaagtacaggagctagttacgacagtacttaagttttaagtggttactacaagtacaaagaaaacgaagggaaacctacccgtaagcctacgtgtactntactgacctacgtacttaccgtagtttacgacgtaaacgggttccgggtacctaagtacgtaaagggttcctaagggtcggactaggtacggtacgttcggtacgggaactaacggttactttaccgaccttccgtaccaaccgtacgtaccgtacgtacgtagttacccgacgtaacccgttaaaccgttaaggtaacgtttacgtttttaaccgaaccgtttaaaacttttacccgtaacgttacgtaaccgtaaaaccgttaagggttaaacccgtttaccggtaaccgttttaacccccggtttcggtttttaaaccggttaccgggtaacccgggtacggggtaacctaaacggggttcggtaacggtaacgtaaccggttaaaaccgtaaacgggttaaccgttcggtaacccggttaccgtacgtacccgttacgtaaccg

SEQ ID NO: 218957 - DNA, 699 bp, Homo sapiens
  misc_feature: GYAE6OF02JD5KV.18.53.E09.1.454.CMB.1.raw
  modified_base (688)..(688): a, c, t, g, unknown or other
  misc_feature (688)..(688): n is a, c, g, or t
tcagtacgagtatgcacgaccggtgctcgatttagagagagtgtgttgggtttggggcagtctcagtcaggacacagcatggacatgagggtcccgctcagctcctgggctcctgctactctggctccggaggtgccagatgtgacatccagatgacccagtcctcatcctcctgtctgcatctgtaggagacagagtcaccagtccacttcggccgggcaaagtccagagctagttagcagcttaatttaaaagttggtattcaagcgaagaaaacgagggtaaacgttcccgtaaagccttacctaggacttacgtatcgtacctaactacttccctaaggttttacgcgtaaaaacgggttcgggggttaccctaaacgttccgtaaacgggtttacacgggttcggtacgacgggttaggtacgttcggttagggggaaccctagggtaacttttccactttacccgttaccaactactacgcgaccgtacggttacgtcgacctaaccgttaggttaacgttacgttttcgaaaccgtttaactttaacctacgttagttaccaaaccgtacgtaagttacctacgggtttaaccctacggttttacgtttacgggacccgtaacgggtacaacgggtcgtaaggacgtacgttaacgtaacgtacgttcggtacgacgtacnccgtacttacg

SEQ ID NO: 218958 - DNA, 758 bp, Homo sapiens
  misc_feature: GYAE6OF02IPBAP.18.53.E09.1.454.CMB.1.raw
  modified_base (99)..(99): a, c, t, g, unknown or other
  misc_feature (99)..(99): n is a, c, g, or t
  modified_base (233)..(233): a, c, t, g, unknown or other
  misc_feature (233)..(233): n is a, c, g, or t
tcagtacgagtatgcacgaccggtgctcgatttagagagagtgtgttggggtttggggcagtctcagtcaggacacagcatggacatgagggtccccgntcagctcctggggctcctgctactctggctccgaggtgccagatgtgacatccagatgacccagtctcatcctcctgtctgcatctgtaggagacagacgtccacctatctacgttggccgggacaagtcagancattagctagtacttaattttaaagttggtaatcgaagacaaaggaaaaacgacggggaaaaccgtaccccgtaagtccgtccgtagtacttactaatacgtacctaacctacttacccgtagtttcggacgtaaacgggtcggggtaccctaagtacgtaaggttcgacggtacggtacgtacgggttaggtacgttcgggtaaggggtaactaacggttacttttaccgtaaccttcccgttaacccaacccgtagttaccaacggttacctacgggttacctaccggtaccttaaaccgttaggtaaaacgtttactttttacggaacctttaaaccgtttaaccttacgttaacggttacctaaacgtaagtttaaccgtaaccgttaacccggttaacccgttaccggttttaaccggtttacgggaccggtaccgggtaaccgtaacggtaccggtacggaaacgtaccgtaacgtaaaccgttaacggtcggttccgaccggtacgaccgtacgtacg

SEQ ID NO: 218959 - DNA, 178 bp, Homo sapiens
  misc_feature: GYAE6OF02HVLW1.18.53.E09.1.454.CMB.1.raw
  modified_base (174)..(178): a, c, t, g, unknown or other
  misc_feature (174)..(178): n is a, c, g, or t
tcagtacgagtatgcacgaccggtgctcgatttagagagagtgtgttgggtttgggggaagaggaagactgacggtcctcccaggagttcaggtgctgggcacagcggccctgggctgcctggtcaaggactacttcccatactcgtactgagcgggctggcaaggcgcatagnnnnn

SEQ ID NO: 218960 - DNA, 692 bp, Homo sapiens
  misc_feature: GYAE6OF02ITSON.18.53.E09.1.454.CMB.1.raw
  modified_base (227)..(227): a, c, t, g, unknown or other
  misc_feature (227)..(227): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccaagatgacccagtctccatccctccctgtctgcatctggtaggagacagagtaccaccatcacgttggcccggganaagtcagagctattagcagtacttaatttaaagttggtatcagacaagaaaacgagggaaacaccctaagctctagactactatcgctaacacttacctagtttagaacgtaacggtccggtacctaagtacgtaagttcgaggtcgtacgtaggtagtacgtcggtacggtaacgtacgttactttacaccgttcctaaccgacctaacgtcgaacgtacgtacgttacgaccgaaccgttaagtaacgtaacgtttacgtttaacgaacccgtttaaactttaacctaacgttacgtaaacgaacgtaaagggttaaccctaacgttaacccggtttaccgtttacccgtttaaaggggttccgaaccgggtacgggaaccgtaacgggtacggtaacggtacgtaaacgtaaaccggtaaaacgttcggtacggttacggactaaccggaccgtacctacgg

SEQ ID NO: 218961 - DNA, 739 bp, Homo sapiens
  misc_feature: GYAE6OF02GBRP3.18.53.E09.1.454.CMB.1.raw
tcagtacgagtatgcacgaccggtgctcgatttagagagagtgtgttgggtttgggggcagtctcagtcaggacacagcatggacatgagggtccccgctcagctcctggggctcctgctactctggctccgaggtgccagatgtgacatccagatgacccagtctccatcctcctgtctgcatctggtaggagacagagtcacatcacttcggccggacaagtcagagctaattagcagtacttaattttaagttggtaatcagacgaagaaacgaacggggaaacacccctaagcctaccgtagtacttacctaagttcgaccttaactacgttaccgttaaggttttcgaaccggtaaaacgggttccggggttaacccaagttaaccgtaaaggggttcctaagggttcgggaaccgtagggttacgggtagttaccgggtacggggaacgtttacggtttactttcaacccgtttacctaccgtaacccctacgtacccggtaacgtaccgtaacggttctaaccggttaccctaacggttacgtaagtttacttttacgaaccttaactttaaccgtacgttacgtaaccaacgttaagtacggttaaccgtaaccggtttacccgttacgtttaccgtttccgggacggtacgggaaccgtacggtcggtaggtacgtacctaacggttaacgtaacggttacggtacggacttacggtaccctacgttaac

SEQ ID NO: 218962 - DNA, 712 bp, Homo sapiens
  misc_feature: GYAE6OF02GV8XL.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttcggccgggacaagtcaagagctattagcagtacttaattttaaattggtaatcagacaaagaaaaacgagggaaaaccgccccgtaagcctacctagacttctatcgacctaactactaccgtaggtttcgaacgtaaagggtccggggtacccagtacgtaaggttcaggtcggactaggttaggacgttacggtaggggtaactaaggtttaactttccaccgttacctaccgaaccattacgacggcttagttcctacgtaacccgtaaccgttaggtaaacgtttacgttttacgaacccgttaaaccttttaccgttaaccgttacggtaacctaaacgtaacggttaaaccgtttaacgtacccggtttaaccccggtttacgttttaaccccggtttgggaacccggtacggggtaacctacgggtaccggtaaggaacgtaaccgtaacgtaaacgtaacggttcggtccggaccgtacaccgtaccttaacg

SEQ ID NO: 218963 - DNA, 851 bp, Homo sapiens
  misc_feature: GYAE6OF02GRUHM.18.53.E09.1.454.CMB.1.raw
tcagtacgagtatgcacgaccggtgctcgatttagagagagtgtgtttgggtttggggcagtctcagtcaggacacagcatggacatgagggtccccgctcagctccgtggggctcctgctactctggctccgaggtgccagatgtgacatccagatcgacccagtctccattccctccctgtctgcatctggtaaggagacagacgtccacctatcctacttcgggaccgggacaagtcaaggagtacaagttacgacgtagtacgtttaaattttaaaagttaggtaacttcgaagacaaaaggaaaaaaccgaagggggtaaaaacccgtacccccgttaaaggtacccttacccgtacggtaaacttccgtttaacgtacgtaccttaaaccgtactttaccgttaaggttttacggaaccgttaaaacgggttccgggggtaacccctaagttaacggttaaacgggttccgtaaggtcgggtacgtaacgggtagggttaagttacccggtaggggtaacgaagtttaccttttaacgaccgttacccttacctaacccgtaacgtaccgacgtaccgtacgttaccggtacgtaacccgttaaaccggttagtaaacggtttacgtttaacgtaaccctttaaactttaaccgtacgttacgtaaccgtaaacgtaacggttaacgttaaccgttaaccgttttaaccccggttacggtttaaccgttttacgggacccgggttaagggaaccgtaagggtaccgttaagggaaacgttaaccgtaaaccgtaaacggtaacgttccgggtagggttaaccttacgggaaccctaccgttaacg

SEQ ID NO: 218964 - DNA, 711 bp, Homo sapiens
  misc_feature: GYAE6OF02FSVIM.18.53.E09.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
tcagtacgagtatgcacgaccggtgctcgatttagagagagtgtgttgggtttggggcagtctcagtcaggacacagacatggacatgagggtccccgctcagctcctggggctcctgctactctggctccgaggtgccagatgtgacatccagatgacccagtcctccatcctccctgtctgcatctgtagganacagagtcacatcacttggccgganagtcagagtcattagcagtactaatttaaattggtactcagacaagaaaacgacgggaacaccccgtaagcctaccgtagtactactacgtcgactaacgtacttacccgtagtttacgacgtaaagggttcgggtaccctagtacgttaacggtctagggtacggacgtaggtacggtagtacgtagggaactaaggtactttacaccgttactaccgtaaccacgtacacggtactaggttcctacggtaaccctaaaccggttaggtaacgttttaacgttttacgaacgtttaaaccttttacctaacggtttacgtaaccttaaacgtaagtttaaaccgttaaccgttaaccgggtttaacccggttacgttttaaccggtttaccgggaacccgtacgggggtacctaacggtacggtaaggaacgtaaccgttaaccgtaaacggttagtacggttacggacgtacgtaccgtaccgttaacg

SEQ ID NO: 218965 - DNA, 673 bp, Homo sapiens
  misc_feature: GYAE6OF02GTLTD.18.53.E09.1.454.CMB.1.raw
  modified_base (197)..(197): a, c, t, g, unknown or other
  misc_feature (197)..(197): n is a, c, g, or t
tcagtacgagtatgcacgaccggtgctcgatttagagagagtgtgttgggtttggggcagtctcagtcaggacacagcatggacatgagggtccccgctcagctccgtggggctcctgctactctggctccgaggtgccagatgtgacatccagatcgacccagtcctccactccctcctgtctgcatctgtagganacagacgtcaccatctacgttcggccggacaagtcgagagactattagctagtactttaaattttaaagttggtaactacgaggacaaacggaaaaaccgaacggggaaaaccgaccccttaaaggtccccttaccggtacgtattaccgtagttacgtaccttaactaccgttaccgttacggtttacggaacgttaaacgggtcgggtaaccctagtacgtaaggttcgaggtcgagtacggtaggtagttcggtacgggactacgttacctttacgacccttccgtacaaccgtatacgacgtactacgttcctaacggacctaaccggtaagtacgtttacgtttacgaaccttactttacgttactaacgtacaagtacgtaactaccgtacgttacccgttgttacgttcggacccgtagggctaggcgtaggaacacgtaacgaacgtatggaccgtagtcactactcg

SEQ ID NO: 218966 - DNA, 721 bp, Homo sapiens
  misc_feature: GYAE6OF02FHQCZ.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgctatctgtaggagacagacgtcaccatccacttgccgggacaagtcagagcattagcagtcttaatttaaattcggttaatcagtacaaaggaaaacgtaggggaaaccgaccccgtaaaggcctacctaggtacttaccgtaatcgtacctaaccaacttacccgtaaggtttttacgaccgtaaaacgggttccgggggtacccctagttaaccgtaaagggttcaacgggtcggacgtaggttaggacgttcggtagggtaacctagttacgtttacctaaccgtctaccactacgtacgacgtactaacggtctacgaacctaacccgttaggaaacgtttcgtttacggaacttaaccgtttaacctacgttacgtaaccgtaataacgttaacgttaaccgttaacccgtaacccggtttccgtttaacgttttaccgggaccggtacgggtaccaacgggttccgtagggaacgtaaccgtaacgtaaaccggtaacgttgggtaaccgtcgtaacggtcctaccgttaaccg

SEQ ID NO: 218967 - DNA, 896 bp, Homo sapiens
  misc_feature: GYAE6OF02HWI9T.18.53.E09.1.454.CMB.1.raw
tcagtacgagtatgcacgaccggtgctcgatttagagagagtgtgttgggtttgggcagtctcagtcaggacacagcatggacatgagggtccccgctcagctcctggggctcctgctactctggctccgaggtgccagatgtgacatcccagatgacccagttcctccatccctcccgtgtctgcatcgtagtacggagacagtacgtcaacctatctacgttcggccgggactaagtcaaggacgcaattagactagtactttaaattttaaagttacggttacttacgaacgtaacgaaacggtaaaaaccggaacgggtaaaaccgacccccgttaaacgccgtttaccgtagtaaccttaccgttaacgtacgtaccttaacgtacttacccgttaaggttttacggaaccgtaaacggggtttccggggtaaccctaacgttaccggttaaacgggtttcgtaacgggttacggaacgtacgggtacgggtaacgttacgggttacggggtataacggtttacgttttaacccgaccgttacctaaccgtaaccgttacgttacccgaaacgtacgtaaccgtttcgtaaccgtaccttaaaccggtaacgtttaaccggttacgttttaaccgtaaaccgtttaaccgttttaaacccttaacggtttaccgtaaaccgtaaacggttaaccgttaaacgtttaaaccgttacccgggtttaaccccggtttacgttttaacccgggttttacgggacccgggttaaacccgggtaaccgttaacgggtaaccggttacgggaacgttaaccggttaaaaccggtaacccgttaacgggttaccggtacggttaaccccggttccgttacccggtaaacttttacccgg

SEQ ID NO: 218968 - DNA, 225 bp, Homo sapiens
  misc_feature: GYAE6OF02GF95Q.18.53.E09.1.454.CMB.1.raw
  modified_base (219)..(225): a, c, t, g, unknown or other
  misc_feature (219)..(225): n is a, c, g, or t
tcagtacgagtatgcacgaccggtgctcgatttagagagagtgtgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnnnnnn

SEQ ID NO: 218969 - DNA, 561 bp, Homo sapiens
  misc_feature: GYAE6OF02FXSL7.18.53.E09.1.454.CMB.1.raw
  modified_base (391)..(391): a, c, t, g, unknown or other
  misc_feature (391)..(391): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagacaagaaaacagggaaacgaccccgtaagctacctgactctatgctacatcctagtttgactaaaggtcggggtacccaagtacgtaaggttcaggtgcgtagtggatcgtgggacagatttcactctcacatcancacgtctacgctaacctagtaagtatttagactaactttactacttcgtactaacgagtaacgttaacgtacgtaacccgttcgttacgtttacggaccgtagggtaccaaggtcgtaggaacgtactaacgaaacgtaacttcggtacgtcgtacgaccgtacgtaacg

SEQ ID NO: 218970 - DNA, 592 bp, Homo sapiens
  misc_feature: GYAE6OF02F6E25.18.53.E09.1.454.CMB.1.raw
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (383)..(383): a, c, t, g, unknown or other
  misc_feature (383)..(383): n is a, c, g, or t
  modified_base (466)..(466): a, c, t, g, unknown or other
  misc_feature (466)..(466): n is a, c, g, or t
  modified_base (571)..(571): a, c, t, g, unknown or other
  misc_feature (571)..(571): n is a, c, g, or t
  modified_base (579)..(579): a, c, t, g, unknown or other
  misc_feature (579)..(579): n is a, c, g, or t
tcagtacgagtatgcacgaccggtgctcgatttagagagagtgtgttggggtttggggcagtctcagtcaggacacagcatggacatgagggtccccgctcagctcctggggcctcctgctactctggcctccggaggtgccagatgtgacatccagatcgacccagttcctccactccctccctgtctgctatcgtggtaggagacagacgtccaccatccacgttcggccgggacaagtcacggagactaagttacgacagtactttaatttaaagttggtatacaagcaaagaaaacgaagggaaacctaccctaagctaccgagactctancgtactacnctctagttacgagtaaggtcggtacccatcgaagttcgngtgacaggtgatggacggactaagttacttccgccttactaccactatcgaagcgtagtcacactaacgagtaagttacttanactaactttacatctacaacgtagtacgttacgaaccgtttcctacgtttacgttgaccgtaggtacaacggtcgtacggaataccgaacgtaaagtcgtacggnggttaccncgtacgtacctcg

SEQ ID NO: 218971 - DNA, 611 bp, Homo sapiens
  misc_feature: GYAE6OF02GCDSS.18.53.E09.1.454.CMB.1.raw
  modified_base (461)..(461): a, c, t, g, unknown or other
  misc_feature (461)..(461): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccggcaagtcagagcattagcagtacttaatttaaagttggttatcgaagacaaaggaaaaacgaaggggaaaacctcccctaaaggtcctccgtagactactatacgctaacattccgtaagtttgaactaaggtcgggtaccagttacgaaggtcagtggacaggtgatcggtagggactagtatttaccacttcctaccactacacgtacgacgtacgtctacgtaccaaaccgttagtaacttntttacgaacgttaactttaccgtacttagtaccaagtagtacgttactacgttaccgttacgtttacgtttacgggacgtaccgggtaactaggtccgtaaggacgtaactaacgtaacgacgttcggtacgacgtcgtaccacgttacg

SEQ ID NO: 218972 - DNA, 676 bp, Homo sapiens
  misc_feature: GYAE6OF02I7NGP.18.53.E09.1.454.CMB.1.raw
  modified_base (224)..(224): a, c, t, g, unknown or other
  misc_feature (224)..(224): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgacccagtcctccatccctccctgtctgcatctggtaggagacagagtccaccatcacgttggccggnaacggtcaggacgctattacgcagtcttaatttaaagttgtactcgagacgaagaaaacgacgggaaacgaccccgtaagcctaccgtagacttactagtcgactacgacttccgtagtttacggacgtaaggttcgggtaccctagtacgtaaggttcgaggtcggacgtaggtaggtacgtacggtacgggtactaggttactttaccgaccgttacctaccaacctacgtacacgtctacgtccgtacgacctaacgttagtaacgttatttaccgacttaacgttactacgttacgtaccgtaacgtacgtaacgttaacgaccgtttaaccggttaccgtttacgtttaccggaccggtacggggtaacctacgggtccgtaagggtactaaccgtaaccggtaaacgtacggttacggtacggtaccgtcgtacccgacgttaccg

SEQ ID NO: 218973 - DNA, 712 bp, Homo sapiens
  misc_feature: GYAE6OF02HYI3N.18.53.E09.1.454.CMB.1.raw
  modified_base (198)..(198): a, c, t, g, unknown or other
  misc_feature (198)..(198): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgacccagtcctccactccctccctgtctgctatctgtagganacagagtcaccatcacttcggccggacaagtcagacgctaattacgcagtacttaatttaaagttggtatcgaagacaacggaaaacgagggaaaccaccccgttaagccttaccgtagtattaccgtagtacgtactaaccacttaccgtagtttacgaacgtaaaggttccggggtacctagtacgtaacgggttcaggtacggacgtaggtacgtagtcgtacgggaacgtagttacgtttaccacttccctacgaacctataccgaacgtacgtacgtcctacggtaacctaaccgttagtaagtttacgttactaaccctaaacgtttaccttaagttacgaccgtaaaggtaccgtaagttaacccgacggttttaccccggttagtttaaccgggtttcgaccgttaacggggtaccaacgggttcgtaacggtaaacgtacccgttaaacgtaaaaccggttacgtacgggttaccggtacccgtacgttacccgtacttaaccgg

SEQ ID NO: 218974 - DNA, 758 bp, Homo sapiens
  misc_feature: GYAE6OF02H94OI.18.53.E09.1.454.CMB.1.raw
tcagtacgagtatgcacgaccggtgctcgatttagagagagtgtgttgggtttggggcagtctcagtcaggacacagcatggacatgagggtccccgctcagctccgtgggctcctgctactctggctaccgaggtcgaccagtatgtcgacactccagactcgacccagtcctccactccctcccgtgtctgctacttcgtaggtaggagacgaacgtagtacccacctaacgtcctaccgttcggacccggggactaacgtccgaaggacgacttaagttacgaccgaagtacctttaagttttaaaagtttggtaactaccgaagtaacgaaacgaaaacggaaacgggtaaccaccccgttaactccgtaccttaaggtaccttactactccgtacttaccactaccgttagttagacgtaacggtcggtaccctagtacgtaaggtcgaggtcgtagtacggtgtactacggtcgggtaactacggttaccttttaccgacgttaccctaaccgtacctacgaccgtacgaccgtagtaccgtaccgaccgtaaccgttagtaacgtttcttaacgtacttaaacgttactacgtacgtaaccaacgtaacgtacttaacgttacccggttacccgttacggtttacgtttaaccgggaccgtaacgggtaccctaacgggtcttaagggtaaccgtaaccgttaaaccgaacgttacggtacgttacgggtacctacgaccgttacttaccg

SEQ ID NO: 218975 - DNA, 650 bp, Homo sapiens
  misc_feature: GYAE6OF02JGRWT.18.53.E09.1.454.CMB.1.raw
  modified_base (161)..(161): a, c, t, g, unknown or other
  misc_feature (161)..(161): n is a, c, g, or t
  modified_base (225)..(225): a, c, t, g, unknown or other
  misc_feature (225)..(225): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccngtctccatccctccctgtctgcatctggtaggagacagagtccaccatccacttcggcccgggnaacggtcagagctattagacagtacttaatttaaattggtatcagcaaagaaaacgagggaaacgcccctaagtcctcctagtattctaatgaccttactacttcctagtttacgaagtaaacgggttccggggtaccctaagttacgtaaacggttctaggtgtacggaggttaggacgttcggtacgggtactaggttactttccgtaccttctaccgtaacgtaatcgacgtacgtacgttaccgtcaccgttaacgttaggtaacgttacgttttacgacctttaacgttacttacgtcgtaacacgtaagtaccgttaacgtaccgtttacccgtacgtttacggtttcggaaccggtaggacccaggtacgaggtaacgtaacacgtaaacgtcgttcggtacggctacgtcctagtac

SEQ ID NO: 218976 - DNA, 550 bp, Homo sapiens
  misc_feature: GYAE6OF02FHYGO.18.53.E09.1.454.CMB.1.raw
  modified_base (371)..(371): a, c, t, g, unknown or other
  misc_feature (371)..(371): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgaccccagtctccatcctccctgtctgcatctgtaggagacagagtcaccatccacttgccgggcaagtcagagcattagcagctatttaaatggtatcagcagaaacaggaacgcccctaagctactgatctatgctacatccagtttgacaaaggtcggggtacccatcgtaaggttcaaggtggcaggtgatcgtgggacctagattcactcnctaccatcagcagtctgactaacctagagtatttcgactaacttactacgttacgtacaactagtaacgttaactacgttaacccgttaccgttacgtttttacgggacccgtaacgggaacccaaggtcgtacggagtactacgaaaccgtacgtcgttacggactcggactacctac

SEQ ID NO: 218977 - DNA, 759 bp, Homo sapiens
  misc_feature: GYAE6OF02JR37W.18.53.E09.1.454.CMB.1.raw
  modified_base (98)..(98): a, c, t, g, unknown or other
  misc_feature (98)..(98): n is a, c, g, or t
  modified_base (161)..(161): a, c, t, g, unknown or other
  misc_feature (161)..(161): n is a, c, g, or t
  modified_base (732)..(732): a, c, t, g, unknown or other
  misc_feature (732)..(732): n is a, c, g, or t
  modified_base (754)..(754): a, c, t, g, unknown or other
  misc_feature (754)..(754): n is a, c, g, or t
tcagtacgagtatgcacgaccggtgctcgatttagagagagtgtgttgggtttggggcagtctcagtcaggacacagcatggacatgagggtccccgntcagctccgtgggctcctgctactctggctcgaggtgccagatgtgacatccagatcgacccngtcctccatcccctcctgtactgacctattccgtaggtaaggacgacgagccgtcaacccgtatccgttacgtcgggccggtactaacgtcgaaggacgtacctaagttacgacgtacgttacgtttaaattttaaggttggttaacctacgtacgaacgtaaaacggtaaaacggtaaacgggtaaacccgtaccccgtaacgtaccgttccgtagtaaccgttacgttaacgtacgtaccctaagtacctccgttaaggttacgaacggtaacgggttccggtacctaagtacgttaacgttcgtacgggtacggtaggtaacgtcggtaccgtttacggacgggtactacgttactttaccgtactacccgtacgtacgtaacttcggactaacggtcgttacaacgaccttacggttaagttacttaactttaccgacttaactaccgttagtaacgaccctaaaggtacgttaacgttacccgtacgttaacccggttcgtaaacggttccgggtaaccggaggttacccgtaagtcggttacgaacgccttaaacgacgttacgnggttaccgccgaacgtaccgtntaccg

SEQ ID NO: 218978 - DNA, 869 bp, Homo sapiens
  misc_feature: GYAE6OF02HZHNP.18.53.E09.1.454.CMB.1.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtcctccatccctccctgtctgcctatctgtaggagacgagtanccacntcctacgtcggaccggtacagtccgaggatactagttacgacgtacgttaacttttaaagtttaagtttacggtaacttaccggaaacgtaaacgaaaaacggaaaaaaccggggtaaaaccgggtaaaacccccgtaaccccggttaaacgtccccgtttaaccggtagttaaccttaaccgtttacgtaccgttaaccctaaccttaaccgttaaccggtttaacggttaaccggtaaaccgggtaaacggggttcccggggtaaccttaacgttaaccggttaaggttcggtaagggtacgtacgggttaaggttacgggtacgttacggggtacggtaacgttacggttttactttaacccgtaccttaccctaacctaaccgtacgtaaccggtacgtacgttaacgtccgtaaccgtaaaccgttaacgttaacgtttaaacgtttcgttaacccttaaacctttaaccgttaccgttaagttacctaaacggtaaacgttaacggtttaacctttaacccggtacggttttaccccggtttaaacgtttttccgggtaccgggtaacccgggtagtaacccggtaggtacgggtagtaacgtaaaccgttaacggaaccgtaggttcgacgttaagcccgacgttactaccg

SEQ ID NO: 218979 - DNA, 665 bp, Homo sapiens
  misc_feature: GYAE6OF02IML6V.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtcctccactcctccctgtctgctatctggtaggagacagacgtaccacatcctacttcggcccggggacaagtcgaaggacacgtattagctaagtaccttaattttaaagttggttatactaggaacaaaggaaaaccgaagggaaaaccgtaccccgtaagacctcctagacttactatcgacttaacacgtaccgtagtttacgacgtaaacggtcgggtaccctagttacgtaaggttcgaggtcggacgtaggtagggtacgtacggtacgggaactagttaacttctaccgttcctacaccaatcgaacgcgtacgtcgtacgacctaacgttagtaacgttactttcgaactttaacttaactctacgtactaagacgttaacgtaccgtacgttaccgttacgttacctttcgggaccgtacgggtaacctacggcgttaggaacgtacgtaaacgtaacgttacggtacgtcggaccttacggactacgtaccg

SEQ ID NO: 218980 - DNA, 665 bp, Homo sapiens
  misc_feature: GYAE6OF02IKJVJ.18.53.E09.1.454.CMB.1.raw
  modified_base (352)..(352): a, c, t, g, unknown or other
  misc_feature (352)..(352): n is a, c, g, or t
  modified_base (404)..(404): a, c, t, g, unknown or other
  misc_feature (404)..(404): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
  modified_base (500)..(500): a, c, t, g, unknown or other
  misc_feature (500)..(500): n is a, c, g, or t
tcagtacgagtatgcacgaccggtgctcgatttagagagagtgtgttgggtttggggcagtctcagtcaggacacagcatggacatgagggtccccgctcagctccgtggggctcctgctactctggctccgaggtgccagatgtgacatccagatcgaccctagtcctccactccctcctgtctgctatcgtagtaggagacaggatctactactctacgttcgggaccggacaagtcgagtacggctaagtacgcgagtactttaagttttaaagtggtatacgagtaacgaaacgaaaaaccggtaacggaaccctaccccgtaagtccttaccgttagattacgtacncgtactacacttacgtagttcgacgtaaggtcggtacctagtacgtacggtnacgtacgcgtaggtagacgttagacgactagtacttcgacttctacactagcngtacngtacacgtactagtagttactcgttaatactaaccttntacgtacttaacgacgttaaacgtacttaaccgtaccgtttaccgtacgtttaccgggtaaccgtaaccgggtacggtaacgtacggttcggtaacggtaactaacggttaaaccggtaaaccggttcggtacgggttccgaaacgtcccgttactacccgttcg

SEQ ID NO: 218981 - DNA, 794 bp, Homo sapiens
  misc_feature: GYAE6OF02JBS0D.18.53.E09.1.454.CMB.1.raw
  modified_base (194)..(194): a, c, t, g, unknown or other
  misc_feature (194)..(194): n is a, c, g, or t
  modified_base (234)..(234): a, c, t, g, unknown or other
  misc_feature (234)..(234): n is a, c, g, or t
tcagtacgagtatgcacgaccggtgctcgatttagagagagtgtgttgggtttggggcagtctcagtcaggacacagcatggacatgagggtccccgctcagctcccgggctcctgctactctggctccgaggtgccagatgtgacatccagatcgacccagtcctccatcctccctgtctgcatctgtagganacagacgtcaaccatcaccgttggaccggcaagtcagacnctattacgcagtacttaattaattaggtatacgagtacgaaacggtaaaacgaacgggaaaccgcccccttaaggccttaccgtaggtaacttccgttaactaccggaactaccgaaattccctaagtttacggaaccgtaaaggtccgggttacccctaagttaccgtaaaggttccgtaggtacggactaggttaggtaacttaccgtaaacggggtactaacggttctttaaccgtaccttccgtacctacctacgtacgtaacgtacctacggtccttacggtaaccctaaccgttaagtaaccgttttaaccgttacgttaacccgttaaacgttttaaccctacgtaccggttaaacctaaacggttaaccgttaacgttaaccgttaaccggtttaccccggtttaaccgtttacggttttaaccccgggaaccgggtaaacccgggtacctaaccgggttacggtaacgggttaacggaaaccttaaccccggtaaaacgtaaccgttcgggttaacgtccggttaacgaccgttaccccgtagttacccgg

SEQ ID NO: 218982 - DNA, 700 bp, Homo sapiens
  misc_feature: GYAE6OF02GU123.18.53.E09.1.454.CMB.1.raw
  modified_base (291)..(291): a, c, t, g, unknown or other
  misc_feature (291)..(291): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatgacccagtctccatcctcctgtctgcatctgtaggagacagagtcaccatcacttgccgggcaagtcagagcattagcagtctaatttaaatggtatcagcaagaaaacgaggaaacgtccctaagctcctagactntaatcgactacactccgtagtttcgactaaaggtcggggtacccagttacgaaagggttcaggtcgcgtaggtaggacgtcgtaggggacctaacgttactttaccgtaccttccgtaccgaacctacgtacgacgtaccgtacggtcctacgcctaaaccggttagtaaacgttaacgtttttcgaacccttaaaccttttaacctaccgttacgtaacctaaaccgtaacgtaaccggtttaaccgttaaccggttaaaccccgttttcggtttaaaccgttttacggggacccgtaacgggggtaaccctaagggtccgttaggggaaacctaaggttaaaccccgtaaaaacggttacccgttagggtacccgggttaccctacgggtaccctacccgtaaccgg

SEQ ID NO: 218983 - DNA, 563 bp, Homo sapiens
  misc_feature: GYAE6OF02GJ1JI.18.53.E09.1.454.CMB.1.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatgacccagtcctccatccctcctgtctgcatctgtagganacagagtcaccatcacttcggccgganaagtcagagcaattagcagcttaatttaaagttggtatcagacaagaaaacagggaaacacccctaagcctcctagatctatgactacatacctagtttcgactaaaggtcggggtaccctagtacgtaagggttcaggtggacgtaggtggatcgtagggacagtactttacactacctacacatacgagcgtagtctagtacctaacgttgtaagttatttacgacttaacttactactcgtacaacgtatacgttactacgttaccttacgttactttcgaccgtagggacaggtcgtacgagtacacgaaagtacgtggtacgtcacggtaccactacg

SEQ ID NO: 218984 - DNA, 641 bp, Homo sapiens
  misc_feature: GYAE6OF02GWRPC.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggacaagtcagagcattagcagtacttaattttaaattggtattacagtcaaagaaaaacgaacgggaaaacgccccctaaaggcctcctagactcctaatgctacattcagttttcgacgaaaggtcggggtaccatacgtaaggttcaggtggctaggtcggtatcgtagggactagtactttcacttctactaccaatctacggactacgtctacgcctaaacgttcgttaaacgttagtttacgtaacctaaacctttactaaccgttacgttacctaaacgttacgtaaacgttacgtaaccgtttacccggttagtttaccgtttacggacccggtacgggaacccgtaaggtccggtacgggaactaacgtaaccgtaaacggtacgtaggttacgacgtacgtaccgtacttaaccg

SEQ ID NO: 218985 - DNA, 643 bp, Homo sapiens
  misc_feature: GYAE6OF02FITJK.18.53.E09.1.454.CMB.1.raw
  modified_base (239)..(239): a, c, t, g, unknown or other
  misc_feature (239)..(239): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggcctccgaggtgccagatgtgacatccagatgacccagtcctccatccctccctgtctgcatcgtgtaggacacagacgtcacctatccacttcggccgggactaaggtcagganctaattagcagtcttaattttaaagtgtatcgagacaagaaacgaggaacgcccctaagcctactgatctatgactacgacttaccgtagtttacgactaacggtcgggtaccagtacgtaaggttcaaggtcggacgtaggtagtactcggtagggactagttactttaccacttccacctacctactcgacgctaacgtctacgaccgtaaccgttagtaacgtttacgtttacgaacttaacctttacttaacgttacgtaactaacgttagtaacgttacgttaccgttacccgttacgttaccgtttccggacggtacgggaacctaggtacggtaggaacgtacgttaaccgaaaccggttacgttacgggtaccggtactacggtacctaccgtacg

SEQ ID NO: 218986 - DNA, 732 bp, Homo sapiens
  misc_feature: GYAE6OF02G6O82.18.53.E09.1.454.CMB.1.raw
  modified_base (98)..(98): a, c, t, g, unknown or other
  misc_feature (98)..(98): n is a, c, g, or t
  modified_base (196)..(196): a, c, t, g, unknown or other
  misc_feature (196)..(196): n is a, c, g, or t
tcagtacgagtatgcacgaccggtgctcgatttagagagagtgtgttgggtttggggcagtctcagtcaggacacagcatggacatgagggtccccgntcagctcctgggctcctgctactctggctccgaggtgccagatgtgacatccaaatgacccagtctccatcctccctgtctgcatctgtagagacagngtcacatcacgttgccgggcaagtcagtagctattagcagcttaatttaaattggtatcagactaagaaaacgaggaaacgacccctaagcctaccgtgatactagtacgcctacactcgtagtttagacgtaaaggtcgggtacccaagttcgtaaggtctggtaggcagtggatcgtaggactagtactttacacttcgtacacctagtacgtacgtacctaacgtcgtacgtacccgtaaaccgttagaacgttttacgttttaacgtaaccttaaaccgttttaaccgtaaccgtttacggtaaaccctaaaacggttacggttaacgttttaaaccgttaacccggggtttaaaccccgtttccgggtttttaaacccgtttacggggtaaccccggttaaacgggggtaacccctaaggggttaaccccggtaaggttaaccggtaacgtttaaaccgtaaaacccgggttaaccgttcggggttaacggtacccggtaccggttaacccgtaccggttactttacccgg

SEQ ID NO: 218987 - DNA, 913 bp, Homo sapiens
  misc_feature: GYAE6OF02IQWCJ.18.53.E09.1.454.CMB.1.raw
  modified_base (159)..(159): a, c, t, g, unknown or other
  misc_feature (159)..(159): n is a, c, g, or t
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
tcagtacgagtatgcacgaccggtgctcgatttagagagagtgtgttggggtttggggcagtctcagtcaggacacagcatggacatgacgggtcccgctcagctccgtggggctcctgctactcgtggctccgaggtcgccagatgtgacatccgagnttcgaccctagtcctaccactccctcccgtgtccgtgcctattcgtaggtaaggacgacaggtacgtaccacgtacnctacgtcggaccgganaacgtcagtacnctaagttacgnaacgtacttaatttaaacgtcgtancgaagtacaaacggaaacggaagggtaaaaccctccccgtaaagcccgtttacgtaacggaaccgttacgtaacgtacggttaccttaacgtaacccgttaccgttacgggttttaaccgaaaccgggttaaaccgggttccgggggtaccccttaaacggggtaaccgttaaacggggttcccggtaaaggtcgggtaccgttacggggtaccgggttagtaaccggggttaacgggggtaacccttaaacgggggtttaacctttccctaaaccgtttacccttaaacccggtaacgtaacgtacccggttaacggtaaccttaaccgggttccctaaaccggaccgttaaacccggttaagggttaaaccgtttaccggttttaaaccggaaaccttttaaacccgtaccgtttaaacgttaccggtaaacccggttaaacggttaccgttaaaccgggtttacggtacccccggttttaaaccgggtttcccggttttaaaccggttccgggaaccgggttaacccgggtacgtaacggtacggttaaccgggaattaacccgtaacgaaaccgttagtccgggttacacggtacaccgttacctacgg

SEQ ID NO: 218988 - DNA, 682 bp, Homo sapiens
  misc_feature: GYAE6OF02GSHS1.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatccctccctgtctgctatctggtaggagacagagtccacctatcacgttcggcccgggacaagtcagacgctagttagcagtacttaatttaagttggtatcagacgaagaaaacgaggaacaccctaagctctagattctagtgactacacttactagttacgacgtaaacgggtcggtacctacgtacgtaacgttcgaggtacggacgtaggttggtattcggtagggactagtacttccaccttctaccgaacctagtacgacgtacgacgttaccgtaccgtaaccgtaacgttagtaaacgtttacttttaacgaacctttaaaccgtttacctaacttacgtaaccctaaacgtacggttaaccgttaccgtaaaccggtttacccgtttacgtttaaccggtttaccgggaccgggtacgggtaacccaagggtccgtaagggtaacgtacgtaaacccgtaaacgttacggttcggtaccggtactaccggtaccgtaccttacg

SEQ ID NO: 218989 - DNA, 818 bp, Homo sapiens
  misc_feature: GYAE6OF02HZ8VY.18.53.E09.1.454.CMB.1.raw
tcagtacgagtatgcacgaccggtgctcgatttagagagagtgtgttgggtttggggcagtctcagtcaggacacagcatggacatggagggtccccgctcagctccgtggggctcctgctactctggctccggaggtcgccagtatgtagacactccagatcgacccagtctccatccctccctgtctgcctatcgtagtacggagacgagactcacctagtctacgttcggcccgggactaacggtcaaggactacgtagttacgcgtaaggttactttaaagtttaaagtttggtaataccgaagtaacgaaaacggaaaaaccggaaacggggtaaaaccctaccccgtaaacggttaccctaaccgttaggtaacttcctaacgtcggtaacctaacgtaccgtttacctaaggtttacggaacggtaaacgggttccggggtacccagttaccggtaacgtacggtacggtcggacggtacggttacggtacggtcgggtaacgggtacgtagtttacggttaccaaccgtttctaaccctaaccgtacggttaccaagggttaccctacggttacgtacggtaaacctaaccgtagttaaacgttttcgttaaacctaacttaacgttaacccttgtaacccgttaactaaacggttaacgttaaaccgttaacgtacccgtttaacccggttggtttaacccggttacgggaacccggttacggaaccgttacggtgggttaaccggacgttaaccgtaacgttaacgggtaacggttcgtaacggtccgttaccgaccggtacttaccg

SEQ ID NO: 218990 - DNA, 575 bp, Homo sapiens
  misc_feature: GYAE6OF02JHLG2.18.53.E09.1.454.CMB.1.raw
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatccattggccgggcaagtcagagctaatgcagctatttaaactggtatcagcaagaaaacgaggaaacnccctaanctacctgatctatcgactacactctagttgactaaggtcggacctatcgtaaggtcagtggactgtgtactcgtaggactgtacgttcaccgtcttaccactatcaggtactagtctacgactacccgtagtaagtttactttacggaacctaaccttactaacgtacgtacctaaagtcgtaacgttaacaccggttaccgttacgtttacgtttccgaaccggagggtaacctggtaactaggaacgtaacgtaccgaaacgttacgtggtaccgatccgtacctcttaaccg

SEQ ID NO: 218991 - DNA, 700 bp, Homo sapiens
  misc_feature: GYAE6OF02HYQR7.18.53.E09.1.454.CMB.1.raw
  modified_base (146)..(146): a, c, t, g, unknown or other
  misc_feature (146)..(146): n is a, c, g, or t
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (278)..(278): a, c, t, g, unknown or other
  misc_feature (278)..(278): n is a, c, g, or t
  modified_base (624)..(624): a, c, t, g, unknown or other
  misc_feature (624)..(624): n is a, c, g, or t
  modified_base (671)..(671): a, c, t, g, unknown or other
  misc_feature (671)..(671): n is a, c, g, or t
tcagtacgagtatgcacgaccggtgctcgatttagagagagtgtgttgggtttgggggtcgagtctcagtcaggacacagcatggacatgagggtccccgctcagctctggggctcctgctactctggctccgaggtgccagatgngacatccagatcgacccagtcttccactccctccctgtctgcatctggagganacanagtacaccatcacgtcggccggacaagtcagagactatacgacacgattaatttaaagtttagacttacaacganaaacggaaaaacgaaagggaaaccgtacccctaaagcctccaagtactacgtaactacgacttaacgactaccgttaagtttcggaaccgtaaagggttcgggtaccctagtaacgtaagggttcaagggttgacgagggtgtatcggtaggaacagtacttacacgttccactaaccagtaccagtaccgtagttaccacgttcaaacttacggtaattacgtttagtacctaaacgttacttaacggtacttaaccaactaaggttaccttaacggttaacctttaacccgggtacgttttaaaccggttaccgggaacgtaacccgggggtaacaaccgggtnttaaccgggaagtaaacccgtttaaccgaaacggtaccggttaaggnggtacccggtacgacccttacgtaaccgg

SEQ ID NO: 218992 - DNA, 672 bp, Homo sapiens
  misc_feature: GYAE6OF02G6985.18.53.E09.1.454.CMB.1.raw
  modified_base (143)..(143): a, c, t, g, unknown or other
  misc_feature (143)..(143): n is a, c, g, or t
  modified_base (198)..(198): a, c, t, g, unknown or other
  misc_feature (198)..(198): n is a, c, g, or t
tcagtacgagtatgcacgaccggtgctcgatttagagagagtgtgttgggtttgggcagtctcagtcaggacacagcatggacatggacgggtcccgctcagctccgtgggctctgctactctggctcgaggtgccagagtgngtacactccagagtcgaccagtcctccactcctccgtgtctgcatcgtgtagganacgagtagtcactatcacgttcggccgggcaagtcgagacgctaagttacgacgtagtacgttaagtttaaacgttggttactaacgtaagacgtaaacggaaaaacggtaacggggtaaaaccgtaccccgtaaaacggtaccttaccgttaacgtaacttaccgtacgtacgtacctaacgtacttaccgtagtttacgaacgtaacggtcggtaccctagtacgtaagtccgtaagtcgacgtaggtacggtatacggtcggaactagttacttactaaccgtctacgaactacgtcgacgacgacgtcgacgactaacgtagtaagttcgttacgtactaacgtactacgtatacgtaagtacgtacgtacgtacgttacgttacgttacgttacgacgtacggacgtacgtcggtaacggtacgtacgtaacgtaacgtcggtcgtacggtcgacgtaccgacgtaacg

SEQ ID NO: 218993 - DNA, 625 bp, Homo sapiens
  misc_feature: GYAE6OF02H06YL.18.53.E09.1.454.CMB.1.raw
  modified_base (284)..(284): a, c, t, g, unknown or other
  misc_feature (284)..(284): n is a, c, g, or t
  modified_base (298)..(298): a, c, t, g, unknown or other
  misc_feature (298)..(298): n is a, c, g, or t
  modified_base (601)..(601): a, c, t, g, unknown or other
  misc_feature (601)..(601): n is a, c, g, or t
  modified_base (612)..(612): a, c, t, g, unknown or other
  misc_feature (612)..(612): n is a, c, g, or t
tcagtacgagtatgcacgaccggtgctcgatttagagagagtgtgttgggtttgggcagtctcagtcaggacacagcatggacatgagggtccccgctcagctcctggggcctcctgctactctggctccgaggtgccagatgtgacatccagactgacccagtcctcatccctccctgtctgcatctgtaggagacagagtcaccatcacttggccggacaagtcagagctaattagcagacttaatttaaattggtatcgagacaagaaaacgagggaaacncccctaagcctacngactctatcgctacgacttctagtttcgacgtaaaggtccgggtaccagtacgtaacggttcgaggttaggcgtaacggttggtaactcggtacggggactaagtttaactttccgtaacttcccgtacctaaacctacgttaccgaacgtcgtaacggtacctacgaacctaaaccgttggtaaacttctttagaaccttaacttacgtacgttacgtaacaacgtacgtaacgttacgtaccgtttaccgtcgtttagtttcgactacgggaccaggtcgtaggactaagacgaaacgttntagggtacctntacgactactacg

SEQ ID NO: 218994 - DNA, 256 bp, Homo sapiens
  misc_feature: GYAE6OF02JHNRW.18.53.E09.1.454.CMB.1.raw
  modified_base (219)..(256): a, c, t, g, unknown or other
  misc_feature (219)..(256): n is a, c, g, or t
tcagtacgagtatgcacgaccggtgctcgatttagagagagtgtgttgggtttggggggaagaggaagactgacggtcctcccaggagttcaggtgctgggcaccgtgggcatggggggaggtgtgtcacaagatttgggctctgggcacagcggccctgggctgcctggtcaagactacttcccatactcgtactgagcgggctggcaaggcgcatannnnnnnnnnnnnnnnnnnnnnnnnnnnnnnnnnnnnn

SEQ ID NO: 218995 - DNA, 992 bp, Homo sapiens
  misc_feature: GYAE6OF02JAGB5.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccggaggtgccagatgtgacatccaagatcgacccagtcctccacttccctccctgtctcgcatctagtaaggagacgagacgtacaccatacctacgttcggaccgggacgaagtgaacgacgtactaagttacggacgtaagtactttaaagttttaaaagtttaggttaacgttacgaagaacgtaaaaggtaaaaaaccggaaacggggaaaaacccggtaaccccccgttaaaacggtaccctttaaccccgttaagtaaccgttaaccgttaacgtaacggtaaccgttaaccttaaccgttaacccttaaggttttaacggaaaccggttaaaaccgggttaacccggggttaaccccgtaaacgttaacccggtttaaaagggttacccggttaaagggttacggtaaccggttacggttaaacggggtaaccgttaccggggttaacggggtaaacggtaaacggtttaaccgttttaacccgtaacctttaccccgtactaaacccgttacgtaacccgtaacgaccgtaacggttacctaccggtaaaccctaaaacccgtttaagggtaaaacttttagtttttaaacccgaaccgtttaaaaccttttacccgttaacggtttaaaccgtaaaccgaaaccgtttaaacggtaaccgtttttaaaccgaaccccgggttttaaaccccggttacgttttttaaacccggtttacccggggaaacccgtaacgggggttaaacccacgggttaaccgttaaaggggtaacccgttaaacgtaaacccgtaaaaccgggttaacggtttcggttaaaccggcccgttaacggaaacccgttactttaacccgg

SEQ ID NO: 218996 - DNA, 878 bp, Homo sapiens
  misc_feature: GYAE6OF02F0S0Y.18.53.E09.1.454.CMB.1.raw
  modified_base (224)..(224): a, c, t, g, unknown or other
  misc_feature (224)..(224): n is a, c, g, or t
tcagtacgagtatgcacgaccggtgctcgatttagagagagtgtgttgggtttggggcagtctcagtcaggacacagcatggacatgacgggtccccgctcagctcctggggctcctgctactctggctcgaggtgccagatgtgacatccagatgacccagtctccatcctccctgtctgcatctgtaggagacagagtcaccatccacgttcggccgggtanaacgtcaaggagcctaattagactagacttaattttaaaagttgggttaacttacgaagtacgaaaagtaaaaaccggaaacggggaaaaccgtaccccccgtaaaaggtcccgttaccgtacggtaacttcgtaacttcgtacctaactaactcccttaggtttacgacgtaaagggttccggggtacccaagttaccgtaaagggttacgtaaggtcgggaaccgtagggttacggtaagttccgggtaggggtacctaacggttacgttttacctaaccgttacccgtacccgtaaccgacctaccgtaacggtccgttaacgtaccgttaccggtaaccctaaaccggtttacggaaaacgtttacgttttaaccggtaaacccttaaacccgttttaaccgttaacgttaaccgttaaaccgtaaacggttaaacggttaacccgttttaaacccggttaaacccgggtttaaacccccggttttccggtttaaaccggtttttcccgggaacccgggttaaccggggaacccttaaaccgggttaccgggttaacgggtaaaccgtaaccggttaaaacccggtaaaacgttaacggttccggggttacggacccggtttaaccggtacccgtaacgtttaaccccgg

SEQ ID NO: 218997 - DNA, 677 bp, Homo sapiens
  misc_feature: GYAE6OF02FSB4O.18.53.E09.1.454.CMB.1.raw
  modified_base (218)..(218): a, c, t, g, unknown or other
  misc_feature (218)..(218): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccggnaagtcagagcattacgcagcttatttaaatcggttatcagacaagaaaacagggaaacgccccgtaagcctcctgatctaatgctacataccagtttcgacgtaaaaggtcggggttacccagttacgtaaaggttccgtaaggtggacgtaggtcggggtaattacggttagggaccgtaagtacttttaccgaaccttcctaccaaaccgtaacgtaccgacggacgtaccggttactcgtacccgtaaaccgttaggtaaagttattttacgaacttaacctttaaccttaacttcgtaactaaacggtagttaacggttaacctaccgttaaccccggttacgtttaccggttttacgggaccggtacggggtaacccaagggttctaagggtaacgtaacgtaaccgtaaaccgtaacgtttacggaggtacccgtaggtaccgtaccgtaacg

SEQ ID NO: 218998 - DNA, 672 bp, Homo sapiens
  misc_feature: GYAE6OF02G9SG0.18.53.E09.1.454.CMB.1.raw
  modified_base (98)..(98): a, c, t, g, unknown or other
  misc_feature (98)..(98): n is a, c, g, or t
  modified_base (162)..(162): a, c, t, g, unknown or other
  misc_feature (162)..(162): n is a, c, g, or t
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (333)..(333): a, c, t, g, unknown or other
  misc_feature (333)..(333): n is a, c, g, or t
tcagtacgagtatgcacgaccggtgctcgatttagagagagtgtgttgggtttggggcagtctcagtcaggacacagcatggacatgagggtccccgntcagcctccgtgggctcctgctactctggctccggaggtgccagatgtgacatcagatcgaccngtctccatccctcctgtctgctatcgtggtaggagacngtacgtcacctatcacgttgccggganaagtnagtagctaattgcanacgttaatttaaagttggtaatcagacgaaacgaaacggacgggtaaaccaccccgtaagccgttccctagacttacgtacgtacncctaaactcgttacctagttcgaacgtaacgggttccgggaccctaagtacgtaacggttccgaagtcggacgtacggtcggtaagtcggttacgggaactgtttactttaccgcttacctaaccacctaacgttcgaactccggtagttactccgaaaccgtacggttaatacgtttattccgaaactacgtttaccgtagtactaccgtaagacctttaacggtcgttaacccgttccgtttaccgggttaactccggtaacgggaccgtacggtacgacgggacgtaagtaaaccgtacggaactacggttcaccgggacttccacggttaactcg

SEQ ID NO: 218999 - DNA, 794 bp, Homo sapiens
  misc_feature: GYAE6OF02IWCY8.18.53.E09.1.454.CMB.1.raw
  modified_base (170)..(170): a, c, t, g, unknown or other
  misc_feature (170)..(170): n is a, c, g, or t
  modified_base (183)..(183): a, c, t, g, unknown or other
  misc_feature (183)..(183): n is a, c, g, or t
tcagtacgagtatgcacgaccggtgctcgatttagagagagtgtgttgggtttgggctctgggcaccgtgggcatgtgtgagttgtgtcaccaagtggggtttgagctcaatctcttctgcttgctggctgtagctccaggtgctccactccaggtgccggtcgtggtancgagtcgtggggntcggaggtcgaagaacggtccgtcggggcctcgagtcgaagtccgtttccgagaccaaggtactaactcgtcggtaactacccgtaaccttacaacccgacgtaccttaaacttaagttaactaaccgtacgttcggttcgtaccggaaccgtacgaaccggggtcccccgttaagggaacgtaaacggggtctttaagggtacggtagggtaagtacgggttaattaaccgtaaccctaaccggttaggttacgggtacgttaacccgaactaaacggtccgtaacgcggtaaaccgtaaggtaaccggttacggacgggaccttaaggaaccttacccgaaacgtacgtccggaaacgtacgggtaccgtaaccgtaccggtaaccgaacgccgtaaacgtcggtactaacggtacgtaggacgtcgacgtacgacgtacgtcgtacgtaagtaccgttcgaacgggaacgtaccggaaccgggttaccgttaaggttacgttacgttacgtacggtagttacgggtaacggtaaggttaccggttagtaccgggtaggtacgttacccgttcgttacgtacggtcccggtacgggaccggttaaccgg

SEQ ID NO: 219000 - DNA, 727 bp, Homo sapiens
  misc_feature: GYAE6OF02JF6CC.18.53.E09.1.454.CMB.1.raw
  modified_base (98)..(98): a, c, t, g, unknown or other
  misc_feature (98)..(98): n is a, c, g, or t
  modified_base (124)..(124): a, c, t, g, unknown or other
  misc_feature (124)..(124): n is a, c, g, or t
  modified_base (134)..(134): a, c, t, g, unknown or other
  misc_feature (134)..(134): n is a, c, g, or t
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (687)..(687): a, c, t, g, unknown or other
  misc_feature (687)..(687): n is a, c, g, or t
tcagtacgagtatgcacgaccggtgctcgatttagagagagtgtgttggggtttggggcagtctcagtcaggacacagcatggacatgagggtcccgntcagctccgtgggctcctgctactcnggctcgagtnccagatgtgacatccagatcgacccagtctccatccctcctgctgcactctaggtagganacagtacgtcaacgntcaacttggccggacaagtcaagtgtacagttacacacggtacttaattttaagttacggtaatacgagaaccaaaggaaaaaagacggggtaaacctaccccgtaaagtcccgttaccgtacggtaacttaccgttaacgtcggtacccttaactaacgttcccgtttaaggtttacgaacggtaaaaccgggtttccggtacccttaagtaacggtttaacgtaccgggttaaggtacgtaaccggtagtacgggtatacggggttaaccggaacgttacgggtttaacttaccgtacctttacccgacctaccgtaacgttacgaggtacctagttccgtacgaacccgttaacgtaaggtaccgttttattaccggtaaccttaacggttacttaacgtcgtaaccacgtacgtaacgtactaaccgttccgtacgtttacgttaggacccgaggtactacgggtcacggttanaactaacgaacgtacgttgtaccgactagtccaaccgttg

SEQ ID NO: 219001 - DNA, 835 bp, Homo sapiens
  misc_feature: GYAE6OF02FV2YE.18.53.E09.1.454.CMB.1.raw
tcagtacgagtatgcacgaccggtgctcgatttagagagagtgtgttgggttggggcagtctcagtcaggacacagcatggacatgagggtcccgctcagctcctggggctcctgctactctggctccgaggtgaccagatgtagacatccagatcgaccctagtctccatccctccgtagtctcgccattcgtaggtaaggacgacagacgtacaccgtataccgtacgttcggccgggtactaacgtccgaaggtacactaagttaaggcaagaccttaatttttaaaacgtgggttaactccgtaagacgtaaaacggaaaaccgtaagggggaaacctacccccgttaaaggcccttacccgttaagggtaacctttaccgtaacgttaccggccttaaaactacccggttaccccgttaagggttttttaacggacccggtaaaaagggggtttccgggggtaaaccccctaagtttaacccggtaaaggggttttcccgaagggggttcgggtaaccctaagggttacggtacgtcccgggttaaggggtactaacgggtttacttaccgttactacccgtactaccgtaacgtacgtaacgtcgtacgttacgtacaccgtaaccgtagtacgttattcgtaacttaacttacgtacttacgtaccgtaaacgtggttaacgttccgaacgttacccgggttaacccgtttacggttaaccgggttttcccggacggtaaccggggtaacaccgggtaccggttaacgtaacgttaaacccggaacggttacgtcggtaccgggtactacgtacccggtattacccgg

SEQ ID NO: 219002 - DNA, 632 bp, Homo sapiens
  misc_feature: GYAE6OF02GMHIS.18.53.E09.1.454.CMB.1.raw
  modified_base (136)..(136): a, c, t, g, unknown or other
  misc_feature (136)..(136): n is a, c, g, or t
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (376)..(376): a, c, t, g, unknown or other
  misc_feature (376)..(376): n is a, c, g, or t
  modified_base (439)..(439): a, c, t, g, unknown or other
  misc_feature (439)..(439): n is a, c, g, or t
tcagtacgagtatgcacgaccggtgctcgatttagagagagtgtgttgggtttggggcagtctcagtcaggacacagcatggaaatgagggtccccgctcagctcctggggctcctgctactctggctccgaggtnccagatgtgacatccagatcgacccagtctccatccctcctgtctgctatcgtggtaggagacagngtccaccatcctacgttcggaccggacaagtcagganctagttancagtacttatttaagttgtatcagacaagtaaacggagggaacctacccgtaagtcctcgtgtactctatcgtactacgtacttactaggttagaacgtaagggtcggtacccagttacgaacggtttnaggtggtactaggtgacgttcggtaggactggttacttccacgtctaccactactcgtacgtntactacgtacgaccctagtagtaagttcttagtaacctaacttcttacgtacgtacaacgttacgtaacgttaccgtacggttacccgttagttacgtttcgggaccgtaagggtacctaggtaccggtaggaacgtaacgtaacggtaaccgtaggtcgtacggtaccgtacgtacctacgtaccgttacgg

SEQ ID NO: 219003 - DNA, 640 bp, Homo sapiens
  misc_feature: GYAE6OF02G5I56.18.53.E09.1.454.CMB.1.raw
  modified_base (231)..(231): a, c, t, g, unknown or other
  misc_feature (231)..(231): n is a, c, g, or t
tcagtacgagtatgcacgaccggtgctcgatttagagagagtgtgttggggtttgggggcagtctcagtcaggacacagcatggacatgagggtccccgctcagctccgtggggctcctgctactctggctccgaggtgccagatgtgacatccagatcgacccagtcctccatccctccctgtctgcatctggtaggagacagacgtccaccatcacgttcggccggganaagtcagagctaattagcagtacttaatttaaagttggtatacagacaaagaaaacgacgggaaacctacccgtaagccttaccgtagacttctaatcgactactacgttaccttaggttcgaacggtaaagggttccggggtaccctaagtacgtaaacgggttcgagggtacggacgtaggtaggtacgttacggtagggactagttacttcaactctacactatcagcagttcacgtacctacgtagttaacgttattacgaacttaacttacgtactagtactaagtacgtaacttaaccgtacgttacccgttagtttaccgtacgaccggacggtaaccgaggttcgaaggtactaacgtaaccggtaacgtgttacggtagtccgtaacgtacctacttccg

SEQ ID NO: 219004 - DNA, 626 bp, Homo sapiens
  misc_feature: GYAE6OF02GHP1C.18.53.E09.1.454.CMB.1.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
  modified_base (332)..(332): a, c, t, g, unknown or other
  misc_feature (332)..(332): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcaganctattagcagcttattaaattgtatnagtacaagaaaacagggtaaacacccctaagtcctcctagtatctatgactacatcagttnacaagtggtaccatcagtnagtgacagtgtatctaggactagtacttctacctacttaccgactacgtacagtacgtacgttaccttacggaccttaaaccgtaggtaaagttacgttttacgaaccgtttaaactttaaccttaacgttacgtaacgtaacgtaacgttaacgttaaccgtacgttaacccgtttacgttacgttttaccgggaccgtaacggggaaccgtaacggtccgtagggtaaacgacgttaaccgaaaaccggtacgttaacggtacggacgtttaccggacccttacgttaaccg

SEQ ID NO: 219005 - DNA, 669 bp, Homo sapiens
  misc_feature: GYAE6OF02F4R21.18.53.E09.1.454.CMB.1.raw
  modified_base (226)..(226): a, c, t, g, unknown or other
  misc_feature (226)..(226): n is a, c, g, or t
tcagtacgagtatgcacgaccggtgctcgatttagagagagtgtgttgggtttgggcagtctcagtcaggacacagcatggacatgagggtccccgctcagctcctggggctcctgctactctggctccgaggtgcctagatggtgacatccagatcgacccagtcctaccactccctccctgtctagcatcgtggtaggagacagagtcaccatcactgccgganaagtcagtagcattagctacgtacttaagtttaaattggtactcgagtacaaacgaaaacgacgggaaacgtcccctaaagtcctccgtagtacttctagtacgacgttacacttcctaaggtttgaccgtaaaggtccggtacccagtaccgaagttcgaggtgtacgaggtaggatccgtagggactacggtacttacgtacgtacctactacacgtacgacgtacgtacgttacgtcgaacctaacgttaggtaattcgtttacgaaccttaactttactacgttacgtaactaacgaagtacgttaacgtaaccgttacccggtttagtttaccgtttacgggacccggttacgggtaaccgacggtacgtacgggtaacgtaaccgttaaccgaaacggttcgtacggtacggtacctacggtaccctaacgttaccg

SEQ ID NO: 219006 - DNA, 663 bp, Homo sapiens
  misc_feature: GYAE6OF02I0HTP.18.53.E09.1.454.CMB.1.raw
  modified_base (157)..(157): a, c, t, g, unknown or other
  misc_feature (157)..(157): n is a, c, g, or t
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
tcagtacgagtatgcacgaccggtgctcgatttagagagagtgtgttgggtttggggcgagtcgtcagtcaggacacagcatggacattgagggtccccgctccgagctcctgggctcctgctactctggctccgaaggtgccagatgtgacatccngagcacccagtcctccagtcctcctgctgactagtctgagnacgagtgtccacatcacgttggcccggataacggtnacgaagcttaatacgcanacgttactttaaagtgtacacgagcaagaacgaaggtaaacncccgtaanctcctagtatntaacgntacactactaccgtaagtttggacgaaagtaaccggggcctactacgtaacggttcaaaggtttcggacgtaggtcgttactcggagggaacccttggttaacttaccggtactactacgtaacccgttactaacgtacgacgttaagtaccgactaccggtaacttaacggttaacgtattttacggaacttaacttaaccggtacttaccgtagacacgttaataccgttacgttaacgttaccggttactttaacggttacccgacgggtaacctacgggacgttaacggacgtaagaaccgttaaccgaagtacggtagttcacggtcctaccggtaacc

SEQ ID NO: 219007 - DNA, 724 bp, Homo sapiens
  misc_feature: GYAE6OF02FUNZN.18.53.E09.1.454.CMB.1.raw
  modified_base (192)..(192): a, c, t, g, unknown or other
  misc_feature (192)..(192): n is a, c, g, or t
  modified_base (469)..(469): a, c, t, g, unknown or other
  misc_feature (469)..(469): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctcctgtctgcatctgtagganacagagtccaccatcacttcgccggacaagtccagagctattagacagtacttaatttaaagttggtactcgtagaacaagaaaaacgaagggtaaaaccgaccccgtaaagcctccgtagtacttactactacgactaactacttacgtagtttacgacgtaacggttccggggtaccctaacgtacgtaaggttacgaggtacggtacgtaggtagtacgtacggtacgggactaaggttactttaccgtaccttaccttaccgaaccccttaanaccgttaagccgtacgttaactccgaacctaacggttacgaacgttttacgtttaagtaacccttaaactttaccgttaaccgttacgttaaccgtaaaccgtaacggtttaaccgttaaccttacccggtttaacccgttaacgttttaccggttttaccggaacccgggtaacgggtaaccctaggttaccgtaagggtaacgtaacttaaaccgaacgttaccgtggtacggacctgtaccgaaccttaccg

SEQ ID NO: 219008 - DNA, 851 bp, Homo sapiens
  misc_feature: GYAE6OF02G9RCK.18.53.E09.1.454.CMB.1.raw
  modified_base (169)..(169): a, c, t, g, unknown or other
  misc_feature (169)..(169): n is a, c, g, or t
tcagtacgagtatgcacgaccggtgctcgatttagagagagtgtgttgggtttggggcagtctcagtcaggacacagcatggacatgacgggtccccgctcagctccgtggggctcctgctactctggctccgaggtgccagatgtgacatccagatcgacccagtccnccactccctcctgtctcgctacgtctaggtacggacgacgaggtacgtaccaccactctacgttccgggaccggtactaacggtcaaggacgtactaagttacgaccgaagttactttaaagtttttaaaacgttggtaacttacaacggtaacgaaaaaggaaaaaccgggaaacggggaaaacccgtacccccgttaacgtaccgttacccgtagttaacttacctttagtacgtaccttaacgtaccgtttaccgttaagttttaccggaaaccggtttaaacgggttccgggttaacccttacgttaaccggttttaacgggttaccgttaggggtacggtacggttaacgggtacggtacgtacggggtaacgggtattaacgtttaccttacccgtcttacctacccgtaactacgtaccgacgttaccgacggttaccacggacccttaaggtaacgtttaacggttcttttaaaccggacctttaaacttaccgttaactaccgttaactacgtaacgttaacgttaaccgttacccgggtttaaccttacgggtttaccgtttacgggacccgggttaaccggacgttaaccgggtcggtaacgtaacggtaactaaccgggtaactttaaccgggtcggttacgtaacccggctacccggttaactacccgg

SEQ ID NO: 219009 - DNA, 756 bp, Homo sapiens
  misc_feature: GYAE6OF02FSY5F.18.53.E09.1.454.CMB.1.raw
  modified_base (98)..(98): a, c, t, g, unknown or other
  misc_feature (98)..(98): n is a, c, g, or t
tcagtacgagtatgcacgaccggtgctcgatttagagagagtgtgttgggtttggggcagtcgtcagtcaggacacagcatggacatgaggtccccgntcagctcccgggctcctgctactctggctccgaggtgccagatgtgacatccagatgacccagtcctccatcctccctgtctgactatcgtggtaaggactacgagtacgtctaaccatcctacgttcggaccggactaaggtcaagagctaagtttacgctacgtacctttaatttaaacgttggtaacttacgagtacaaaacggtaaaacgacgggaaaaccgtaccccgtaaagtccgttaccggttagaaccgttactaagtacgtaccgtaactacgttcctagttttccggaacgtaaaccggtttcgggacccctaaagttaccggtaacggtttacgaggttacggaacgtcggtaaggtacgttaacgaggtaaccgtagttaacttttccgacctttccctactaacccgtactacgtacggtactcgttacgtcgtaaccgtaaccgtagttaacggtatttaccgaacttaaccgttaccgttaacttacgttaacctaaggtaccgttacgttaacccggttaccgttaacccgtttacgttaaacggttttccggaacgtaccgggtaacgtacggtaccgtacggtaacgaaccttaacgaaccgttaaggtcccgtaggcctacgacgtacgtcgttaccg

SEQ ID NO: 219010 - DNA, 738 bp, Homo sapiens
  misc_feature: GYAE6OF02G7OHO.18.53.E09.1.454.CMB.1.raw
  modified_base (195)..(195): a, c, t, g, unknown or other
  misc_feature (195)..(195): n is a, c, g, or t
tcagtacgagtatgcacgaccggtgctcgatttagagagagtgtgttgggtttggggcagtctcagtcaggacacagcatggacatgagggtccccgctcagctcctgggctcctgctactctggctccgaggtgccagatgtgacatccagatcgacccagtcctccatcctccctgtctgcatctggtagganacagagtccacatcacgttgaccggacaacgtcagagacctagttacgcgagtacttaaattttaaacgttggtaactacgtagaacgaaaggaaaaccggaacggggaaaccgtacccccgtaaggtccttacccgtagtacttacgttactcggtacctaacctacttaccgttaggttttacgaaccggttaaacgggttccggggttacctaagttaccgtaaacgggtttccgaacggttggacgtacggttgggaacgttacggtacgggaacgtacgtttactttaccgaccttccctaccgtaccgtaagtcctaacgtcctacggtccttacggtaccctaaccggtttaagtaactttacggtttactaacccgttaaccgtttacgttaactcgtaaccgtaacgtagtaacctttaacggtacccgttaccgttccgtttaagttaccggaccggtacgggttacgacgttggtaacggtactaacgtaaccgtaacgtacgttcggtaaccgcgtacctaccgacttccg

SEQ ID NO: 219011 - DNA, 263 bp, Homo sapiens
  misc_feature: GYAE6OF02IP33A.18.53.E09.1.454.CMB.1.raw
  modified_base (227)..(263): a, c, t, g, unknown or other
  misc_feature (227)..(263): n is a, c, g, or t
tcagtacgagtatgcacgaccggtgctcgatttagagagagtgtgttggggtttgggggggaagaggaagactgacggtcctcccaggagttcaggtgctgggcaccgtgggcagtggggggaggtgtgtcacaagatttgggctcgtgggcacagccggccctgggctgcctggtcaaggactacttcccatactcgtactgagcgggctggcaaggcgcagtagnnnnnnnnnnnnnnnnnnnnnnnnnnnnnnnnnnnnn

SEQ ID NO: 219012 - DNA, 736 bp, Homo sapiens
  misc_feature: GYAE6OF02I9EJ9.18.53.E09.1.454.CMB.1.raw
  modified_base (217)..(217): a, c, t, g, unknown or other
  misc_feature (217)..(217): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcagcttaatttaaattggtatacagtacaagaaaacgagggaaacgaccccgtaaagcctacctagacttctaatcgacctactatcctagtttagacgtaaaaggttcggggtaccccaagttaccgtaaaggttccgaagggttcgggacgtagggttacggaagtttccggtaggggtaacgtaagttaacttttccgtaacttccgttacccgaaacctaacgttccgaagtccgtaacggttaccgttacggaaccctaaaccgttaacggtaaacgtttaacgtttttaacggaaccctttaaaaccttttaacctttaccgttacgttaaaccgtaaaccgtaggttaaaccgtttaacgttacccgtttaaaccccgggtttactttaaccgggttttaccgggtacccgaacgggggttaacctaacggtcggtaaggaacgtaacgtaaccgaaaccggtacgttacggtaggtcctacggtccaaccgttacg

SEQ ID NO: 219013 - DNA, 722 bp, Homo sapiens
  misc_feature: GYAE6OF02FJ7AP.18.53.E09.1.454.CMB.1.raw
  modified_base (199)..(199): a, c, t, g, unknown or other
  misc_feature (199)..(199): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgacccagtctccatccctccctgtctacgctatctgtacgganacagacgtacaccatccacgtcgaccgggacaacggtcaacggagtacctattacgcgtaagtctttaatttaaacgtggttactacgagtaccgaaaggtaaaaccggtacgggaaaaccgtacccctaagacccgttacctagaacttacgtaagtccggtaccctaacgtacgtaaccgttagggttttacgaaaccgtaaacgggttcggggtaccctaagtaccgtaagggttcgaaggtcggactaggtagaccgttgaacggtacctagtattccgtactcctacctaacgtactccgaacgtccttacgttacaccggtacttaaaggtacgttagttactttacgaccttaaactttacccgtagttaacgaccttaaacgaaggtttaccgttaacgttaccggttaacccggtttccgtttaaaggttaccgggaccgggtacgacgttacggacgtacggataaccggtaactaacgggtacgttcggaactcggttacacggtactacgg

SEQ ID NO: 219014 - DNA, 704 bp, Homo sapiens
  misc_feature: GYAE6OF02GK4J3.18.53.E09.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccggaggtgccagatgtgacatccagatgacccagtcctccatccctcctgtctgcatctagtagganacagacgtcaccaatctacttggccggganaagtcagagctattagcagtcgttaatttaaagttgtatcgagactaagaaaacgagggaaacgcccctaagcctcctagactactacgtacgtcctacgtactaccgtagtttacgaactaaacgggtcgggtacctaagtacgtaacggttacgacgtggctaggtagacttcgtcgggaactacggtactttacgacttcctacctaccgactcgtaacgtccgtacgttacgtaccggaccttaaccggttacgtaacgtttacgtttaccgtaaccgttaactttaccgttaacgttaccgtacctaaccgtaaagttaacggttaaccgttaccgtttaacccggtaccggtttaaccgttttacgggacccggttacggggtaccgtaaggtaccggtaacggtaaccgtaacgtaaacccgtaacgggtaacgttacgggtacggtaccgtacgtcccgtaacgtaccgg

SEQ ID NO: 219015 - DNA, 267 bp, Homo sapiens
  misc_feature: GYAE6OF02GA0E2.18.53.E09.1.454.CMB.1.raw
  modified_base (216)..(216): a, c, t, g, unknown or other
  misc_feature (216)..(216): n is a, c, g, or t
  modified_base (222)..(226): a, c, t, g, unknown or other
  misc_feature (222)..(226): n is a, c, g, or t
  modified_base (228)..(267): a, c, t, g, unknown or other
  misc_feature (228)..(267): n is a, c, g, or t
tcagtacgagtatgcacgaccggtgctcgatttagagagagtgtgttgggtttgggggaagaggaagactgacggtcctcccaggagttcaggtgctgggcaccgtgggcagtgggggaggtgtgtcacaagatttgggctctgggcacagccggccctggggctgcctggtcaaaggctacttccaatactcgactgacgcgggctggcaaggcncatagnnnnncnnnnnnnnnnnnnnnnnnnnnnnnnnnnnnnnnnnnnnnn

SEQ ID NO: 219016 - DNA, 701 bp, Homo sapiens
  misc_feature: GYAE6OF02HGJKX.18.53.E09.1.454.CMB.1.raw
  modified_base (201)..(201): a, c, t, g, unknown or other
  misc_feature (201)..(201): n is a, c, g, or t
tcagtacgagtatgcacgaccggtgctcgatttagagagagtgtgttgggtttggggcagtctcagtcaggacacagcatggacatgagggtccccgctcagctccgtggggctcctgctactctggctccggaggtgccagatgtgacatccaagatcgacccagtcctccactccctccctgtctgcatctagtagganacagagtccacactcacgttggaccgggactaacgtcaggagtcaattacgcaagtacttaaagttttaaattggtaatacagaaccaaaggaaaaacgaacgggtaaaccgaccccgtaaagtcccttcctagtacttctatcgtacctaactacttccgtaaggttcgaacgtaaagggttccgggtaaccctaagtaccggtaagtcgtagacggtactaaggtggtaattcggtagggactaacggtttacttccgtacttacctaccgtaacctacgtaccgtaagtcgtaacgtcgttacgaactaaccgtaagttaacgttcgtttacgtaaccttaactttaccgtaagttactaacgtaagtacgtaaccgtttaacgtaccgttacccgttacgttaccgtttacgggaaccgtacggggacctaggtcgtaggtaacgtaacgtaaccgtaaacgtacggtacggtagtaccgtacgtacctacgtacg

SEQ ID NO: 219017 - DNA, 280 bp, Homo sapiens
  misc_feature: GYAE6OF02GCKGO.18.53.E09.1.454.CMB.1.raw
  modified_base (225)..(225): a, c, t, g, unknown or other
  misc_feature (225)..(225): n is a, c, g, or t
  modified_base (234)..(238): a, c, t, g, unknown or other
  misc_feature (234)..(238): n is a, c, g, or t
  modified_base (240)..(280): a, c, t, g, unknown or other
  misc_feature (240)..(280): n is a, c, g, or t
tcagtacgagtatgcacgaccggtgctcgatttagagagagtgtgtttggggtttggggggaagaggaagactgacggtccctcccaggagttcaggtgactgggcaccggtgggcatggggggagtgtgtctacaagtatttgggcctctagggcacagcggccctggggacctgcctggtcaaggactactcccatacctcgtatgagcgggctggcaaggcncaagtacgnnnnntnnnnnnnnnnnnnnnnnnnnnnnnnnnnnnnnnnnnnnnnn

SEQ ID NO: 219018 - DNA, 906 bp, Homo sapiens
  misc_feature: GYAE6OF02HRCJY.18.53.E09.1.454.CMB.1.raw
  modified_base (97)..(97): a, c, t, g, unknown or other
  misc_feature (97)..(97): n is a, c, g, or t
tcagtacgagtatgcacgaccggtgctcgatttagagagagtgtgttgggtttggggcagtctcagtcaggacacagcatggacatgagggtccccntcagctccgtggggcctcctgctactctggctccgaggtgccagatgtgacatccagatgaccctagtctccacttcctccctgtctgcatctaggtaggacgacagacgtaccacctatccgtaacgttcgggacccggggtaacaaacggttcgaacggtaacggtacctaacgtttacggaccgtaacggttacctttaaaaagtttttaaaacgttagggttaacttaccgtaaacggtaaccgaaaacgggtaaaaaaccggaaacgggtaaaacccggtaaccccccttaaacgggacccttacccggtaaggacctttacgttaacgtcggtaaccttaaccgaaccttaccgttacggttttaaggtaaccggtaaaagggttaccggggtacctaacgttaccggttaacgttacgggacgttacgggtacgtaagggtacggtacgtaccggtacgggtaactaacggtttactttaccaaccgttacccgtacctaaccgtaacgtccgtaagtacgtaacgttccgtaaccggtaaccctaacggttaaggttaacctttaagttttacccgaaaccttaaccgtttaaccgttaccgttaaacgttaccgtaaaccgtacggttaaacgttaccgttaacccggtttaaccccggttttacggttaacgggttttaccggaaccgggttaaccggggaaccgttaaccgggcggtttaaacgggacttaaaccggtaaaccggtaaaccggttacgtaggtttaccgacggttaacccgtactacccgtttaacgg

SEQ ID NO: 219019 - DNA, 788 bp, Homo sapiens
  misc_feature: GYAE6OF02GLK35.18.53.E09.1.454.CMB.1.raw
tcagtacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatcgacccagtctccactccctccctgtctgacattctggtaggagacgagtacgtaccacctatcgtacgttcggccgggataagtcgagacgactacgttagactacgtactttaagttttaaagttcggttactcgagaacgaaacgtaaaacggacgggaaacccgtacccgtaagtccttaccgtagtaacttctagtccgtacttacgtactccgttagttacggaacgtaaacgggtcggtaccctaagtaccgtaacgtcgtaggtacggcgtaggtaggtaccgtaggtcgggtaattacgttacgtttaccaacgtttcccaacggaacccttagtacccgagtaacgtacccggtttaccaaccgttaaccgtaaaccggttagtttaacgttttaccggttttacgaaaccttttactttaccccgttaaggttacctaaaccgtaagttaaacgggttaacccgttaaccggtttaaaccggtttccccgtttaagggtttttaaacccggtcgggtaaccccgggtttaaacgggacccggttacggtaacggtacggttaaacggtacaaacccggttaacggttagtccggttagacctccggtaaccgtactttccgg

SEQ ID NO: 219020 - DNA, 767 bp, Homo sapiens
  misc_feature: GYAE6OF02JWD5J.18.53.E09.1.454.CMB.1.raw
  modified_base (147)..(147): a, c, t, g, unknown or other
  misc_feature (147)..(147): n is a, c, g, or t
  modified_base (552)..(552): a, c, t, g, unknown or other
  misc_feature (552)..(552): n is a, c, g, or t
tcagtacgagtatgcacgaccggtgctcgatttagagagagtgtgttgggtttggggcagtctcagtcaggacacagcatggacatgagggtccccgctcagctcctgggctcctgcctactctggctccggaggtgccagatggtnacatccagatcgaccagtctccatcctccctgtctgctattcgtaggtacggacgacgacgtacgtccaccgatccgaacgttcggaccgggcaacgtccgaagacgtactagttacggactaacgtacgtttaaagtttaaacggttcggtaactaacgtacggaaacaaaaacgggtaaaaaccgtaacgggggtaaaaccccttaccccgttaaacgggtcccttaaccgttaggtaacttaccggttaagtccgaacttaaccgtacgttacccggtttaaggtcgtaaccgggaaacgggttttcccggaaccttagtacttaacgggtacctaggtaccgagttacgtagtacgtcggtaacgtaaactcgttacttcacctccgtaactactcgtacncgtacgtagtccgtacacgttaaccggtagttaacttacgttacgtaacttaccctaaggttaacttacgaacctaacggtacgttaacggttaaccgtccgtttaacccgggttacgtttacggttacggtaccgaagggttaccctaaggtccggtaaatcggtaacctaacgggtaacttcggtacgtcgttacggacttacctaaccgtcg

SEQ ID NO: 219021 - DNA, 750 bp, Homo sapiens
  misc_feature: GYAE6OF02JUDEX.18.53.E09.1.454.CMB.1.raw
  modified_base (247)..(247): a, c, t, g, unknown or other
  misc_feature (247)..(247): n is a, c, g, or t
  modified_base (412)..(412): a, c, t, g, unknown or other
  misc_feature (412)..(412): n is a, c, g, or t
tcagtacgagtatgcacgaccggtgctcgatttagagagagtgtgttggggtttgggggtcgagtctcagtcaggacacagcatggacatgagggtccccgctcagctcctggggctcctgctactctggctccgaggtgccagatgtgacatccagatacgacccagtctaccatccctccctgtctgacatctggtaggagacagatccaccatcctacgttcggccgggtacaaggtcaggacnctattacgctagtacttaatttaagttggtactacgtaagaccaaaaggaaaaccggtaacggggaaaccgtacccccgttaaagcccttacgtaccgtatacttagctactaccattcctaggtttacgaccgtaaagggtcggtacccagttacgtagtacgngtagcgtagtagtactcggtaggaccgagtttcttacgtacctctaccgaacctcgtacaacggtactaacgtcgttaccgaacctaaccggttagtaaacggtttacgttacggtaacccttaccgtttaaaccgtacgttaaccgacgttaaacgtacggtaacgttaccgttaaaccggttacccggtttaacgtttaacccgttttacggggaaccccggtaacgggttaccgtaaaccgggttccggaacggttaacggtaacccgtaacccggtaaaccgttaacggtttcggggaacccgtttagtaacccggacccttaagtttaacccg

SEQ ID NO: 219022 - DNA, 733 bp, Homo sapiens
  misc_feature: GYAE6OF02FZ8X1.18.53.E09.1.454.CMB.1.raw
tcagtacgagtatgcacgaccggtgctcgatttagagagagtgtgttgggtttggggcagtctcagtcaggacacagcatggacatgagggtccccgctcagctccgtggggctcctgctactctggctcgaggtcgccagatgtagacatccagactgaccctagtcctccactccctccctgtctagctatcgtggtaaggacgtacgagtacgtccaccgtactcgtaccgttcggaccgggtacaacggtcgagtagtactagttacgacgaacgtactttaagtttaaagttggttaactcgaacgaactaaacggaaaacggacgggtaaacctaccccggtaagtccgttccgaggtactaccgttagtacgtacctacctacgttaccgttacggtttacgaaaccggttaaacgggtccgggttaccccgtaattacccgggttaagttccggtaaggttacgggtaccgtagggttacgtacggttacggtaacggtaacgtacgttacgtttaccgtacctacgtacccaagaccttcgtagcctacgtcctacgtacgtaacgttacgtagttcgttacgtactacgtttaacctactacgtaaccttagaacgttactaaccgtacgtttaccttaccgttacgttacgaccggtagaacgtacggtgtacggacgttacgacgtaacgtcgacggttacgtcgtacgtactccgtaacg

SEQ ID NO: 219023 - DNA, 782 bp, Homo sapiens
  misc_feature: GYAE6OF02FTK9Z.18.53.E09.1.454.CMB.1.raw
  modified_base (198)..(198): a, c, t, g, unknown or other
  misc_feature (198)..(198): n is a, c, g, or t
tcagtacgagtatgcacgaccggtgctcgatttagagagagtgtgttgggtttggggcagtctcagtcaggacacagcatggacatgagggtccccgctcagctcctggggctcctgctactctggctccggaggtgccagatgtgacatccagatcgacccagttctccacttccctcctgtctgcatctgtagganacagactacaccatcgtacgttcggccgggataacgtcgagacgctaatacgacagtactttaaatttaaacgttggttaactacgaacgtaacgaaaaacggaaaaaccggaacggggtaaaacccgtaacccccggttaaacggtcccgttaaccgtacgtaaccgtttaccgtaagttacggacccttaactacgtttacccgttaaggtttaaccggaaccggttaaaacggggttccgggtaccctaggtaaccggtttaaggttccgtagggtacggtaacgtaggtacggtacgtacggtaggggtactaggtttaacttcccgtacttcgaccctaactcgtacgacgtacctacgtcctagccgtacgttaacgtagttaaacgtttacgtttaaccaacctttaacgtttaactttggtacccgttaccggacgttccgacgggtaacctcgttaaaacgttttaccctccgttaacgttaccggttcccggttaggggaaccggtaaccggtaacgggtacggtaaccgagttaacgaccggtaaccgtaacggtcggtaccgacggtacccg

SEQ ID NO: 219024 - DNA, 707 bp, Homo sapiens
  misc_feature: GYAE6OF02IM61A.18.53.E09.1.454.CMB.1.raw
tcagtacgagtatgcacgaccggtgctcgatttagagagagtgtgttggggtttggggcagtctcagtcaggacacagcatggacatgagggtccccgctcagctcctggggctcctgctactctggctccggaggtgccagatgtgacatccagatcgaccctagtcctccactccctcctgtctgctatctaggtaggacgacagacgtccacctatccacgttcggcccgggtactaacgtcaagacgactaagttacgactagtactttaaagttttaaagttggtactcgaacgacgaaacgaaaaacggaacggaaacctaccccgtaagccctactacgtacttacgtactacgactactacttacgtacgttacgacggtaaggtccggtacctagtacgtaacggtacgtacggtaggacgtaggtcggtacgtacggtaggacgtagttacgttaccacgttaccacgtacctactacgtactcgtaacgtccgtacgtaacctaacgttaagtaacgtttacgtttaacgtaccttaaacctttacgtacgtacgttaacgtactaaaggttaccttaacgtacccgtttaccggttaccgttaccgttcgggaccggtaacgggtactaggtcggttaagacgtaacgaaccgttaaagtacggtacggtccgaccggttacaccgtaccttacg

SEQ ID NO: 219025 - DNA, 742 bp, Homo sapiens
  misc_feature: GYAE6OF02JMUHQ.18.53.E09.1.454.CMB.1.raw
  modified_base (700)..(700): a, c, t, g, unknown or other
  misc_feature (700)..(700): n is a, c, g, or t
  modified_base (732)..(732): a, c, t, g, unknown or other
  misc_feature (732)..(732): n is a, c, g, or t
tcagtacgagtatgcacgaccggtgctcgatttagagagagtgtgttgggtttggggcagtctcagtcaggacacagcatggacatgagggtccccgctcagctccgtgggctcctgctactctggctcgaggtgccagatgtgacatccagatcgacccagtcctccatccctcctgtctgctatctagtaggacgacgagtacgtacacctactacctaccgttcggaccggggactaaacgtcgaagacgactaacgttaacgactaacgttaacctttaaagttttaaaacggtttcgggtaactaccgtaaggaaaccgtaaaaagggaaaacggtaaaccgggtaaacccgtaacccccgttaaacggtcccgttacccgtaacggtacttaacgttactacgtaaccttaacctaaccgttaccgttacgttttacgaaccggttaaacgggttccgggtaacccgtattaacggtaacggttacgtacggtagacgttacggacgtagtcgtaaggactaagtcttaccgactcctaacgacctatcgagtactcgtagtaccgaactaacgttagtacttacgttctaaaccgttactttaagaccttagaacttaacgtaagtaactttacccgtagtttacccgtacgtttacggtaccgtaccggacggttacaggtcgtaggtaaancccgttaaacgaacgtcggtgaccgttaccgntaccgattcg

SEQ ID NO: 219026 - DNA, 899 bp, Homo sapiens
  misc_feature: GYAE6OF02GYY96.18.53.E09.1.454.CMB.1.raw
tcagtacgagtatgcacgaccggtgctcgatttagagagagtgtgttgggtttggggcagtctcagtcaggacacagcatggacatgagggtccccgctcagctccgtggggcctcctgctactctggctcgaggtgccagatgtgacatccagatgacccagtcctccatccctccctgtctgcatctggtaggagacagacgtaccaccatcgacgttcggccgggacaacgtcagagctaagttacgactaggtacttaaattttaaaagttggttaactcaagtacaaacgaaaaacggtaaggggaaaaccgtaaccccctaaaggtcccttaccgtagtaacttacgtaacgtaccgtactacgaaccttacccgtaaggttttaaccggtaaccggtaaaaacggggtttcccggggggttaacccttaacgtaaccggtttaaacgggtttacggtaacgggtttacgggacgttaagggtttacggggtaaccttaccggggtaacggggtaaacggtaacggtttaacgttttacccgtaaccctttacccgtaacccctaaccgtaaaccgttacccgaaaggtacccgtaacgggtttaccgttaaccccggtaaacccgttaaacccggtttaaacggtaaaacgttttaacgtttttaaccggtaaaccgttaaaaccctttttaaccgttaacccgttaccgttaaaacgttaacccgtaaagtttaaaccgggtttaaccgtaacccgggtttaacccggttacgtttaaccggttttaccgggaaccggtacggggtaaccctagggtaaccggtacggtaacgtaaccgttaaacgaaacgtaacggttcgtacggtaccgtacgtaccctaccgttaacg

SEQ ID NO: 219027 - DNA, 769 bp, Homo sapiens
  misc_feature: GYAE6OF02H46I6.18.53.E09.1.454.CMB.1.raw
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (300)..(300): a, c, t, g, unknown or other
  misc_feature (300)..(300): n is a, c, g, or t
  modified_base (631)..(631): a, c, t, g, unknown or other
  misc_feature (631)..(631): n is a, c, g, or t
tcagtacgagtatgcacgaccggtgctcgatttagagagagtgtgttgggtttggggcagtctcagtcaggacacagcatggacatgagggtccccgctcagctccgtggggtcctcctgctactctggcctaccggagtgccagatgtgacactaccagactcgaacccagtcctccatccctccctgtcngcatcgtggtagganacgagtactcacctatctacgttgggccgganaacggtcaggacgtacctaagttacgactagtactttaaattttaaacgttagggttaacncgaacgtacgaaaacgaaaacggtaaacggaaaaccgtaccccccgtaaaggtaccgttacctaggtaacttacggtactaccgttaacctaacgtacccttaccttaggttaccgtaaacggtaaacggggttccggtacccgtaagttaacccgtaacggtttacgtaacggtttacggacgttaagggtacggtactaacgggtaccgggttaatacgttaactttacgacccttaactaccgtacctacttaccgagaccgtattcgaacgtaactaacggttcgttaaaggttactttccggtaaacttaaccttaccgaacttanaaaccctaagtaacgtaacgttaaccgtacgtttaacccgtacgttttaccggtcgaacggtaaccggtacctaagtacggtaggtaactaaaccgtaataaaccggttgtaccgggtatcggtacacgtaccgtacg

SEQ ID NO: 219028 - DNA, 286 bp, Homo sapiens
  misc_feature: GYAE6OF02HUVCO.18.53.E09.1.454.CMB.1.raw
  modified_base (134)..(134): a, c, t, g, unknown or other
  misc_feature (134)..(134): n is a, c, g, or t
  modified_base (230)..(286): a, c, t, g, unknown or other
  misc_feature (230)..(286): n is a, c, g, or t
tcagtacgagtatgcacgaccggtgctcgatttagagagagtgtgttgggtttggggggaagaggaagactgacggtcctcccaggagttcaggtgctgggcaccgtgggcagtgggggaggtgtgtcacaagntttgggctcgtgggcacgaggccggccctggggcctgcctggtcaaaggactactcccatctacgtactgacgcgggctggacaggcgcagtagcnnnnnnnnnnnnnnnnnnnnnnnnnnnnnnnnnnnnnnnnnnnnnnnnnnnnnnnnn

SEQ ID NO: 219029 - DNA, 730 bp, Homo sapiens
  misc_feature: GYAE6OF02IDL0P.18.53.E09.1.454.CMB.1.raw
  modified_base (233)..(233): a, c, t, g, unknown or other
  misc_feature (233)..(233): n is a, c, g, or t
tcagtacgagtatgcacgaccggtgctcgatttagagagagtgtgttgggtttggggcagtctcagtcaggacacagcatggacatgagggtccccgctcagctccgtggggctcctgctactctggctccggaggtcgccagatgtgacatccagatgaccctagtctccatccctcctgtctgctatctggtaggagactagacgtcacctagtctacgttggaccggtanaagtcaggacgactagttagctagtactttaaatttaacgtggtatacgaagtacgaagaaaacgaacgggaactcccctaagccttaccgtagtacttacctatcgtactactacttacgtaggtttcgaacgtaaacggttcgggtaccctagttaacgtaacgggttcacggtacggtacgtacgggtacggtaacgttcgggtacgggacttacgtttacgtttaccgaaccgttcctaccgttaaacccgaagtaccgtaagtacccgttaaggttccgtaaccgtaacgtaaacccgtttagggtaaacgttttacgttttacgaaaccgttaaccgtttaacgtacgttacgtaacgtaaacgtacggttaacttaaccgttacgttacccgtttaggttacgttaccggacgtaaccgggtacgtaacgcgtaacggtataaccgttaacgaacgttacgtacggccgtacgtaccgacgtaccgtacg

SEQ ID NO: 219030 - DNA, 808 bp, Homo sapiens
  misc_feature: GYAE6OF02IQLG7.18.53.E09.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (800)..(800): a, c, t, g, unknown or other
  misc_feature (800)..(800): n is a, c, g, or t
tcagtacgagtatgcacgaccggtgctcgatttagagagagtgtggttgggtttggggcagtctcagtcaggacacagcatggacatgacgggtccccgctcagctccgtgggctcctgctactctggcctccgaggtcgccagatgtgacatccagctcgacccagtcctccactcctccctgtctgcatcgngtaggacacgagtacgtccaacctntacctacgttcgggacccgggtactaacgtcgaacgacgtactaacgttcgacgtaagtactttaaagttttaagttaggtacttaacggacgtaaccgaaaacggtaaaacggaaaccggggtaaaccgtaccccgtaacttccgtaaccgttacgttacgtacttacgtcgttaacctaccgtaacgttacccgttaaggttacgaacggtaaacggttccggggtaccctaacgttaaccggttacggttaccggtaggtacggtaccggtaggttaaggtacgtcggtaacgggtaacgttaacgtttacctttaccgtaccctttacgtaaccccgtaccttacgtaccgtaacgtacgttaacccgtgtaccctaaacgtaccggtttaacggtttaactttaccggtttaactaccgtttaacttaccgttaaggttactaaaccggtaacgttacgttaaccgttaacccggtttaccgttccccggtttaagtttaccgggttccgaaccggacgtaacgtaggacgttacggaacgtactaaacggacgtacgtggtacgactacgtaccncggttacg

SEQ ID NO: 219031 - DNA, 307 bp, Homo sapiens
  misc_feature: GYAE6OF01DN4A3.22.13.B02.1.454.CMB.1.raw
  modified_base (306)..(307): a, c, t, g, unknown or other
  misc_feature (306)..(307): n is a, c, g, or t
tcagacatacgcgtcacgaccggtgctcgatttagtctagcgacttccgcgggcacggccatatattattgtgcgagagcgaggggggtggatattgtagtggtggtagctgctcctcggcatacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccacgcgtatgtctgagcgggctggcaaggcgcatagnn

SEQ ID NO: 219032 - DNA, 307 bp, Homo sapiens
  misc_feature: GYAE6OF01EVEUB.22.13.B02.1.454.CMB.1.raw
  modified_base (305)..(307): a, c, t, g, unknown or other
  misc_feature (305)..(307): n is a, c, g, or t
tcagacatacgcgtcacgaccggtgctcgatttagtctagcgacttccgcgggcacggccatatattattgtgcgagagcgaggggggtggatattgtagtggtggtagctgctcctcggcatacggtatggacgtctggggccaagggaccacggtcaccgtctcctcagcctccaccaagggcccatcggtcttccccctggcaccctcctccaagagcacctctggggcacagcggccctgggctgcctggtcaaggactacttccacgcgtatgtctgagcgggctggcaaggcgcatagnnn

SEQ ID NO: 219033 - DNA, 346 bp, Homo sapiens
  misc_feature: GYAE6OF02HPWOB.22.13.B02.1.454.CMB.1.raw
  modified_base (315)..(346): a, c, t, g, unknown or other
  misc_feature (315)..(346): n is a, c, g, or t
tcagacatacgcgtcacgaccggtgctcgatttagtctagcgacttccggacgggcacggccagtatattattgtgcgaagagcgaggggggtggatattgtagtggtggtagctgctcctcggcatacggtatggacgtctggggccaagggaccacggtcaccgtctcctcagcctccaaccaagggcccatcggtcttccccctaggcaccctcctccaagagcacctctgggggcacggcggccctgggctgcctggtcaaggactaccttccgacgcgtatgtctgagcgggctggcaaggcgcatagcnnnnnnnnnnnnnnnnnnnnnnnnnnnnnnnn

SEQ ID NO: 219034 - DNA, 312 bp, Homo sapiens
  misc_feature: GYAE6OF02I3VCO.22.13.B02.1.454.CMB.1.raw
  modified_base (306)..(312): a, c, t, g, unknown or other
  misc_feature (306)..(312): n is a, c, g, or t
tcagacatacgcgtcacgaccggtgctcgatttagtctagcgacttccgcgggcacggccatatattattgtgcgagagcgaggggggtggatattgtagtggtggtagctgctcctcggcatacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccacgcgtatgtctgagcgggctggcaaggcgcatagnnnnnnn

SEQ ID NO: 219035 - DNA, 313 bp, Homo sapiens
  misc_feature: GYAE6OF02GVPUP.22.13.B02.1.454.CMB.1.raw
  modified_base (307)..(313): a, c, t, g, unknown or other
  misc_feature (307)..(313): n is a, c, g, or t
tcagacatacgcgtcacgaccggtgctcgatttagtctagcgacttccgcgggcacggccatatattattgtgcgagagcgagggggggtggatattgtagtggtggtagctgctcctcggcatacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccacgcgtatgtctgagcgggctggcaaggcgcatagnnnnnnn

SEQ ID NO: 219036 - DNA, 258 bp, Homo sapiens
  misc_feature: GYAE6OF01AWFKB.24.87.H10.1.454.CMB.1.raw
  modified_base (256)..(258): a, c, t, g, unknown or other
  misc_feature (256)..(258): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaacatagtagtctgagcgggctggcaaggcgcatagnnn

SEQ ID NO: 219037 - DNA, 258 bp, Homo sapiens; identical to SEQ ID NO: 219036
  misc_feature: GYAE6OF01D1TMC.24.87.H10.1.454.CMB.1.raw
  modified_base (256)..(258): a, c, t, g, unknown or other
  misc_feature (256)..(258): n is a, c, g, or t

SEQ ID NO: 219038 - DNA, 258 bp, Homo sapiens; identical to SEQ ID NO: 219036
  misc_feature: GYAE6OF01BEL2P.24.87.H10.1.454.CMB.1.raw
  modified_base (256)..(258): a, c, t, g, unknown or other
  misc_feature (256)..(258): n is a, c, g, or t

SEQ ID NO: 219039 - DNA, 256 bp, Homo sapiens
  misc_feature: GYAE6OF01ELTAN.24.87.H10.1.454.CMB.1.raw
  modified_base (255)..(256): a, c, t, g, unknown or other
  misc_feature (255)..(256): n is a, c, g, or t
tcagactactatgtcacgaccggtgctcgatttagcagtactgcgttgggtttgggacagatttcactctcaccatcagcggcctccagtctgaagatttgcactttatttctgtcaacactatggtgactggcctccgtacacttttggccaggggaccaaactggagatcaaacgaactgtggctgcaccatctgtcttcatcttcccgccatctgaacatagtagtctgagcgggctggcaaggcgcatagnn

SEQ ID NO: 219040 - DNA, 257 bp, Homo sapiens
  misc_feature: GYAE6OF01EC89E.24.87.H10.1.454.CMB.1.raw
  modified_base (254)..(257): a, c, t, g, unknown or other
  misc_feature (254)..(257): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgcatctgaacatgtagtctgagcgggctggcaaggcgcatagnnnn

SEQ ID NO: 219041 - DNA, 260 bp, Homo sapiens
  misc_feature: GYAE6OF01CMY5S.24.87.H10.1.454.CMB.1.raw
  modified_base (256)..(260): a, c, t, g, unknown or other
  misc_feature (256)..(260): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaacatagtagtctgagcgggctggcaaggcgcatagnnnnn

SEQ ID NO: 219042 - DNA, 510 bp, Homo sapiens
  misc_feature: GYAE6OF01D0OLM.24.87.H10.1.454.CMB.1.raw
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcatctatgatgtctccaanagggtcactggcgtccccgcaggttcagtggcagtgggtctgggacagacttcactctcaccgtnagcagcctagagcctgaagtattttgcggtttactactgtcagcagcgttccgctggccgctaacgttcggcgggggaccagggtggagaggagacgaacgtggtggntgcacctanctgtcttcactcttcccgc

SEQ ID NO: 219043 - DNA, 529 bp, Homo sapiens
  misc_feature: GYAE6OF01CJFDD.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccgagggcccctggtcgtcccagccaggttcgttggcggtgggtctggggacagatttcactctcacatcagcgctccagtctgagatttgctactttattctgtacaactactatggtgactggccttaccgtactacttttcggcctaggggaccctaaagtggaagatacaaaacgactggtgctagccacatactgttacttcattccgtcccgtacc

SEQ ID NO: 219044 - DNA, 535 bp, Homo sapiens
  misc_feature: GYAE6OF01DMHN4.24.87.H10.1.454.CMB.1.raw
  modified_base (204)..(204): a, c, t, g, unknown or other
  misc_feature (204)..(204): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
  modified_base (498)..(498): a, c, t, g, unknown or other
  misc_feature (498)..(498): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcagaaacctggccaggctccaggcctctcctctatgctgtctccaccagggcccctggtcgtcccagcctaggttcgttggcggtggtcgtgggacagtattcactctcaccatcagccgcctccagtctgagtntttgctactttatttctgtctaactactatggtntactcgcctcgtactcgtttcggccacgggacctaacgtggaacgatacaaacgtactggtacggtntacgcacctatcgtctcttctacttccgtcccgtacc

SEQ ID NO: 219045 - DNA, 503 bp, Homo sapiens
  misc_feature: GYAE6OF01B07IK.24.87.H10.1.454.CMB.1.raw
  modified_base (394)..(394): a, c, t, g, unknown or other
  misc_feature (394)..(394): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagatttcactctcaccatcagcgcctcagtctgagtntttgctactttattctgtcacactatgtgactgctccgtactacgtttggccagggaccaacgtggagatcaaacgactgtggntgcacatctgtcttnctcctccgcc

SEQ ID NO: 219046 - DNA, 256 bp, Homo sapiens
  misc_feature: GYAE6OF01BO00V.24.87.H10.1.454.CMB.1.raw
  modified_base (256)..(256): a, c, t, g, unknown or other
  misc_feature (256)..(256): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaacatagtagtctgagcgggctggcaaggcgcatagn

SEQ ID NO: 219047 - DNA, 522 bp, Homo sapiens
  misc_feature: GYAE6OF01DQVMD.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagattcactctcaccatcagcggcctccagtctgaagtattttgctactttatttctgtcaactactatggtgactggcctccgtactctttggcctagggaccaacgtggaagactacaaacgaactgtggctgcaccatctgtcttctacttcttcccgtacc

SEQ ID NO: 219048 - DNA, 800 bp, Homo sapiens
  misc_feature: GYAE6OF01BLC7Y.24.87.H10.1.454.CMB.1.raw
  modified_base (214)..(214): a, c, t, g, unknown or other
  misc_feature (214)..(214): n is a, c, g, or t
tcagactactatgtcacgaccggtgctcgatttagcagtactgcgttgggtttgggggaggaactgctcagttaggacccagacggaaccatggaagccccagcgcagcttcctcttcctctgctactcgtggcctccagactaccacgtggaagaagtagtcagtgacgcagtcctccacgcccacctgtctgtcgtcctaccggaagggaancgccctaccctctccgtgacgacgggccaggtgaagtattggtcggacagactaacgttcgccgttacggtaccagacgaaacgaaaccgtcggaccaggtccctacccggacggtcctcccgtcctacttacgtcgtctcgtccctaccgaccgaccgggtccctggtccgtacccgacgtccgtacgggtttcggtcgggcgggttcgggtcgtaggggaacctaggttctttaccgtacgttcctaaccgtaacctacgttccgaacgggtcccgggtaccccttaccgtacggttccgtaacggtaaacgtttacgttttacggaaccttttaactttttacgtttccgttacgttaaccttaaaccgtacgtttaacggttcgggttacgtaccggttccggtacccgtttacccggttaaccgtttaccggttttaccgggaacccggtaaccggggtaaaccctaacggtacgggtaacgtaacgtaaaccgtaaaacgtacgttcggtacggtactacggaccctaacgtacgttccgttacgttaccttaccgtaacctttcccgttccccgtaacc

SEQ ID NO: 219049 - DNA, 538 bp, Homo sapiens
  misc_feature: GYAE6OF01DWIPW.24.87.H10.1.454.CMB.1.raw
  modified_base (202)..(202): a, c, t, g, unknown or other
  misc_feature (202)..(202): n is a, c, g, or t
  modified_base (524)..(524): a, c, t, g, unknown or other
  misc_feature (524)..(524): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaangccaccctctcctgcagggccagtgagaatgttggcagcaacttagcctggtaccagcagaacctggccaggctccaggctcctcctctatgctgtcctccaccacgggcccctggtcgtcccagccaggttcgttgggcggtgggtctggggacagtatttcactctcaccatcagcggcctccagtctgaagtattttgctacttttatttctgttacctaactacttatggtgactggcctccgtactacgtttggccgaggggtaccaacgtggaagtactacaaacgaactggtcggctcgcaccatcctgtccttnacttcttcccgtcc

SEQ ID NO: 219050 - DNA, 520 bp, Homo sapiens
  misc_feature: GYAE6OF01B89BM.24.87.H10.1.454.CMB.1.raw
  modified_base (203)..(203): a, c, t, g, unknown or other
  misc_feature (203)..(203): n is a, c, g, or t
  modified_base (508)..(508): a, c, t, g, unknown or other
  misc_feature (508)..(508): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctcccaggctcctctctatgctgtctccaccagggcccctggtcgtcccagccaggttcgtggcggtgggtctgggacagatttcactctcaccatcagcggcctccagtctgaagattttgctactttatttctgtcaacactatggtgactggccttccgtactacttttcgggccgaggggtaccaaacgtggagatacaaacgaactggtgctgcaccatctgtcttnactcttcccgcc

SEQ ID NO: 219051 - DNA, 531 bp, Homo sapiens
  misc_feature: GYAE6OF01BSQU0.24.87.H10.1.454.CMB.1.raw
  modified_base (384)..(384): a, c, t, g, unknown or other
  misc_feature (384)..(384): n is a, c, g, or t
  modified_base (519)..(519): a, c, t, g, unknown or other
  misc_feature (519)..(519): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgtggcggtgggtctgggacagatttcactctcaccatcagcgcctcngtctgagatttgctactttatttctgtcaactactatggtgactggtcctccgtactacttttcgggccgtacggggtacctaacgtagggagaacgtacaaacgtaacgtgtggctgcaccatctcgtcttacnctcttcccgtcc

SEQ ID NO: 219052 - DNA, 524 bp, Homo sapiens
  misc_feature: GYAE6OF01BBWHY.24.87.H10.1.454.CMB.1.raw
  modified_base (203)..(203): a, c, t, g, unknown or other
  misc_feature (203)..(203): n is a, c, g, or t
  modified_base (492)..(492): a, c, t, g, unknown or other
  misc_feature (492)..(492): n is a, c, g, or t
  modified_base (510)..(510): a, c, t, g, unknown or other
  misc_feature (510)..(510): n is a, c, g, or t
tcagactactatgtcacgaccggtgctcgatttagcagtactgcgttgggtttgggggaggaactgctcagttaggacccagacggaaacatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctccaggctcctcctctatgctgtcctccaccgacgggcccctggtcgtcccagccaggttcgtggcggtgggtctgggacagtatttcactctcacatcagcgcctcagtctgagtatttgctactttattctgtctaacactatggtgtactggcctccgtactacgtttggccgtagggtaccaacgtggagatacgaaacgacgtgtcggntgcaccatctcgtcttcncttccttcccgacc

SEQ ID NO: 219053 - DNA, 515 bp, Homo sapiens
  misc_feature: GYAE6OF01AIVGC.24.87.H10.1.454.CMB.1.raw
  modified_base (505)..(505): a, c, t, g, unknown or other
  misc_feature (505)..(505): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagatgttggcagcaacttagcctggtaccagcagaaacctggccaggctcccaggctcctcctctatgctgtctccaccacgggcccctggtgtccccagccaggttcgttggcggtgggtctgggacagatttcactctcaccatcagcggcctccagtctgagtattttgctactttatttctgtctacactatggtgactggtcctccgtactacgtttcggccgtaggggaccaacgtggagatacaacgactgtggctgcacatctgtctnctcttcccgc

SEQ ID NO: 219054 - DNA, 530 bp, Homo sapiens
  misc_feature: GYAE6OF01DT51F.24.87.H10.1.454.CMB.1.raw
  modified_base (203)..(203): a, c, t, g, unknown or other
  misc_feature (203)..(203): n is a, c, g, or t
  modified_base (516)..(516): a, c, t, g, unknown or other
  misc_feature (516)..(516): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctctctatgctgtctccaccgagggcccctggtcgtcccagccaggttcgttggcggtgggtctgggacagatttcactctcaccatcagcggcctccagtctgagtatttgtctactttatttctgtcaactactattggtgtactcggcctccgtactacgttttcggccgtacgggacctaacgtggagatacaaacgtacgtgtggtctgcaccatctgtcttnacttcctcccgtcc

SEQ ID NO: 219055 - DNA, 511 bp, Homo sapiens
  misc_feature: GYAE6OF01EG6U2.24.87.H10.1.454.CMB.1.raw
  modified_base (501)..(501): a, c, t, g, unknown or other
  misc_feature (501)..(501): n is a, c, g, or t
tcagactactatgtcacgaccggtgctcgatttagcagtactgcgttgggtttggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtgtcccagccaggttcgtggcggtgggtctggggacagatttcactctcaccatcagcggcctcagtctgaagtattttgctactttatttctgtcaacactatggtgactggccttccgtactacttttggccaggggaccaaactggagatcaaacgactgtggctgcacatctgtcttnctctcccgcc

SEQ ID NO: 219056 - DNA, 515 bp, Homo sapiens
  misc_feature: GYAE6OF01EF09O.24.87.H10.1.454.CMB.1.raw
  modified_base (501)..(501): a, c, t, g, unknown or other
  misc_feature (501)..(501): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaacctggccaggctcccaggctcctcctctatgctgtctccaccacgggcccctggtcgtcccagccaggttcgtggcggtgggtctgggacagattcactctcaccatcagcgcctccagtctgagtatttgctactttatttctgtcaactactatggtgactgcctccgtactctttcggccgtagggaccaacgtggagatacaaacgactgtggctgcaccatctgttcttntactcctcccgtcc

SEQ ID NO: 219057 - DNA, 528 bp, Homo sapiens
  misc_feature: GYAE6OF01EHFZ9.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctggggacagatttcactctcaccatcagcggcctccagtctgagtattttgctactttatttctgtctaacactatggtgactggcctccgtactacgttttgggccgtaggggtaccaacgtggagatacaaacgaactggtcgctgccaccatctgtcttcacttcctcccgacc

SEQ ID NO: 219058 - DNA, 512 bp, Homo sapiens
  misc_feature: GYAE6OF01DG0V8.24.87.H10.1.454.CMB.1.raw
  modified_base (203)..(203): a, c, t, g, unknown or other
  misc_feature (203)..(203): n is a, c, g, or t
  modified_base (503)..(503): a, c, t, g, unknown or other
  misc_feature (503)..(503): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccaccggagacattgtgttgacacagtctccagccaccctgtctttgtctccaggggaaanagccaccctctcctgcagggccagtgacaatgttaggaagttgtagcctggtatcaacacaaacatggccaggcctcccggctcctcatctatgatgcatccaatagggccacgtggaatcccaagacaggttcagtggcaggtgggtctgggacagacttcactctcaccatcagcagtgtagagcctagaagtatttgctagttttattactgtcagcacgtgacaactcgccctacgtttcggccctgggaccagactggacataccaacgacgtgtggctgccacatctgtcttcncttctcccg

SEQ ID NO: 219059 - DNA, 551 bp, Homo sapiens
  misc_feature: GYAE6OF01D6K0D.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagatttcgactctcaccatcagcgcctccagtctgaagtatttgctactttattctgtctaacactatggtgactcggtccttccgtactacgttttcggaccgtacggggaccctaaacgtggaacgtagtaccgaaaacgtaacgtggtcggtctaggcacctatctgttcttacacttccctcccgtacc

SEQ ID NO: 219060 - DNA, 550 bp, Homo sapiens
  misc_feature: GYAE6OF01EB2MB.24.87.H10.1.454.CMB.1.raw
  modified_base (434)..(434): a, c, t, g, unknown or other
  misc_feature (434)..(434): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccacccgtctcctgcagggccagtgagaatgttgcagcaacttagcctggtaccagcagaaacctggccaggctccaggctcctcctctatgctgtctccaccagggcccctggctcccagccgaggttcgtggcggtgggtctggggacaggtatttcactctcaccatcacgcggcctcctagtctagaagtattttgctactttattctgtactaacactatggtnactgcctccgtactacgtttcggaccgtaggggaccaacgtgggaacgtactacgaaaacgaacgtgtacggtctacgtccaccgtatcttacgtcttactactccgttcccgacc

SEQ ID NO: 219061 - DNA, 257 bp, Homo sapiens
  misc_feature: GYAE6OF01D4K86.24.87.H10.1.454.CMB.1.raw
  modified_base (256)..(257): a, c, t, g, unknown or other
  misc_feature (256)..(257): n is a, c, g, or t
tcagactactatgtcacgaccggtgctcgatttagcagtactgcgttgggtttgggacagatttcactctcaccatcagtggcctccagtctgaagattttgcactttatttctgtcaacactatggtgactggcctccgtacacttttggccaggggaccaaactggagatcaaacgaactgtggctgcaccatctgtcttcatcttcccgccatctgaacatagtagtctgagcgggctggcaaggcgcatagnn

SEQ ID NO: 219062 - DNA, 572 bp, Homo sapiens
  misc_feature: GYAE6OF01BNWM8.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaangccacctctcctgcagggccagtgagatgttggcagcacttagcctggtaccagcagaaacctggccaggctccaggctcctctctatcgtctgtcctccaccgagggcccctggtcgtcccagcctaggttcgttggcggtgggtcgtggggacctagtctttcactctcacctagtccgagccggcctcctacgtctagaagtatttgctactttattctgtacaactactagtgtgactgccttaccgtactacgtttcgaccgtacgggacctaaacgtcggaagtaacgtaccgtaaaacgtacgtacggtcggtactcgaccgacctaagtcgttcgtaccttacacgttcccttcccgtaccg

SEQ ID NO: 219063 - DNA, 519 bp, Homo sapiens
  misc_feature: GYAE6OF01C71MS.24.87.H10.1.454.CMB.1.raw
  modified_base (203)..(203): a, c, t, g, unknown or other
  misc_feature (203)..(203): n is a, c, g, or t
  modified_base (488)..(488): a, c, t, g, unknown or other
  misc_feature (488)..(488): n is a, c, g, or t
  modified_base (505)..(505): a, c, t, g, unknown or other
  misc_feature (505)..(505): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctcccaggctcctcctctatgctgtctccaccagggcccttggtcgtcccagccaggttcgtggcggtgggtctggggacagatttcactctcaccatcagtcggcctcagtctgaagtatttgctactttatttctgtcaactactatgtgactggtcctccgtactactttggccgagggtaccaactggagtatacaaacgactgtggntgccacatctcgtcttntactcttccgtacc

SEQ ID NO: 219064 - DNA, 513 bp, Homo sapiens
  misc_feature: GYAE6OF01AXLZ8.24.87.H10.1.454.CMB.1.raw
  modified_base (360)..(360): a, c, t, g, unknown or other
  misc_feature (360)..(360): n is a, c, g, or t
  modified_base (505)..(505): a, c, t, g, unknown or other
  misc_feature (505)..(505): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagntttcactctcaccatcagcggcctccagtctgaagtatttgctactttatttctgtcaactactatggtgactggcctccgtactacttttggtcgaggggaccaacgtggagatacaaacgactgtggctgcacatctgtctcntctcccgc

SEQ ID NO: 219065 - DNA, 548 bp, Homo sapiens
  misc_feature: GYAE6OF01EQ2M7.24.87.H10.1.454.CMB.1.raw
  modified_base (205)..(205): a, c, t, g, unknown or other
  misc_feature (205)..(205): n is a, c, g, or t
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagngccaccctctcctgcagggccagccggagtgttagtaagtacttaggctggtaccaanagaaacctggccaggctcccaggctcctcatctatgatgtctccaacngggtcactggcgtcccgcaggttcagtgcagtggtctgggacagacttcactcncaccgtcagcagcctagagcctgaagtnttttgtcgtttactacgtgtcagcagtccgttccgcctcggcccgtcgtaacgtttcgggccggggggtaccgaggggtcgggaggagggaggacgaacgtggtggcgtgcgacctatcttcgtcttcacttccttcccgcctactcgtgtaaac

SEQ ID NO: 219066 - DNA, 531 bp, Homo sapiens
  misc_feature: GYAE6OF01C2JBX.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagaatgttggcagcaacttagcctggtaccagcagaaacctggccaggctcccaggctcctctctatgctgtctccaccagggcccctggtcgtcccagccaggttcgtggcggtgggtctgggacagtatttcactctcacatcagcgcctccagtctgaagtatttgctactttatttcttgtctaactactagtggtgactcggtcctccgtactacgttttcggccgtacggggaccaacgtggagactacgaaacgactgtggctgcacctatctgtcttctactccttcccgtacc

SEQ ID NO: 219067 - DNA, 545 bp, Homo sapiens
  misc_feature: GYAE6OF01D9EWJ.24.87.H10.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (540)..(540): a, c, t, g, unknown or other
  misc_feature (540)..(540): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaaccaanagaaacctggccaggctcccaggctcctcatctatgatgtctccaacngggtcacgtggccgtccccgcaggttcaggtggctaggtggtctgggacagtcttcactctcacgtnagcagcctagngcctgaagtattttgcggtttactacgtgtcagcagtccgttccgccgtcggccgtcgttacgtttccgggcgggggaccgaggggtggaggaggacgacgacgtggtggctgcactgtctgtcttcacttccttcccgctatctagtacngtacg

SEQ ID NO: 219068 - DNA, 519 bp, Homo sapiens
  misc_feature: GYAE6OF01EQ9WB.24.87.H10.1.454.CMB.1.raw
  modified_base (436)..(436): a, c, t, g, unknown or other
  misc_feature (436)..(436): n is a, c, g, or t
  modified_base (478)..(478): a, c, t, g, unknown or other
  misc_feature (478)..(478): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccacgggcccctggtcgtcccagccgtagggttcgtggcggtgggtctgggacagatttcactctcaccatcagcggcctccagtctgaagtattttgctacttttattcttgtctaactactatggtntacgtggcctccgtactactttggccaggggaccaagtgganatacaaacgactgngntgcacatctgtcttcatcctccgcc

SEQ ID NO: 219069 - DNA, 545 bp, Homo sapiens
  misc_feature: GYAE6OF01BFEJ8.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgctgtctccagccaccctgtctgtgtctccaggggaaanagccaccctctcctgcagggccagtgagaatgttggcagcaacttagcctggtaccaacagaaacctggccaggctcccaggcctcctcatctatgatgtcctccaacagggtcacgtcggccgtccccgccaggttccaggtggcaggtgggtctgggacagacttcactctcaccgtcagcagcctagacgcctagaagtattttggcggttttactacgtgtcagtcagtcgttccgccgtggcccgtctaacgtttcggggccgggggtaccgaggggtggaggaggaggacgacgtggtggcgtgccgctagtcctgtcttcattcctcccgctacg

SEQ ID NO: 219070 - DNA, 644 bp, Homo sapiens
  misc_feature: GYAE6OF01B52E5.24.87.H10.1.454.CMB.1.raw
  modified_base (204)..(204): a, c, t, g, unknown or other
  misc_feature (204)..(204): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgtggcagcaacttagcctggtaccagcagaaacctggccaggctccaggcctcctcctctatgctgtcctccaccgacgggcccctggtcgtcccagccgtaggttagttgggcggtgggtctggggactagtnttcgactcgtcaaccntcagccggcctccgagtctagtaagtcttttcgcttacgtttatttctcgttacctaactacgttagtggtcgacttcggtacccgttccgttaacttaccggttttacgggacccgtaacggggtaaccctaaacggtacggaacgtaacgttaaccgaaaaccggttacgtaggtccggtaaccttacggaccctaacccgtacgttaccgttacggtttaccctttaccgtactttccccgttcccccggtaaccc

SEQ ID NO: 219071 - DNA, 662 bp, Homo sapiens
  misc_feature: GYAE6OF01EACCH.24.87.H10.1.454.CMB.1.raw
  modified_base (118)..(118): a, c, t, g, unknown or other
  misc_feature (118)..(118): n is a, c, g, or t
  modified_base (210)..(210): a, c, t, g, unknown or other
  misc_feature (210)..(210): n is a, c, g, or t
tcagactactatgtcacgaccggtgctcgatttagcagtactgcgttgggtttgggggaggaactgctcagttaggacccagacggaaccatggaagccccagcgcagcccccccttntcttcctcctgctactctggctcccagataccactggagaagtagtcatgacgcagtctccagccaccctgtctgtgtctccgaggggaaanagcccaccctctcctgcagggccagtgagatgttggcagcaacttagcctggtaccagcagaaacctggccaggctcccaggctcctcctctatgctgtcctccaccaggggcccctggtcgtcccacgccgtacggttcggttcggtcgggtcggggtcgtcggggtacgaggtagtttcctacgtccttccaccctactcacggtcgggcccttccgacgttcgtagtaaggtatttttcgtctaactttttagtttcttgttctaacctaacttagttaggttcgtacgtcggtcccgttacccgttaccttacgttttcgggtacccggacggggtaaccctaaacgtacggtaagtacgttaacgaaaaccgtaaaccgtggtcgggtacttacgaccgaaccctagtccttcgttaccttactacttcccgtttccccggtacccc

SEQ ID NO: 219072 - DNA, 655 bp, Homo sapiens
  misc_feature: GYAE6OF01B0SX2.24.87.H10.1.454.CMB.1.raw
  modified_base (201)..(201): a, c, t, g, unknown or other
  misc_feature (201)..(201): n is a, c, g, or t
tcagactactatgtcacgaccggtgctcgatttagcagtactgcgttgggtttggggaggaactgctcagttaggacccagacggaaccatggaagccccagcgcagcttctcttctcctgctactctggctccagataccactggagaagtagtcatgacgcagtctccagccaccctgtctgtgtctccgaggggaaangccaccctctcctgcagggccagtgagaatgtggcagcaattagcctggtaccagcagaaacctggccaggctcccaggcctctcctctatgctgtcctccaccacgggcccctggtcgtccccagccgtaggttcgttgggcggtgggtctggggacaggtatttcactctcaccatcagccgcctcagtctgaagtattttcgacttactttactttcttgttacctaacgtaccttagttggttcgtaaccgttcgggtaccccgttccgttaaccgttaccgttttacgggtacccgtaacgggggtaaccctaaaccggtacggaacggtaacgttaaccgtaaaaccggtaaacttacgggtacggtacctacggtaccctaacccgtaaacgttccgtttaccggttaccttttacccgtaactttccccgtttcccccggtaaccc

SEQ ID NO: 219073 - DNA, 519 bp, Homo sapiens
  misc_feature: GYAE6OF01CNU06.24.87.H10.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (507)..(507): a, c, t, g, unknown or other
  misc_feature (507)..(507): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctntcctgcagggccagtgagaatgttggcagcaacttagcctggtaccagcagaaacctggccaggctcccaggctcctctctatgctgtctccaccagggcccctggtcgtcccagccaggttcgtcggcggtgggtctgggacagatttcgactctcaccatcagcggcctccagtctgagtattttgctactttatttctgtcaactactatggtgactgcctccgtactacttttcggcctaggggaccaaacgtggaagatacaaacgaactgtgctgcaccatctgtcttnactcttccgacc

SEQ ID NO: 219074 - DNA, 541 bp, Homo sapiens
  misc_feature: GYAE6OF01ES568.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccacgggcccctggtcgtcccagccaggttcgttggcggtgggtctgggacagatttcacgtctcaccatcagccggcctccagtctgaagtatttgctactttatttctgtctaactactatggtgtactggtcctccgtactactttcgggcctacggggaccaacgtggagtatacgaaacgtaacgtgtcggtctcgcacctatcttctcttacacttccgtcccgtacc

SEQ ID NO: 219075 - DNA, 657 bp, Homo sapiens
  misc_feature: GYAE6OF01DWPA1.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttagcctggtaccagcaagaaacctggccaggcctccaggcctcctcctctatgctgtcctccaccgacgggcccctggtcgtcccagccgtagggttcgttgggcggtgggtcgtgggactagtactttccactctacacctagtccgacggccggtcctcccgtacggttctagtaagttattttcgtacttacgttttactttcgtacgttactaactacgttattcggttacgtacgttcggtcccgttaccgttaccgttacgttttacgggaccgtaacggggtacccgtaaacggtacggtaacggtaactaccgtaaaacggtaacgttaggtacgggtccgttacggacctaccgtacttaccgttcgttacctttactaccttccgttccccggtacccg

SEQ ID NO: 219076 - DNA, 618 bp, Homo sapiens
  misc_feature: GYAE6OF01BZ0LE.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgccaccctctcctgcagggccagtgagaatgttggcagcaacttagcctggtaccagcagaaacctggccaggctccaggcctcctcctctatgtctgtcctccaccgacgggcccctggtcgtcccagccgtaggttcgttggcggttgggtctggggacagtactttcactctcaccatcaggccggcctccgagtctagtaacgtattttcgacttacttttatttctacgttactaactacgttagtggtcgtacgttcggtccttaccgttacttaccgttttcggacccgtaacgggtaaccctaaacggtcggaacgtaacgttaaccgaaaaccgtacgttacggtcgggaccttcggaccaaccgtacgttcgtcgttacttacctacttcccgttcccgtacc

SEQ ID NO: 219077 - DNA, 533 bp, Homo sapiens
  misc_feature: GYAE6OF01A4X1A.24.87.H10.1.454.CMB.1.raw
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggcctcctcctctatgctgtctccaccagggcccctggtgtcccagccaggttcgtggcggtgggtctgggactgatttcactctcaccatcagcggcctccagtctgaagnttttgctactttatttctgtctaacactatggtnactggtcctccgtactacgttttggaccaggggtaccaacgtggagactacgaaacgtacgtggtggctgcctacagtactgtcttacacttcgttcccgtacc

SEQ ID NO: 219078 - DNA, 537 bp, Homo sapiens
  misc_feature: GYAE6OF01C94CI.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccagggaaaagngccaccctctcctgcagggccagtgagaatgttggcagcaacttagcctggtaccagcagaaacctggccaggctccaggctcctcctctatgctgtctccaccagggcccctggtcgtcccagccctagggttcgttgggcggttgggtctgggacagtatttcactctcacatcagcgcctccagtctgaagtatttgctactttatttctgtctaactactatggtgactcgtcctccgtactacgttttcgggccgtacggggaccaaacgtggaagactacgaaacgtaactggtcgctgcacatctgtacttcactcgtcccgtacc

SEQ ID NO: 219079 - DNA, 552 bp, Homo sapiens
  misc_feature: GYAE6OF01CUSDM.24.87.H10.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
tcagactactatgtcacgaccggtgctcgatttagcagtactgcgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggctccaggctcctcatctatgatgtctccaacngggtcactggccgtcccgcaggttcagtggcagtggtctggacagacttcactctcaccgtcagcagcctagacgcctagaagtattttgtcggtttactacttgtacagcgagtcgttccgcctggcccgacgttaacgtttcgggcgggggtaccgaggggtcggaggtaggagacgaacgtggtcggctgcaccagtcgtgttcttcacttccttcccgcctactctacgtaactgtaag

SEQ ID NO: 219080 - DNA, 627 bp, Homo sapiens
  misc_feature: GYAE6OF01BOE22.24.87.H10.1.454.CMB.1.raw
  modified_base (393)..(393): a, c, t, g, unknown or other
  misc_feature (393)..(393): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaagagccaccctctcctgcagggccagtgagatgttggcagcaacttagcctggtaccagcaagaaacctggaccaggcctcccgacggtcctcctcctctatcgctcgtcctccaccgacgggtcccctggtcgtccccgagccgtaggttcggtgggcggtgggtcgtgggactagtacttcactctcacntcacgcgcctcgagtctagtagttactttgacttactttactttcgtagttaccaacttacgttagtggtcgtactcgggtcccttaccggttacttaccggttttcgggacccggtaacggggtaaccctaaacggtgggaacgtaacgtaccgaaaacggtacgttgggtaccgtacgtagaccctaccgtagttccttacggttccttacgtcctttcccgttccccgtac

SEQ ID NO: 219081 - DNA, 555 bp, Homo sapiens
  misc_feature: GYAE6OF01BBVP2.24.87.H10.1.454.CMB.1.raw
  modified_base (204)..(204): a, c, t, g, unknown or other
  misc_feature (204)..(204): n is a, c, g, or t
  modified_base (391)..(391): a, c, t, g, unknown or other
  misc_feature (391)..(391): n is a, c, g, or t
  modified_base (537)..(537): a, c, t, g, unknown or other
  misc_feature (537)..(537): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccaggggaaangccaccctctcctgcagggccagtgagaatgttggcagcaacttagcctggtaccagcagaaacctggccaggctccaggctcctcctctatgctgtctccaccacgggcccctggtcgtcccagcctaggttcgttcgggcggttgggtctggggacagtatttcactctcaccatcagcgcctcngtctgagtatttgactactttatttctcgtacaactatagtgtcgtacgtcgtccttccgtacttacgtttcggaccgtaggggtaaccaacgtggactacgtacaaacgtaacgtggtacggctaggccacctagtctgtcttanacttcccgttcccgtacc

SEQ ID NO: 219082 - DNA, 549 bp, Homo sapiens
  misc_feature: GYAE6OF01CM4LI.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttagcctggtaccagcagaaacctggccaggctcccaggctcctcctctatgctgtcctccaccagggcccctggtcgtcccagccaggttcgttggcggtgggtctggggacaggtatttcactctcaccatcagccgcctccagtctgaagtatttgctactttatttcttgtactaactactatggttcgacgttcggtccttccgtactacgttttcgggccgtaacggggtacctaaacgtggaacgatacgaaacgactaggtggctgcaccatctgtcttcactccttcccgacc

SEQ ID NO: 219083 - DNA, 507 bp, Homo sapiens
  misc_feature: GYAE6OF01EZUP4.24.87.H10.1.454.CMB.1.raw
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (498)..(498): a, c, t, g, unknown or other
  misc_feature (498)..(498): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccacctctcctgcagggccaggtgagaatgttgcagcaacttgcctggtaccagcagaaacctggccaggctcccaggctcctcctctatgctgtctccaccagggcccctggcgtccagccaggttcgtggcggtggtctggggacaggatttcactcgtcaccatcagcgcctcagtcnganatttgctatttattctgttcaactactatgtgactggccttcgtactacttttcggaccaggggtaccaacgtggacgatcaaacgactgtcgatgcacatctgtactnatctccgtc

SEQ ID NO: 219084 - DNA, 542 bp, Homo sapiens
  misc_feature: GYAE6OF01C6F4H.24.87.H10.1.454.CMB.1.raw
  modified_base (204)..(204): a, c, t, g, unknown or other
  misc_feature (204)..(204): n is a, c, g, or t
  modified_base (531)..(531): a, c, t, g, unknown or other
  misc_feature (531)..(531): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcagaaacctggccaggctcccaggctcctcctctatgctgtcctccaccgacgggcccctggtcgtccccagcctagggttcgttgggcggtgggtctggggacagtatttcactctcaccatcagccggcctccagtctgtaagtatttgtctactttatttcttgtctaactactatggtgtactggtccttccgtactacgttttcggccgtacgggaccaacgtggacgactacgaaacgactgtcggctgcaccatctgtcttnactctccgtcc

SEQ ID NO: 219085 - DNA, 562 bp, Homo sapiens
  misc_feature: GYAE6OF01D36W3.24.87.H10.1.454.CMB.1.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctttgctccagggganagagccaccctctcctgcagggccagccggagtgttagtagtactaggctggtaccaanagaacctggccaggctccaggctcctcatctatgatgtctaccaacgagggtcacgtggccgtccccgcaggttcagtggcaggtggtctgggacngacttcactcncacgtcagcagcctagagcctgaagtnttttgacggtttactacgtgtcagtcacgtcgttccgccgtggcccgtcttaacggtttcggggcggggggtaccgaggggtggacggagggagacggtaacgtggtacggcgtggccaccgtattcgttgtccttcacttccgttacccgcctactcgtacgtaaacg

SEQ ID NO: 219086 - DNA, 522 bp, Homo sapiens
  misc_feature: GYAE6OF01CY2W8.24.87.H10.1.454.CMB.1.raw
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
  modified_base (396)..(396): a, c, t, g, unknown or other
  misc_feature (396)..(396): n is a, c, g, or t
  modified_base (517)..(517): a, c, t, g, unknown or other
  misc_feature (517)..(517): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatacccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcatctatgatgtctccaacagggtcacgtggcgtcccagccaggttcgttggcggtgggtctgggacagatttcactcncacatcagcggcctcagtctgaagtntttgctacttttattctgtcaactacttatggtgactcgccttaccgtactacttttggcctaggggaccaaacgtggagactacgaaacgtacgtgtggctgcacctatactgtcttcgnttccc

SEQ ID NO: 219087 - DNA, 564 bp, Homo sapiens
  misc_feature: GYAE6OF01CW8RV.24.87.H10.1.454.CMB.1.raw
  modified_base (207)..(207): a, c, t, g, unknown or other
  misc_feature (207)..(207): n is a, c, g, or t
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
  modified_base (361)..(361): a, c, t, g, unknown or other
  misc_feature (361)..(361): n is a, c, g, or t
tcagactactatgtcacgaccggtgctcgatttagcagtactgcgttgggtttggggaggaactggcttcagttaggacccagacggaaccatggaagccccagcgacaagcttctcttcctcctgcttactctggctcccagatacccatggagaagtagtcatgacgcagtctcagccaccctgtctgtgtctccgaggggaaanacgccaccctctcctgcagggccagtcagagtgtagcagcagctacttagcctggtaccnggcagaaacctggcctggcctccgaggctcctcatctatggtncgtcacagggccactggcgtcgcggacnggttcagtgcagtgcttgggacngacttcactcacatcatcgacagactggacgaccgtaagtagtttcgacgtagtagtacttacgtgtactagtctttacgtttcggttacccttcgtccttacttattacgttacgttacgtttcggaccgtacgggttccgaggtcgtaggtacggtagttacgtaagtacgtaacgttaggtaggtacgtcgcgtaacccg

SEQ ID NO: 219088 - DNA, 727 bp, Homo sapiens
  misc_feature: GYAE6OF01CDMLQ.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaaagcgccaccctctcctgcagggccagtgagaatgttggcagcaacttagcctggtaccagcaagaaacctggaccctggcctccgacggtcctcctcactctagtggtcgccgtaccgacggacggccacggtcggcgtcggacggacgtgggttacaggtcggacgtagggtcggtcggtttacgggactacgtacttaccgtacttcgtctactacgtacgtccgaacgacggtacggtacgggaccgtaacccgggtaaagtttagtttaccggacgtttaggttacgtttaacgtttacgtcggttaccgtcggtttcgtttccgggttttcccggtcccctttcccgttacccgtttaccctttaagttaccgtttaaccgttttccgggttttccggaacccgggtttacgggtttcccgaggggtccttaacggggtaacgtagttaacccggtaacgggtaccgtaaacggtttcgggcggttaaccgttccggaacccttacgttgtttacccgg

SEQ ID NO: 219089 - DNA, 538 bp, Homo sapiens
  misc_feature: GYAE6OF01A4FDH.24.87.H10.1.454.CMB.1.raw
  modified_base (523)..(523): a, c, t, g, unknown or other
  misc_feature (523)..(523): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctccaggctcctcctctatgctgtcctccaccagggcccctggtcgtcccagccaggttcgttggcggtgggtctggggacagtatttcactctcaccatcagcgcctcagtctgatatttgctactttattctgtctaactactatggtgactcggcctccgtactacttttcgggcctaggggacctaaacgtggaagactacgaaaaccgtaacgtggtggctggccaccatcctgtccttanacttcctcccgtacc

SEQ ID NO: 219090 - DNA, 510 bp, Homo sapiens
  misc_feature: GYAE6OF01A8FIL.24.87.H10.1.454.CMB.1.raw
  modified_base (502)..(502): a, c, t, g, unknown or other
  misc_feature (502)..(502): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctggggacagatttcactctcaccatcagcgcctccagtctgagattttgctactttatttctgtcaacactatggtgactggcctccgtgctacttttggccaggggaccaacgtggagatcaaacgacgtgtggctgcacatctgtctcntcttcccg

SEQ ID NO: 219091 - DNA, 259 bp, Homo sapiens
  misc_feature: GYAE6OF01C3XOL.24.87.H10.1.454.CMB.1.raw
  modified_base (256)..(259): a, c, t, g, unknown or other
  misc_feature (256)..(259): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaacatagtagtctgagcgggctggcaaggcgcatagnnnn

SEQ ID NO: 219092 - DNA, 553 bp, Homo sapiens
  misc_feature: GYAE6OF01BVLLT.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgtggcagcaacttagcctggtaccagcagaaacctggccaggctccaggctcctctctatgctgtcctccaccgacgggcccctggtcgtccccagcctaggttcgtggcggtgggtctggggacagtatttcgactctacacctatcagcggcctccgagtctgaagtatttgctactttattctgtactaactactatggtgtactgtcctccgtactacgtttcggaccgtacggggtaacctaacgtggaacgtatacgaaacgtacgtggtcggtctgccaccattcgtcgttcttacacttcccttcccgtacc

SEQ ID NO: 219093 - DNA, 529 bp, Homo sapiens
  misc_feature: GYAE6OF01C8NNP.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctccaggctcctctctatgctgtcctccaccagggcccctggtgtcccagccaggttcgttggcggtggtctggggacagatttcactctctaccatcagcggtcctccacgtctgtaagtatttgtctactttattcttgtctaactactatgtgactcggctccgtactacttttggccgtagggaccaacgtggagacgtacaaacgtaactagtcggtctgcacatctcgtcttcactcctcccgtacc

SEQ ID NO: 219094 - DNA, 545 bp, Homo sapiens
  misc_feature: GYAE6OF01EF39Z.24.87.H10.1.454.CMB.1.raw
  modified_base (203)..(203): a, c, t, g, unknown or other
  misc_feature (203)..(203): n is a, c, g, or t
  modified_base (414)..(414): a, c, t, g, unknown or other
  misc_feature (414)..(414): n is a, c, g, or t
  modified_base (436)..(436): a, c, t, g, unknown or other
  misc_feature (436)..(436): n is a, c, g, or t
  modified_base (524)..(524): a, c, t, g, unknown or other
  misc_feature (524)..(524): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagatgtggcagcaacttagcctggtaccagcagaaacctggccaggctcctggctcctcctctatgctcgtctccaccacgggcccctggtcgtccccagccaggttcgttgggcggtgggtctggggacagatttcactctcaccatcagcggcctccagtctagaagtattttgctacttttntttctgttcaactactatggtnactggccttccgtactacgttttcggaccgtaggggaccctaaacgtggaagatacgaaacgtaacgtgtcggctgccacctatcgtntcttacacttccttcccgacc

SEQ ID NO: 219095 - DNA, 524 bp, Homo sapiens
  misc_feature: GYAE6OF01B9R9G.24.87.H10.1.454.CMB.1.raw
  modified_base (203)..(203): a, c, t, g, unknown or other
  misc_feature (203)..(203): n is a, c, g, or t
  modified_base (361)..(361): a, c, t, g, unknown or other
  misc_feature (361)..(361): n is a, c, g, or t
  modified_base (394)..(394): a, c, t, g, unknown or other
  misc_feature (394)..(394): n is a, c, g, or t
  modified_base (426)..(426): a, c, t, g, unknown or other
  misc_feature (426)..(426): n is a, c, g, or t
  modified_base (487)..(487): a, c, t, g, unknown or other
  misc_feature (487)..(487): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggcctcctcctctatgctgtctccaccagggcccctggtcgtcccagccaggttcgtggcggtgggtctgggacagtnttcactctcacatcagcgcctcagtctgaagtntttgctactttattctgtcaactactatggtnactggcctcgtactacgtttgccagggtaccaagtggagtatacaaacgtaacgtgtcggntcggcacctatctagttcttacacttcctcccgtacc

SEQ ID NO: 219096 - DNA, 537 bp, Homo sapiens
  misc_feature: GYAE6OF01B8OHQ.24.87.H10.1.454.CMB.1.raw
  modified_base (204)..(204): a, c, t, g, unknown or other
  misc_feature (204)..(204): n is a, c, g, or t
  modified_base (387)..(387): a, c, t, g, unknown or other
  misc_feature (387)..(387): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagaatgttggcagcaacttagcctggtaccagcagaaacctggccaggcctcccaggctcctcctctatgctgtcctccaccagggcccctggtcgtcccagccaggttcgtggcggtgggtctgggacagtattcactctcaccatcagcgcctccngtctgaagtatttgcttactttatttctgtcaactctatggtgtacgtcgcctccgtactacgtttcgggacccgtaggggtacccaaacgtggagtactacgaaacgtactggtgctgccactatctgtcttactcttccgttccgacc

SEQ ID NO: 219097 - DNA, 573 bp, Homo sapiens
  misc_feature: GYAE6OF01CTC1L.24.87.H10.1.454.CMB.1.raw
  modified_base (204)..(204): a, c, t, g, unknown or other
  misc_feature (204)..(204): n is a, c, g, or t
  modified_base (446)..(446): a, c, t, g, unknown or other
  misc_feature (446)..(446): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgtggcagcacttagcctggtaccagcagaaacctggccaggctcccaggcctcctcctctatgcctgtcctcccaccgacggggccccctggtcgtccccagcccgtagggttcgttgggcggttggggtctggggacaggtatttcgactctcaccatcagcgcctccagtctgagtatttgctactttatttctgtctaacactatggtnactggccttccgtactacgttttcggaccgtaggggaccctaaacgtggaagtaactaccgaaaacgacgttcggtcggctcggccacctattcgttacgttccttccaacttccgttccccgtacc

SEQ ID NO: 219098 - DNA, 534 bp, Homo sapiens
  misc_feature: GYAE6OF01EW8KZ.24.87.H10.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (400)..(400): a, c, t, g, unknown or other
  misc_feature (400)..(400): n is a, c, g, or t
  modified_base (530)..(530): a, c, t, g, unknown or other
  misc_feature (530)..(530): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggctcccaggctcctcatctatgattgtctccaacaggggtccactggccgtccccgcaggttcagtggcagtgggtctgggacagacttcactctcaccgtcagcagcctagacgcctgaagtnttttgcggtttactactgtcagcagtcgttccgcctggccgtctacgttcgggcgggggacaggggtggagaggagacgaacgtgtggctgcaccagtctgtcttcattccttcccgctactctcgaatntacg

SEQ ID NO: 219099 - DNA, 534 bp, Homo sapiens
  misc_feature: GYAE6OF01ETDWF.24.87.H10.1.454.CMB.1.raw
  modified_base (203)..(203): a, c, t, g, unknown or other
  misc_feature (203)..(203): n is a, c, g, or t
  modified_base (532)..(532): a, c, t, g, unknown or other
  misc_feature (532)..(532): n is a, c, g, or t
tcagactactatgtcacgaccggtgctcgatttagcagtactgcgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggctcccaggcctcctcatctatgatgtctccaacagggtcactggcgtccccgcaggttcagtggcaggtgggctgggacagcttcactctcaccgtcagcagcctagacgcctagaagtattttgtcggtttactactgtcagcagtcgttccgcctgggccgtcgttaacgtttcgggcggggggtaccgaggggttggaggagggagacggaacgtggtggctgcacatctgtccttcacttccttcccgctntc

SEQ ID NO: 219100 - DNA, 521 bp, Homo sapiens
  misc_feature: GYAE6OF01BDYCR.24.87.H10.1.454.CMB.1.raw
  modified_base (204)..(204): a, c, t, g, unknown or other
  misc_feature (204)..(204): n is a, c, g, or t
  modified_base (366)..(366): a, c, t, g, unknown or other
  misc_feature (366)..(366): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccaggggaaangccacctctcctgcagggccagtgagaatgttggcagcaacttgcctggtaccagcagaacctggccaggctccaggctcctctctatgctgctccacgcgggcccctggtctcccagccaggttcgttggcggtgggtctgggacagatttcactctcacntcagccgcctcagtctgtagtatttgcttactttattcttgtcaactactatgtgactggtcctccgtactcgtttcggccgtaggggacctaacgtcggatatacgaaacgacgtgtcggctgcacctatctcgtcttacacttctcccgtacc

SEQ ID NO: 219101 - DNA, 533 bp, Homo sapiens
  misc_feature: GYAE6OF01CQQMY.24.87.H10.1.454.CMB.1.raw
  modified_base (204)..(204): a, c, t, g, unknown or other
  misc_feature (204)..(204): n is a, c, g, or t
  modified_base (504)..(504): a, c, t, g, unknown or other
  misc_feature (504)..(504): n is a, c, g, or t
  modified_base (519)..(519): a, c, t, g, unknown or other
  misc_feature (519)..(519): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagaatgttggcagcaacttagcctggtaccagcagaaacctggccaggctcccaggctcctcctctatgctgtctccaccagggcccctggtcgtcccagccaggttcgtggcggtgggtctggggacagtatttcactctcacatcagccggcctccgagtctagaagtattttgctactttattctgtactaactactatggtcgactcggtcctccgtactacgttttcggccgtagggtacctaacgtggagtatacaaacgtactgtggntgcactatctgtctntactcttcccgtcc

SEQ ID NO: 219102 - DNA, 777 bp, Homo sapiens
  misc_feature: GYAE6OF01AUF51.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcattgacgcagtctccagccaccctgtctgtgtctccgaggggaangccaccctctccgtgcagggccagtgagatgttggcagcaacttgcctggtaccagcagaacctggccaggctcccgaggctcctcctctatcgctgtcctccgaccgacgggtcccctgggtccgtccccgagccctagggtttcgttgggcggttggggtcgtaggggactaggtacctttcacgttccgtaccaccgtagttccgaacggtcctaaggttcgtaacggtacggcccgttaggtaaacggttacgtttttacggaccgtttaacggttttttaacgtttacccgtttacggttacctaaccggttacccgtaaccccggtttacggtaaaccctaaacccggttacccgggtaacccccgtttaacccggttttttccccggggacccccggtttacgggggaaccccttaacgggtaacccggttacgggtaaccctaacgttaaccccgaaaccggttaaccggttcggttaccgggtaccgttacggacccctaacccgtacgtttcccgtttacggttacctttacccgtaccgtttcccccgttccccggtaaccc

SEQ ID NO: 219103 - DNA, 524 bp, Homo sapiens
  misc_feature: GYAE6OF01EZBNL.24.87.H10.1.454.CMB.1.raw
  modified_base (517)..(517): a, c, t, g, unknown or other
  misc_feature (517)..(517): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttagcctggtaccagcagaaacctggcctggctcccaggctcctcatctatggtgacgtccaccagggccacgtggcgtcgcggacaggttcagtggcagtggctttgggacagacttcactctcatcatcgacagactggacgcccgaagtatttgaagtgtattactgtcagtcttgtttcgtccctctcctctatcgtactactttcggccgtaggttccaggtcgtggacgtactacgaagcgtaacgtggtacgtctcgacactntcgttcg

SEQ ID NO: 219104 - DNA, 683 bp, Homo sapiens
  misc_feature: GYAE6OF01DJ1OI.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccaggggaaanagccaccctctcctgcagggccagtgagaatgttggcagcaacttagcctggtaccagcagaaacctggccaggctcccaggctcctcctctatgctgtcctccgaccgtacgggcccctgggtccgtccccagccgtagggtttccgttggcggttgggtcgtggggactagtactttccacttcgtccacctatccgacggccggtccctaccagtctagaagttacgttttgaccttacttttacttttccgtagttacctaaactacgttagttcgggttacgacgtttccgggtacccttacccggttaaccgttaccgtttttcggggacccggtaacggggtaaccctaaacggttcgggaacgtaaccttaacgaaaaccgtaaccggttcgggttacggtaccttacggacctaacccgtagttccgtacggtttacccgtttatacccgtttcccgttccccgtaaccc

SEQ ID NO: 219105 - DNA, 616 bp, Homo sapiens
  misc_feature: GYAE6OF01CXWQJ.24.87.H10.1.454.CMB.1.raw
  modified_base (204)..(204): a, c, t, g, unknown or other
  misc_feature (204)..(204): n is a, c, g, or t
  modified_base (414)..(414): a, c, t, g, unknown or other
  misc_feature (414)..(414): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanacgccaccctctcctgcagggccagtgagaatgtggcagcaattagcctggtaccagcagaaacctggccaggcctccgaggcctcctccctctatcgctgtcctccaccgtacgggcccctggtcgtcccagccgtaggttcgttgggcggttgggtcgtgggactagtactttcactctcacctatcagccgcctccagtctgaagtntttgcttactttatttctgtactaactactagtggtcgtacgtcggtcccttccgtaccttacgttttcgggacccgtaacggggtaaccctaaacggtggtaacgtagtaccgaaaacggtaacgtgggtacggtaccttcggacctaaccgtacttccgttacgttacctttacgtaacctttcccgttccccggtaccc

SEQ ID NO: 219106 - DNA, 530 bp, Homo sapiens
  misc_feature: GYAE6OF01ETJRX.24.87.H10.1.454.CMB.1.raw
  modified_base (203)..(203): a, c, t, g, unknown or other
  misc_feature (203)..(203): n is a, c, g, or t
  modified_base (390)..(390): a, c, t, g, unknown or other
  misc_feature (390)..(390): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccgacgggcccctggtcgtccccagccgaggttcgtgggcggtgggtctggggacagtatttcactctcacatcagcgcctcngtctgagtatttgctactttatttctgtctaactactatgtgtactggtcctccgtactcgtttcggccgtacgggaccaacgtggagatacgaaacgacgtgtcggatcgcaccatctcgtcttctctccttcccgtcc

SEQ ID NO: 219107 - DNA, 773 bp, Homo sapiens
  misc_feature: GYAE6OF01C5ADY.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagagggaaccatggaaaccccagcgcagcttctcttcctcctgctactctggctcccagccatcaccggaggaattgtgttgacgcagtctccaggcaccctgtctttgtctccgagggganagagtcaccctctcctgccagggccagtcagagtgtagcagcagcaattgcctggtaccagcagaaacctggccaggctccaggcctcctcctctatcgctgtcctccaccgacgggcccctgggtcgtccccaaggtcccgtagggtttcgttcggggccggttggggtccttaacgggggactacggtaacttttcgaccttccgtacacccgtaagttccgaacggtcccgggtccctacccgtacggttaccgttacggtaaaccgttagtttttacggtaacctttaaccttttttaacgtttttaccgttacggtttaaccctaaaccttaaccgtttaacgtttacgggtttacggtaaccgtttcgggttaccccgtttacccggtttaaccgttacccggttttttaaccggggacccgttaaccgggggtaaacccgtaaaaccggttacgggtaaacgtacgttaaccgaaaacggtaaaccgtaggttacggtaccttacggcctaaccgtaacgttccgtacggtttacttaccttaccgttccgttccccgtacccg

SEQ ID NO: 219108 - DNA, 585 bp, Homo sapiens
  misc_feature: GYAE6OF01CTA9A.24.87.H10.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (376)..(376): a, c, t, g, unknown or other
  misc_feature (376)..(376): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagccggagtgttagtaagtacttaggctggtaccaanagaaacctggccaggctcccaggctccncatctatgatcgtctccaacacgggtcacgtcggccgtccccgcaggttcaggtggcaggtggtctgggacagtacttcactctcnccgtcagcagcctagacgctagaagtattttggcgttttactactgtcagctaggtccgttccgccgtcggcccgtaccgttaacggtttccggggccggggggtaaccgtagggggtggacggagggaacggacggtaacgttggtcggcgtgccgaccgtagttcctggttccttcgtacttccctccccgactactcgtcgtaaac

SEQ ID NO: 219109 - DNA, 534 bp, Homo sapiens
  misc_feature: GYAE6OF01BD3CR.24.87.H10.1.454.CMB.1.raw
  modified_base (520)..(520): a, c, t, g, unknown or other
  misc_feature (520)..(520): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttagcctggtaccagcagaaacctggccaggctccaggctcctcctctatgctgtctccaccacgggcccctggtcgtcccagcctaggttcgtggcggtgggtcgtgggacagtattcactctcacatcacgcgcctccagtctgagtatttgctactttattctgtctaactactatcgtgtacgtcgtcctccgtactacgtttcgaccgtagggacctaacgtcggagactacgaaacgtacgtgtcggtctcgcacatctcgtcttanctccgtcccgtccg

SEQ ID NO: 219110 - DNA, 529 bp, Homo sapiens
  misc_feature: GYAE6OF01A6ET2.24.87.H10.1.454.CMB.1.raw
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacacagtctccaggcaccctgtctttgtctccagggganagagccaccctctcctgcagggccagccggagtgttagtaagtacttaggctggtaccaacagaaacctgaccaggctcccaggctcctcctctatgctgtcctccaccagggcccctggtcgtcccagccaggttcgttggcggtgggtctggggacagtatttcactctcacntcagcggcctccagtctagagtatttgctactttatttctgtctaacactatggtgactcggtcctccgtactacttttcggccgaggggaccaacgtggacgatacaacgaactgtgctgcacatctgtctctctcctcccgccatctgaac

SEQ ID NO: 219111 - DNA, 635 bp, Homo sapiens
  misc_feature: GYAE6OF01DYC9Y.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaacctggccagctccagctcctctctatcgctgtcctccaccgacgggtcccctggtcgtcccacgccgtacggttcggtcgggcggtgggtcgtgggacagtactttcactctcaccatcgacggccgtcctcgacgtctagtagttatttgcttacttttacttctgtactaactacttagtggtacgtacgtcgtccttccgttaacttccgttttcgggaccggtaacggggtaaccctaaaggtcgggtaacgtaacgttaaccgaaaacggtacgttacgggtcgggtaccgtacggtacccaacccgtaagttccgtttacgttaccctttaccgttacccgttcccgtttccccggtaacccg

SEQ ID NO: 219112 - DNA, 529 bp, Homo sapiens
  misc_feature: GYAE6OF01CASFF.24.87.H10.1.454.CMB.1.raw
  modified_base (204)..(204): a, c, t, g, unknown or other
  misc_feature (204)..(204): n is a, c, g, or t
  modified_base (437)..(437): a, c, t, g, unknown or other
  misc_feature (437)..(437): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (515)..(515): a, c, t, g, unknown or other
  misc_feature (515)..(515): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagaatgttggcagcaacttagcctggtaccagcagaaacctggccaggctcccaggctcctcctctatgctgtcctccaccgagggcccctggtcgtccccagcctaggttcgttggcggtgggtctgggacagtatttcactctcaccatcagccggcctccagtctgaagtatttgctactttatttctgtacaactactatggtnactgcctcgtactctttggccgagggtaccaagtggaagctacaaacgatggtcgntggcactntcgttcgtcttacncttcctcccgtacc

SEQ ID NO: 219113 - DNA, 581 bp, Homo sapiens
  misc_feature: GYAE6OF01EPRN1.24.87.H10.1.454.CMB.1.raw
  modified_base (206)..(206): a, c, t, g, unknown or other
  misc_feature (206)..(206): n is a, c, g, or t
  modified_base (361)..(361): a, c, t, g, unknown or other
  misc_feature (361)..(361): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaagngccaccctctcctgcagggccagtgagatgtggcagcaactgcctggtaccagcagaaacctggccaggctccaggctcctcctctatgctgtcctccaccagggcccctggtcgtcccagcctaggttcggtggcggtgggtcgtgggacaggntttcgactctcacatcagcgcctcagtctgaagtatttgactactttattctgtacactactatagtgactcggcctccgtactaccgttttgggaccctacggggacctaacgtacgggtaagactacgaaaaccggtaacgttaggttcgggtacttcggcccaacccgtattccgttacgttccctttacctaacctttcccgttcccccggtaccc

SEQ ID NO: 219114 - DNA, 521 bp, Homo sapiens
  misc_feature: GYAE6OF01A3E3A.24.87.H10.1.454.CMB.1.raw
  modified_base (388)..(388): a, c, t, g, unknown or other
  misc_feature (388)..(388): n is a, c, g, or t
  modified_base (430)..(430): a, c, t, g, unknown or other
  misc_feature (430)..(430): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagtatttcactctcaccatcagcggcctccngtctgagtatttgctactttatttctgtctaacactatggtnctggcctccgtactacgtttcggccgtaggggaccaacgtggagatcaaacgacgtgtggctgcaccntctgtcttcnctccttcccgtcc

SEQ ID NO: 219115 - DNA, 555 bp, Homo sapiens
  misc_feature: GYAE6OF01DA7W0.24.87.H10.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (513)..(513): a, c, t, g, unknown or other
  misc_feature (513)..(513): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangcccaccctctcctgcagggccagtgagaatgttggcagcaacttgcctgtaccagcagaacctgccaggctccagctcctctctangctgtcctccaccgacgggcccctggtcgtcccacgccgtaggttcggttggcggtgggtcgtggggacagtatttccactctcaccatcaggccggcctccagtctagtaagtatttcgtctactttatttctgtacaactactatggtcgactcggtcctccgtactacgtttcggccgacgggaccaacgtggagtactacaaacgacgtggtacggtntacggcaccctattctcgttcttctacttccttcccgtaccc

SEQ ID NO: 219116 - DNA, 570 bp, Homo sapiens
  misc_feature: GYAE6OF01C5CEY.24.87.H10.1.454.CMB.1.raw
  modified_base (547)..(547): a, c, t, g, unknown or other
  misc_feature (547)..(547): n is a, c, g, or t
  modified_base (554)..(554): a, c, t, g, unknown or other
  misc_feature (554)..(554): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttagcctggtaccagcagaaacctggccaggctcccaggcctcctctctatgctgtcctccaccgacgggcccctggtcgtccccgagccgtagggtttcgttgggcggtggggtcgtggggactaggtactttcacttctcaccatcacgccggcctccacgtctagtaagtatttgtctactttatttcttgtctaactactagtggtgtacgtcgtcctccgtactacgttttcggccgtacgggacctaacgtggacgtaactacgaaacgtacgtgtacgctacgcactatcgtnttacttntactccgttcccgtcc

SEQ ID NO: 219117 - DNA, 805 bp, Homo sapiens
  misc_feature: GYAE6OF01ERWE6.24.87.H10.1.454.CMB.1.raw
tcagactactatgtcacgaccggtgctcgatttagcagtactgcgttgggtttagggggaggaactgctcagttaggacccagacggaaccatggagccccagcgcagcttctcttcctcctgctactctggctcccagataccacgtggagaagtagtcatgacgctacgtctccacgcctaccctgtctgtcgtcgtaccgagggaacacgcctaccgtctcctggcagggtccaggtgagtaagtcgttacggcaagctaacgttaacgccgttggaaccaagacgacgaaaaccgtggcccacggcctcccctacggaccttacctccgttctacgtcgtctcgtaccgtcccgtaccgtaccgggaccccgttgggtccgttcccgaacggccgtaacgggtttaccggttcggggcggttaggggtaccgtaggggtaccgtaggtaactttccgaaccgttccttaccaacccgtacgtcaacggttccgaccgtttaccgacgtttacgtacggtaaacgttacgtttttacggtaacctttacgtttacgttttacctttacggttacctaacgtactacgttacggttcgtaacccgttcgggtacccttacccggtaactacccgttttacgggacccgtaacggggtaaccgtaaacgttacgggtaagtacggttaccgtaaaaccgggtaaacctaggtttccgggtacgttaccggtaccgttacccgtaaacgtttcccgtacggtttcccttaccggtttactttccccgtttaccccggttaacccg

SEQ ID NO: 219118 - DNA, 257 bp, Homo sapiens
  misc_feature: GYAE6OF01C0KES.24.87.H10.1.454.CMB.1.raw
  modified_base (256)..(257): a, c, t, g, unknown or other
  misc_feature (256)..(257): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaacatagtagtctgagcgggctggcaaggcgcatagnn

SEQ ID NO: 219119 - DNA, 534 bp, Homo sapiens
  misc_feature: GYAE6OF01CJUK3.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggcagtgagaatgtggcagcaacttagcctggtaccagcagaaacctggccaggctccaggctcctcctctatgctgtctccaccagggccccctggtcgtccccagccgaggttcgttggcggtgggtctggggacaggatttcactctcacatcagcgcctccatctgagtatttgctactttattctgtcaactactatggtgactaggcctccgtactcgttttggccgtacgggaaccaacgtggagtaatacgaaacgaactgtggactggcacactctacgtcttactacttcgttcccgtaccg

SEQ ID NO: 219120 - DNA, 1026 bp, Homo sapiens
  misc_feature: GYAE6OF01D15CY.24.87.H10.1.454.CMB.1.raw
tcagactactatgtcacgaccggtgctcgattttagcagtactgcgttgggtttgggggagggaactcgctccaggttaggacccaggacggaacctactggtaaggccccagccgcagctttctacttcctcctaggccttacctcctgggcgttacccgtagggacttaccgacgttgggtacggttaacgtttagttcctagtttcggaacggtcgtacggttcctccgtagtccctacccgttggtccttgggttcgttcgttccggaaggggggaaaacggcggtccctacccgtccgtcccgggttgaccgtaacggggccctaggttcgagtaattcggttaggcctacggacctaacctttacggcccgtttacgggtaaccccaggtaccgttaaacggaaaaccccgtttcgggaccctaaggggtccctaccccgaaggggtccccttccccgttaccggtaacgttacgtcgggtaccgtttcgggtcccttacccggaaccggtacggggttcccccttgggttcccgtttcccccgtaagggtccccggttaaggggttttccgggtttcggggggcccgggtttcggggggtttaccctttacggggggaaaccgttacggggtttaacttttttcccggaaccggttttcccggtaacccgggtaaccccgttaaggtttacccggaacgggtaccccggttaccccgttaccccggtaacggtttacccgttaaccgggtaaacggtttaaccgtttttaacccggtaaccctttaaccgtttttacgtttaccgttacgttaaccttaaaccgtacgtttacgttacggttacgtaaccgttcgggtacccgttaccggtaccgttacggtttacgggaccggtaacgggtaacctaacgtcggtaacgtacgtaaccgaaacggtacgtacggtacggtacgtacggtcctaaccgttacgttccggttacggttaccgttacgtccgttcccgttccccggtaccg

SEQ ID NO: 219121 - DNA, 499 bp, Homo sapiens
  misc_feature: GYAE6OF01EROXN.24.87.H10.1.454.CMB.1.raw
  modified_base (201)..(201): a, c, t, g, unknown or other
  misc_feature (201)..(201): n is a, c, g, or t
  modified_base (477)..(477): a, c, t, g, unknown or other
  misc_feature (477)..(477): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccaggcaccctgtctttgtctccagggganagagccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacagacttcactctcatcatcgacagactggagcccgaagattttgcagtgtattactgtcagctgtttcgtccctctcctcctatgtactctttggcctagggttccaggtctggagtntcagcgtactgtgctgctaccg

SEQ ID NO: 219122 - DNA, 626 bp, Homo sapiens
  misc_feature: GYAE6OF01ECJ23.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangcccaccctctcctgcagggccagtgagatgtgcagcaacttgcctggtaccagcagaacctggccaggcctccgaggcctcctcctctatcgctcgtcctcccaccgacgggcccctggtcgtcccgagtccgtaggttcgtgggcggttggtcgtggggacagtactttcacgtctaccgacctatccgacgtccggtcctaccgtagtctagtagttatttcgcttacttttatttcgtgttactaactactagtggtacgtacgtcgtcccgttccgttactacgtttcgggaccgtacggggaacctaacgtcgggaactaacgtaccgaaaaccggtaacgttggtacggtaccgtacggaccctaaccgtagttaccgttcgttacctttacctacctttcccgttccccgtacc

SEQ ID NO: 219123 - DNA, 562 bp, Homo sapiens
  misc_feature: GYAE6OF01CLEZ9.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggcctcccaggctcctcctctatgctgtctcccaccgacgggcccctggtcgtcccagcctagggttcgttgggcggttggggtcgtggggaccaggtatttcacttctccaccatcagccgcctccagtctgtaagtatttgctactttattcttgtactaactactagtggtgtactcgtccttccgtactacgtttcggaccgtacgggaacctaacgtggacgtactacgaaacgtacgtaggtcgtctcgcacctattctcgtcttacacttcctcccgtacc

SEQ ID NO: 219124 - DNA, 532 bp, Homo sapiens
  misc_feature: GYAE6OF01EYI20.24.87.H10.1.454.CMB.1.raw
  modified_base (204)..(204): a, c, t, g, unknown or other
  misc_feature (204)..(204): n is a, c, g, or t
  modified_base (520)..(520): a, c, t, g, unknown or other
  misc_feature (520)..(520): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcagaaacctggccaggctcccaggctcctcctctatgctgtctccaccacgggcccctggtcgtcccagccagggttcgtggcggtgggtctggggacagatttcactctcaccatcacgcgcctcacgtctgagtatttgctactttatttctgtctaactactatggtgtactggtcctccgtactacgttttcggccgaggggtaccaacgtaggagagtacgaaacgactgtcggctgcaccatctcgtcttcnctcttcccgtcc

SEQ ID NO: 219125 - DNA, 561 bp, Homo sapiens
  misc_feature: GYAE6OF01BWKLP.24.87.H10.1.454.CMB.1.raw
  modified_base (214)..(214): a, c, t, g, unknown or other
  misc_feature (214)..(214): n is a, c, g, or t
tcagactactatgtcacgaccggtgctcgatttagcagtactgcggttgggtttggggggaggaactgctcaggttaggacccagaccggaaccatggaagcccctagcgcagcttctcttcctcctgctactctggctcccagataccactggaggaagtagtcatggtacgcagtctcctagccaccctgtctgtgtctccgaggggaaagngccaccctcgtccggtgcagggccaggtgaggactggttggcagcaacttgcctggtaccagcagaaacctggccaggctcccaggctcctcctcgtactcgctgtcctccgaccgacgggcccctgggtcgtcccgacgcctaggttcgtggcggtggggtcgtggggacaggatttcactctcacctatcaggcggcctccacgtctgtaagtatttagctactttattctgtactaactacttatgtgactggcctccgtactacgttttcggccgtacgggaccaacgtggagtatacaacgtaatggtcggctggcacatactgtcttcactccttccgtcc

SEQ ID NO: 219126 - DNA, 646 bp, Homo sapiens
  misc_feature: GYAE6OF01CIB23.24.87.H10.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (380)..(380): a, c, t, g, unknown or other
  misc_feature (380)..(380): n is a, c, g, or t
tcagactactatgtcacgaccggtgctcgatttagcagtactgcgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagcccaccctctcctgcagggccagccggagtgttagtaagtacttaggctggtaccaanagaaacctggccaggctcccaggctcctcatctatatgtctaccaacngggtcacgtggccgtccccgcaggttcaggtggcaggtgggtctggggacagacttcactctcaccgtnagcagcctagacgcctagaagtattttgacggtttactactgtcagtctacgtccgttcccgccgtcgggcccgtaccgttaaccggtttccgggggaccggggggtaaccgtagggggtacgggaacgggaacggggtacggaaccggtaaacggttgggtacgggccgttcgggacctacccgtacgttccgttcggttaccttacctaccgtttcccgttcccccggacctacttccgtaagtaaacctagttacggttacgg

SEQ ID NO: 219127 - DNA, 602 bp, Homo sapiens
  misc_feature: GYAE6OF01C3BXX.24.87.H10.1.454.CMB.1.raw
  modified_base (439)..(439): a, c, t, g, unknown or other
  misc_feature (439)..(439): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagacgcccaccctctcctgccagggccagtgagatgtggcagcaacttagcctggtaccagcagaaacctggccaggctcccaggcctcctctctatgctgtcctccaccgacgggtcccctggtcgtcccgacgtccgtaggttcggtgggcgggtgggtcgtgggacagtatttccactctccgacctatcgacgccggtccctccgagtcgtagtaagtattttgcttactttntttcttgtactaactacttagtggtcgtacgtcggtcccttccgtaccttacgtttcgggaccgtacggggaaccaacggtggacgataccgaaacgtacgtacggtgtctcggcctaccgtacttcgttcgttaccttacgtacttccccgttcccgtaccc

SEQ ID NO: 219128 - DNA, 575 bp, Homo sapiens
  misc_feature: GYAE6OF01BT2U3.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatcgctgtcctccaccagggcccctgggtctcccagcccaggttcgtgggcggtggggtctggggacagtatttcactctcaccatcagcgcctccagtctgaagtattttgctacttttattccttgtactaactactagtggtcgactcggtccttccgttactaccgttttcgggacccgtaggggtaacccaaacgtgggaactacgtaacgaaaccgtaactggtcggtctacggccaccattcgttcgtctttacacttccgttccccgtaccg

SEQ ID NO: 219129 - DNA, 715 bp, Homo sapiens
  misc_feature: GYAE6OF01D0MDO.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgagggaagagccaccctctcctgcagggccagtgagatgtgcagcaacttgcctgtaccagcagaacctggccaggctccgaggcctcctcctctatcgctcgtcctcccaccgaccgggcccctggtccgtccccgacggtccgtacgggttcggttcggggtcggttcgggtcgtggggactaggtactttcgactctacaccacgttccgacggtcccggtccttacccgagttccgtaggtaacgtttactttttacggacctttaacgttttttactttaccgttacggttaacctaaacgttaccgttttaggttacgggttacggtaaccgtttccgggtacccgtttacccgttaacgtttaccggttttaccgggacccggtaaacggggtaaccctaaacggttcgggaaacgtaaccgtaaccgaaaaccggtaacgttggtaccggtactcgaccgtaacccgtattcccggtacttccttacctaccgtttcccgtccccgttaaccg

SEQ ID NO: 219130 - DNA, 643 bp, Homo sapiens
  misc_feature: GYAE6OF01B4UKX.24.87.H10.1.454.CMB.1.raw
  modified_base (206)..(206): a, c, t, g, unknown or other
  misc_feature (206)..(206): n is a, c, g, or t
  modified_base (267)..(267): a, c, t, g, unknown or other
  misc_feature (267)..(267): n is a, c, g, or t
  modified_base (453)..(453): a, c, t, g, unknown or other
  misc_feature (453)..(453): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagatgccaccggagacattgtgttgacacagtctccagcccacccttgtctttgtctccgaaggggaaancgccacctctcctgcagggccagtgacaatgttaggattgtagctggtatcaacacaaacntggccaggtcctcccggctcctcactctatgatcgactactaccaagtacggccacgtcggcaactccccaagaccgtaggtttccaggtcgggactagggttcgggtcgtaggggaactacggtactttccgaccttctaccaacctatccgagactaggttacgtaggacgtcgtagtaagttnttttagactttagttttactacgtgtacacgtacgtaccgtagtaacctaacggtccggtaccctttaccggttccggaccccgtagggaccctaacggtaccgtacggaaccgtaaccgtacccgtaaacggtactcgggttcggcctacggacctaccttacgttccttacgttcccttccgtacccg

SEQ ID NO: 219131 - DNA, 587 bp, Homo sapiens
  misc_feature: GYAE6OF01DTGKS.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagatgtggcagcacttagcctggtaccagcagaaacctggccaggctccccaggcctcctcctctatgctgtctcccaccgagggcccctggtcgtccccagcctagggttcggttggcggtgggtcgtggggacaggtactttccgacttctccaccatcagccggcctccgagtctgaagtatttgctactttatttctgtctaactactatggtgactggtccttccgtactcgttttcggaccgtacggggaacctaacgtgggaactacgtacgaaacgaacgttaggtcggtcctacggcacccgtagttccttcggttacccttcgtaaccttcccgttcccgtaccccg

SEQ ID NO: 219132 - DNA, 578 bp, Homo sapiens
  misc_feature: GYAE6OF01DH1O8.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttagcctggtaccagcagaaacctggccaggctccaggctcctctctatgctgtcctccaccgacgggcccctggtcgtccccagccgtaggttcgtggtcggtgggtctggggactaggtatttcactctcacctatcagccgcctccagtctagaagtatttgcttacgtttattctgtactaactactagtggtcgtacgtcggtcccttccgtacttaccgttttcggcccgtaaggggaacctaacgtggaagtactacgtaaacgtacgtggtcggactcggcctaccgtattccgtcgttacttcacttcccgttccccgtaccg

SEQ ID NO: 219133 - DNA, 526 bp, Homo sapiens
  misc_feature: GYAE6OF01DV8QQ.24.87.H10.1.454.CMB.1.raw
  modified_base (205)..(205): a, c, t, g, unknown or other
  misc_feature (205)..(205): n is a, c, g, or t
  modified_base (314)..(314): a, c, t, g, unknown or other
  misc_feature (314)..(314): n is a, c, g, or t
  modified_base (359)..(359): a, c, t, g, unknown or other
  misc_feature (359)..(359): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaaggggaaancgccaccctctcctgcagggccagtgagaatgtggcagcaacttgcctggtaccagcagaaacctggccaggctcccaggcctcctctctatcgctgtctccactgtcnccccgtggtctcccagtccaggttcgtggcggtggtcgtgggacngtatttcactctcacatcacgcgcctcagtctagtagtatttgctactttattctgtactaactactatggtatacgtcgtccttccgtactcgttttacgaccgtacgggtacctaacgtggagatacaaacgtacgtgtagctgctacatctntctcntctcccg

SEQ ID NO: 219134 - DNA, 543 bp, Homo sapiens
  misc_feature: GYAE6OF01D3FBC.24.87.H10.1.454.CMB.1.raw
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
  modified_base (395)..(395): a, c, t, g, unknown or other
  misc_feature (395)..(395): n is a, c, g, or t
  modified_base (502)..(502): a, c, t, g, unknown or other
  misc_feature (502)..(502): n is a, c, g, or t
  modified_base (528)..(528): a, c, t, g, unknown or other
  misc_feature (528)..(528): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagacgccaccctctcctgcagggccagtgagatgtgcagcaacttagcctggtaccagcagaaacctggccaggctccaggctctcctcatgctgtctccacncggcccctggtcgtcccagccgaggttcgttggcggtgggtctgggacagtnttcgactctcaccatcacgcggtcctccagtctgaatntttgctacttttatttctcgtcaactactagtcggtatacgtcgtcctccgtaactcgtttcggtaccgtacgggaactaacgtggagtatcgaaacgagtgtcggntggccaccgtacttcgtacgtctacncttccgtcccgtacc

SEQ ID NO: 219135 - DNA, 600 bp, Homo sapiens
  misc_feature: GYAE6OF01BGN8D.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgagggggaaanagcccaccctctcctgcagggccagtgagaatgttggcagcaacttagcctggtaccagcagaaacctggccaggctccaggctcctcctctatgctgtctccaccgacgggcccctggtcgtcccaggccgacggttcgttcggcggtgggtcgtggggacagtactttcactctcaccatcagcggcctccagtctgaagtattttgcttactttatttctgttacctaactaccttagtcggttgtactcgggtccttccggttactacgttttcgggaccgtacggggtaaccctaaacgtggtacgtactaccgtaaaccgtaacgttcggtcggtcgtacggcctacctacgttcgttcgttccttactacttcccgttcccgtacccg

SEQ ID NO: 219136 - DNA, 766 bp, Homo sapiens
  misc_feature: GYAE6OF01DOPF9.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcgagggccagtgagaatgttggcagacaacttagcctggtaccagcagaaaccgtggccaggcctcccaggcctcctcctctagtcgctcgtcctcccgaccgacgggtcccctgggtccgtccccgacggtcccgtagggtttcggttcggggcggttcggggtcgtggggactaggtacttttccacgttctcctaacctacgttccgaacgggtcccggtccccttacccgaacggttaccgttacgggtaaagtttacgttttttacggtacctttaacgttttttacgttttaccgtttacgttacctaaaccgttaaccgtttaaggttacgggttacgttaccgtttccgggtaccccgtttaccggttaacccgtttaccggtttttaccgggaccccgggtaaacggggtaacccgtaaaccgggttagggtaaacgtaacgttaaccgaaaaccggtaacgttcgggtacggtacctcggaccctaacccgttattccgttacgttaccctacgttaccttcccgttcccccgtacc

SEQ ID NO: 219137 - DNA, 259 bp, Homo sapiens; identical to SEQ ID NO: 219091
  misc_feature: GYAE6OF01DISNQ.24.87.H10.1.454.CMB.1.raw
  modified_base (256)..(259): a, c, t, g, unknown or other
  misc_feature (256)..(259): n is a, c, g, or t

SEQ ID NO: 219138 - DNA, 549 bp, Homo sapiens
  misc_feature: GYAE6OF01DFI07.24.87.H10.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (313)..(313): a, c, t, g, unknown or other
  misc_feature (313)..(313): n is a, c, g, or t
  modified_base (539)..(539): a, c, t, g, unknown or other
  misc_feature (539)..(539): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagagaccaccggagaaattgtgttgacacagtctccaggcaccctgtctttgtctccagggganagagccaccctctcctgcagggccaggccggagtgttagtaagtacttaggctggtaccaanagaaacctggccaggcctcccaggcctcctcatctatgatgtctccaacngggtcactcggccgtccccgcaggttcagtggcaggtgggtctgggacagacttcactctcaccgtcagcagcctagacgcctgaagtattttgcgtttactactgtcagcagtcgttccgccgtcggcccgtcttaacgtttccgggcgggggaccgaggggtggaggaggagacgaacgtgtggctgcaccagtctgtcttcacttccttcccgcctactctanaactgtaacg

SEQ ID NO: 219139 - DNA, 541 bp, Homo sapiens
  misc_feature: GYAE6OF01EDKZ9.24.87.H10.1.454.CMB.1.raw
  modified_base (291)..(291): a, c, t, g, unknown or other
  misc_feature (291)..(291): n is a, c, g, or t
  modified_base (448)..(448): a, c, t, g, unknown or other
  misc_feature (448)..(448): n is a, c, g, or t
  modified_base (530)..(530): a, c, t, g, unknown or other
  misc_feature (530)..(530): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagcccaccctctcctgcagggccagtgagatgttggcagcaacttagcctggtatcaacagaaacctggccaggctcccaggctcctnatctatggtatatccagcagggccagtggtcgtcccagccgtaggttcaggtggctaggtgggtctggggactaggtagtttcacttctcaccatcagctagtctgctagtctaggtaattgttttgacttagtttacttacgtgtcagtcaccgtnaaccgtacgtcggtccctacgttccggccgtcggaccagaccgtggactacgtaccgaacgtactggtcgctcgactacctntcgtcgttacc

SEQ ID NO: 219140 - DNA, 774 bp, Homo sapiens
  misc_feature: GYAE6OF01BVPDA.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagcccagcgcagcttctcttcctcctgctactctggcctcccagataccactggagaagtagtcatgacgcagtctccagccaccctgtctgtcgtctccgaaggggaancgccaccctctcctgcgagggccaggtgagtatgtggcagacaattcgctggtaccagcacgaacgtggccaggcctccgaggcctcctcctctatcgtctcgtcctcccgaccgacggtcccctggtcgcccaggtccgtaggttcggttgggcggttgggtcgtgggactaggtactttccaacgttctaccaccgtagttccgacggtcccggtaccctaccgtacgttacgttaacgggtaacgtttacgtttttacggtaaccttttaactttttaacgtttccgttacgtaaccgttaaaccgttaaacgtttacggttacgggtttacggtaaccggttcccgggtttaccctttaacccggtttaaccgttacccggtttttaccggggaacccgggtaaaccggggtaaacccgttaaacgggttacgggaaacggtaaccgtaaacccgtaaaaccggttaccggttacgggtaccggtaccttacggtacccgtaaccggttacttcccgttacgtttacccgttaccgttacccgttcccccgttcccggtaacccc

SEQ ID NO: 219141 - DNA, 567 bp, Homo sapiens
  misc_feature: GYAE6OF01AKTOF.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaanagccacctctcctgcagggccagtgagaatgttggcagcaacttagcctggtaccagcagaacctggccaggctccaggctcctcctctatgctgtcctccaccacgggcccctggtctcccagcctaggttcgtggcggtgggtctgggacagtatttcactctcaccatcgagcagtgtagacgcctgaagtatttgactagttttatacgtgtcacgctaccgtgactaacgtcggccctacgtttccggcccgttcgggaccctaggaccgtaggacctacgtcccgaaacggtaacgttcggtcggtctcggcccaccgtagttccgttcgttaccttacacttcccgttccccgtaccg

SEQ ID NO: 219142 - DNA, 517 bp, Homo sapiens
  misc_feature: GYAE6OF01ADXR9.24.87.H10.1.454.CMB.1.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
  modified_base (493)..(493): a, c, t, g, unknown or other
  misc_feature (493)..(493): n is a, c, g, or t
  modified_base (508)..(508): a, c, t, g, unknown or other
  misc_feature (508)..(508): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccagggcccctggtcgtcccagccaggttcgtggcggtgggtctgggacagatttcactctcacatcagcggcctcagtctgaagtntttgctactttatttctgtcaactactatggtgactcggccttccgtactacgttttcggccgtaggggaccaacgtggacgatcgaaacgactgtcgntgcacatctcgtctnctctccgcc

SEQ ID NO: 219143 - DNA, 680 bp, Homo sapiens
  misc_feature: GYAE6OF01DL9FQ.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangcccaccctctcctgcagggccagtgagatgtggcagcaacttgcctggtaccagcaagaaacctggccaggcctcccgaggcctcctcctctatgctcgtcctacccaccgacgggcccctggtccgtccccaggcccgtagggttcggttcggggcgggttggggtcgtaggggactaggtactttccacttccgtaccacctactccgacggccggtcccgtaccgtacggttccgttaggtaacgttacgttttcgtacctttaacgtttttactttccgttacgttacctaaaccttacgttagttcggttacgtaccgttcggttcccttaccgttacttaccgttttcgggaccgtaacggggtaaccctaaacggtgggaacgtaacgtacgaaaaccggtacgtcggtacggtactcggaccaccgtattccgttcgttaccttacctacttcccgttcccgtaccc

SEQ ID NO: 219144 - DNA, 662 bp, Homo sapiens
  misc_feature: GYAE6OF01DKYU7.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgtggcagcaacttagcctggtaccagcaagaaacctggccaggcctccccgaggcctccctctctatcgctgtcctccaccgacgggcccctggtctcccgagccgtagggttccgtgggcggttggggtcgtacggggtaccagtactttcgactcctacacctacgtcgacgggacccgtccctaccgtacgttccgtaagtaacgttagttttacgtacttaacctttttatttccttacgttacctaacgtacttaggttggtagtaccgttcggtcccttaccgttaccttacggtttttcggtaccggtaacggggtaacctaacgtagggaacgtacgtaacgaaaacgtacgtacgggtcgtacgtcgtaccgacctattccgttcgtttaccttacgtaccttcccgttcccgtaccc

SEQ ID NO: 219145 - DNA, 678 bp, Homo sapiens
  misc_feature: GYAE6OF01ANB2Q.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctccaggctcctcctctatgctgtctccaccgacgggcccctggtcgtcccagccctagggttcgttgggcggttgggtctggggactaggtactttcgacttccgtccacctatccgaggtcccggacccttcccgtagttccgtaggtaacgttacgtttttgtaccttaacgttttacttttctcgttacctaaacgtaccttaagttcgggttacgtaccgttccggtcccgttacccggttaaccgttaccgtttttacgggacccgtaacgggggtaaccctaaacggttacgggaacgtacgtaccgtaaaaccggtacgttacggtcggtacgttacggccctaccgtagttccgttacggttacctttacctacttcccgttccccggtaccc

SEQ ID NO: 219146 - DNA, 620 bp, Homo sapiens
  misc_feature: GYAE6OF01CLNVT.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttagcctggtaccagcagaaacctggccaggctccaggctcctctctatgctgtcctccaccacgggcccctgggtcgtccccagccgtaggttccgtgggcggttggggtctggggacagtatttcgactctcaccatcagccggccctccagtctagaagttattttgcttacgttttattttcgtgttacctaactacttagtgggtcgtacgttcggtacccttcccgtaaccttacgttttcgggaccgtaacggggtaacctaaacggtcggaacgtacgtaacaaaaccggtaacgtcggtacggcgttaccggacctaccgtacttacgttcgttaccttacctaccttcccgttccccgtacccg

SEQ ID NO: 219147 - DNA, 609 bp, Homo sapiens
  misc_feature: GYAE6OF01C4R74.24.87.H10.1.454.CMB.1.raw
  modified_base (204)..(204): a, c, t, g, unknown or other
  misc_feature (204)..(204): n is a, c, g, or t
  modified_base (470)..(470): a, c, t, g, unknown or other
  misc_feature (470)..(470): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgccaccctctcctgcagggccagtgagaatggttggcagctaacttacgcctggtaccagcaagaaacctggccaggcctcccgaggcctcctcctctatcgcttcgtccctccaccgacgggtcccctggtcgtcccagcctagggttcgttggggcggtgggtcgtagggactagtatttccgactctccacctatcacggccggtcctacgtacgtcgtagtacgttatttgtacttacttttacttctgtactaactagtntggttcacgtcgtccttaccgttacttacgtttacgggaccgtacggggaacctaacggtggaacgtaactaacgaaaccgtacgtggtacggctcggacctaccgtattcgtcgttactctactcccgttcccgtacc

SEQ ID NO: 219148 - DNA, 542 bp, Homo sapiens
  misc_feature: GYAE6OF01AFC6B.24.87.H10.1.454.CMB.1.raw
  modified_base (411)..(411): a, c, t, g, unknown or other
  misc_feature (411)..(411): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccgacgggcccctggtcgtccccagccagggttcgttggcggttgggtcgtggggacaggatttcgacttcgtcaccactcaggccggcctccagtctgaagtntttgctacttttatttctgtacaactactatggtgacgtcgtccttccgtactcgttttcggaccgtaggggacctaacgtgagtatacgaaacgacgtgtgcngcacatctntctcactccttccgtacc

SEQ ID NO: 219149 - DNA, 540 bp, Homo sapiens
  misc_feature: GYAE6OF01CY54G.24.87.H10.1.454.CMB.1.raw
  modified_base (204)..(204): a, c, t, g, unknown or other
  misc_feature (204)..(204): n is a, c, g, or t
  modified_base (376)..(376): a, c, t, g, unknown or other
  misc_feature (376)..(376): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttagcctggtaccagcagaaacctggccaggctccaggctcctctctatgctgtctccaccgacgggcccctggtcgtcccagccgtaggttcgttgggcggttggggtctggggactagatttcactcncacatcagccggcctccagtctagtaagtatttgtctactttactttctgtactaactactatgtgactcgtcctccgtactacgttttggccgtagggaccaacgtgagactacaaacgtatgtcggtctcgcaccatctcgtacttcactccttcccgtacc

SEQ ID NO: 219150 - DNA, 517 bp, Homo sapiens
  misc_feature: GYAE6OF01BT25R.24.87.H10.1.454.CMB.1.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
  modified_base (509)..(509): a, c, t, g, unknown or other
  misc_feature (509)..(509): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagatgttggcagcaattgcctggtaccagcagaaacctggccaggctcccaggctcctcctctatgctgtcctccaccagggcccctggtcgtcccagccaggttcgttggcggtgggtctggggacngattcactctcacatcagcgcctcagtctgaagtatttgctactttatttctgtctaacacttatggtgacgtcggcctccgtactacgttttcggccgtaggggtaccaaagtcggaagactacaaacgacgtgtgctgcacatctgtctcntctccgtc

SEQ ID NO: 219151 - DNA, 672 bp, Homo sapiens
  misc_feature: GYAE6OF01BPXF0.24.87.H10.1.454.CMB.1.raw
  modified_base (148)..(148): a, c, t, g, unknown or other
  misc_feature (148)..(148): n is a, c, g, or t
  modified_base (162)..(162): a, c, t, g, unknown or other
  misc_feature (162)..(162): n is a, c, g, or t
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (280)..(280): a, c, t, g, unknown or other
  misc_feature (280)..(280): n is a, c, g, or t
  modified_base (427)..(427): a, c, t, g, unknown or other
  misc_feature (427)..(427): n is a, c, g, or t
  modified_base (451)..(451): a, c, t, g, unknown or other
  misc_feature (451)..(451): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcccctacgatacaccngtaggaagtaagtnactagacgacgacgtacgttcccacgaccgacccctaccgttgtcgtgttcgtccgaacgggaagggaacnccaccctacctctcgngacggcgactaggagaagtagttggcacganaacttaacgtcgtcgtaacgaacacgacgaaaacgtaccgcgaaccgtcgtcccacggactcccttccctaccttatcggtcctgtccctacccaacccgacgggtcccggtcctcggtcccaccgcgtacgttgggtcggtcgggnggtcgtcggacgatcgttcttacnctcacgacttgcgcgtccgtctcgtacgtacgtaagtatttacgttactactttacttttactacgttacaactaacgtacgtggtcggtactcggtcctccgtacgttaccgtttacggtaccggaacgggtaccgtaaactaggtagacgtaacgaaacgtacgtacgtggtacgtacgacgtacacgttctcgttactctacgtccttcccgtcgtac

SEQ ID NO: 219152 - DNA, 652 bp, Homo sapiens
  misc_feature: GYAE6OF01CTD6N.24.87.H10.1.454.CMB.1.raw
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagcgccaccctctcctgcgagggccagtgagaatggttggcagcaacttagcctggtaccagcagaaacctggccaggcctccgaggcctccgtcctctatcgctgtcctccaccgacgggcccctggtcgtccccagtccgtacggttcggttcgggcggttgggtcgtgggactagtactttcactcncacagtcacggtccgcctcctagttctagtaagttntttcgtcttaacttttnttccgttntacctaactactagtggtcgtacgtcgggtcccttaccgttaccgttaccggttttacgggacccgtaacggggtaaccctaaacggtcggtaaacgtaaccgtaaccgaaaaccggttacgttacgggtcgggtacctcggtacccaaaccgttcgttccgttacgttccttaccgtaccttccgttcccccgtaccc

SEQ ID NO: 219153 - DNA, 684 bp, Homo sapiens
  misc_feature: GYAE6OF01BU7J4.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagcgccaccctctcctgcagggccagtgagatgtggcagcaacttagcctggtaccagcagaaacctggccaggcctacccaggcctcctcctctatgctcgtcctcccaccgacgggcccctggtacgtccccagccctagggttccgttggggcggttgggtcgtaggggactaggtactttccacgttctccaccacgtccgaggcccgtcctccgtacgttcgtacgtaagttacgttttcgtaccttacgttttacttttcttacgttacctaacctacttaacgttcgggtacgtacgttccggtaccgttcccgttaacgtaccgttttacgggacccgtaacggggtaaccctaaacggtacggtacgtaacgtaccgtaaaacgtaaccgttacgggttacggtaccgttacggaccgtaacccgtacttaccgttacgttaccgttactaccttcccgttccccgtaacccg

SEQ ID NO: 219154 - DNA, 669 bp, Homo sapiens
  misc_feature: GYAE6OF01C2UF4.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaangcccaccctctcctgcagggccagtgagaatgttggcagcaacttagcctggtaccagcaagaaacctggccaggcctcccaggcctccctcctctatcgcctgtcctacccgaccgacgggcccctggtccgtcccaggtccgtagggttcggttgggcggttgggtctggggactagtactttcacttctccacactcgacgccggtcctaccgtacgtccgttagtaacgttagttttacgtactttaacttttacgtttccttacggttacctaaacttacgttagttcgggttacgtaccgttcggtcccgttaccgttaacgttacggttttacgggaccggtaacggggtaacctaacggtcggaacgtacgtaaccgtaaaacgtacgtaggtacggtacgttacgcctaccgtacgttcttacgttaccttacctacttcccgttccccgtacc

SEQ ID NO: 219155 - DNA, 604 bp, Homo sapiens
  misc_feature: GYAE6OF01D6DU5.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagatgtggcagcaacttgcctgtaccagcagaacctgccaggctccagctcctctctatgctgtcctccgaccgacgggcccctggtcgtccccagcccgtagggttcggttgggtcggtgggtcgtgggactagtatttccgactctccaccctagtccacggcggtccctccgagtctagaagttacgtttgtctacttttatttcttacgtactaactacttagtcgggtgtactcggtccttaccgttaccttacgttttcgggaccgtaacggggtaacctaacgtggtaacgagtaaccgaaacgtaacgtcggtcggtctacggccaccgtactcgttcgttacttactacttcccgttccccgtacc

SEQ ID NO: 219156 - DNA, 617 bp, Homo sapiens
  misc_feature: GYAE6OF01CLIGI.24.87.H10.1.454.CMB.1.raw
  modified_base (204)..(204): a, c, t, g, unknown or other
  misc_feature (204)..(204): n is a, c, g, or t
  modified_base (396)..(396): a, c, t, g, unknown or other
  misc_feature (396)..(396): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccagggggaaanagccaccctctcctgcagggccagtgagaatgtggcagcaacttagcctggtaccagcagaaacctggccaggctccaggctcctcctctatcgctgtcctccaccacgggcccctggtcgtcccagccgtaggttcgtggcggtggtctgggacagatttcactctcacatcagcgcctcagtctgaagtnttttgcttactttatttctcgtacaactactagtagggtgtacgttcgggtcccttaccggtaaccttaccgttttcgggacccgtaacgggggaaccctaaaaccgtgggaacgtaacttaccgaaaaaccggtaacttgggtacgggtccgtacggtacccaaccgtactttccgttcggtttaccctttagaaccctttcccgtttcccccggaaccc

SEQ ID NO: 219157 - DNA, 638 bp, Homo sapiens
  misc_feature: GYAE6OF01BGTUZ.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctccaggctcctctctatgctgtctccaccgacgggcccctggtcgtccccagtccgtaggttccggttgggccggtgggtccgtggggacaggtagttcactctcaccatcagcgcctcacgtctagagtatttgactactttacttcttcgtactaactactagttggtcgtacgtggtcccttccgttaacgtaccgttttcgggacccgtaacgggggtaacccaaacggtacgggtaacgtacgtaaccgtaaaaccggtaaccgtacggtccgggtacgttaccggacccgtaacccgtagttacccgttcggtttaccctttaccgttactttccccgtttaccccgttaccccg

SEQ ID NO: 219158 - DNA, 660 bp, Homo sapiens
  misc_feature: GYAE6OF01A0IAH.24.87.H10.1.454.CMB.1.raw
  modified_base (240)..(240): a, c, t, g, unknown or other
  misc_feature (240)..(240): n is a, c, g, or t
  modified_base (456)..(456): a, c, t, g, unknown or other
  misc_feature (456)..(456): n is a, c, g, or t
tcagactactatgtcacgaccggtgctcgatttagcagtactgcgttggggtttcggggtaaggtaactggcctcagttaggacccagacgggaaaccattcggaagccccagtccgcgacgtccttcgtcttcctacctagcttactacctggtccttcccaggtacttaccctacttcgggaggtaaggtacgtcacttcgaacgctaggtcctccgacgcctaccctgtctgtgtcnccgagggaacgcgccgacctgtcctagcctagggccagtgacgtatcgtgcagctacttgcgtggtaccagacacgaaccgtgtacccaggtcctaccgacggtctccgtccgtctagtccgcgtggtcctcgaccgtcgggcccttgggtactccgagtccgaaggttcgtgggcgtgggtcctagggacacgtcttcaacgtctaccgactacncagctacgtgtaacgacgccgtagtaagtactttgccttagtttatactgtcacgtcctacgtcgaccacgtcggaccctacgtttcccgggcccgtcgggtacctacggtacgtcggaaccacgtacccgaacgtaccggtgtaccggtcgtacggtcctacctagttcgtacgttccgttacgccgttccgttcccgtcccg

SEQ ID NO: 219159 - DNA, 593 bp, Homo sapiens
  misc_feature: GYAE6OF01DA9FL.24.87.H10.1.454.CMB.1.raw
  modified_base (204)..(204): a, c, t, g, unknown or other
  misc_feature (204)..(204): n is a, c, g, or t
  modified_base (323)..(323): a, c, t, g, unknown or other
  misc_feature (323)..(323): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctccgaggggaaaangccaccctctcctgccagggccaaggtgagaatgtggcagcaattgcctggtaccagcagaaacctggccaggctccagctcctctctatcgctcgtcctccaccgacggccctggtcncccgagccgtaggttcgtggcggtggtctggggacaggtattcactcacaccagtcagccgctcagtctagacgtattgctactttattctgtactaatactagtggtacgtactcggtccttaccgtacttacgttttacgggtaccaacggggtaaccctaaacgtcggaagtaacttaaccggaaaaaccgtaagtacgtacggggtacttacggaccctaacgtaattcgttacgttacttacgttaacctccgttcccgtacccg

SEQ ID NO: 219160 - DNA, 686 bp, Homo sapiens
  misc_feature: GYAE6OF01BCJ48.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaancgccaccctctcctgcagggccagtgagatgtggcagcaacttagcctggtaccagcagaacctggccaggcctcccgaggcctcctcctctatcgctcgtcctccgaccgacgggtcccctgggtcgtccccgagccgtagggttcgtcgggtcggtggggtctggggactagtacgtttcacttctaccacctatccgacggccggtccctaccacgttcctaggtaagttagttttcgtacttacttttactttcttcgttacctaactacttagttcggtacgtacgttcgggtcccgttacccgttaccgttaccgttttacgggacccggtaacggggtaaccctaaaccggtacgggtaacgtaacgtaaccgtaaaaaccggtaaccgttagggttaccggtacgtccgtacccgtaaccgtacgttccgttacggttacctttaccgtacctttcccgtttcccccggtacccg

SEQ ID NO: 219161 - DNA, 552 bp, Homo sapiens
  misc_feature: GYAE6OF01B7E05.24.87.H10.1.454.CMB.1.raw
  modified_base (203)..(203): a, c, t, g, unknown or other
  misc_feature (203)..(203): n is a, c, g, or t
  modified_base (515)..(515): a, c, t, g, unknown or other
  misc_feature (515)..(515): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctccaggctcctctctatgctgtcctccaccacgggcccctggtcgtccccagccaggttcgtgggcggtgggtctggggacagtatttcactctcaccatcacgcgcctccagtctagaagtatttgctactttatttctgtacaactactatggtacgtacgtcggtcctccgttactacgttttcggaccgtaaggggtaccaaacgtggaagtactaacaaacgtactggtcggntacgcacctatcgtgtcttactacttccttcccgtac

SEQ ID NO: 219162 - DNA, 256 bp, Homo sapiens; identical to SEQ ID NO: 219046
  misc_feature: GYAE6OF01EOSY9.24.87.H10.1.454.CMB.1.raw
  modified_base (256)..(256): a, c, t, g, unknown or other
  misc_feature (256)..(256): n is a, c, g, or t

SEQ ID NO: 219163 - DNA, 587 bp, Homo sapiens
  misc_feature: GYAE6OF01BHMW8.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagatgccaccggagacattgtgttgacacagtctccagccaccctgtctttgtctccgaggggaaagcgccaccctctcctgcagggccagtgacaatgttaggagttgtagctggtatcaacacaaacatggccaggcctcccggctcctcatctatgatgcactccaagtcgggccacgtggcatcccagacaggttcaggtggctaggtgggtctgggacagtacttcactctcacctatcagcagtgtagacgtccgtagaagttagttttgacttagttttacttacgttgtctagtcctaccgtagaactaacgtcggtaccccttacgttttccggaccccgttagggacccgaacggtaccgtaggaacctacgtacccgaaacggtaacgtggtccggcgttacgacctaccctacgttccgttcgttcctttcgtacccg

SEQ ID NO: 219164 - DNA, 806 bp, Homo sapiens
  misc_feature: GYAE6OF01DVZKF.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgtggcagcaacttagcctggtaccagcaagaaacctggccaggcctcccgaggcctcctcctctatcgctcgtcctcccgaccgaccgggcccccttgggtccgtccccgacggtcccgtacgggtttccggttcggggtcgggttcggggttccgtggggaccgtaggtacttttccgaccttccgttacccaacccgtacgttccgaacggtcccgggtcccttacccgtacggttcccgttaaggttaaacggtttacgttttttcggtacctttaaccgttttttacttttaccgttcgttaacctaaaccttaacgtttaacgtttacgggttacgtaaccgttccgggttaccccgtttacccggttaacctttacccggtttttaccggggaccccgtaacggggggtaaaccccttaaacgggttcgggaaaccgtaacgttaacccgaaaaaccgggttaaccgttagggttacgggtaccttaccggacccgtaacccgttacgtttcccgtttacgtttaccctttacccgttacccgtttccccgtttcccccgtaaccc

SEQ ID NO: 219165 - DNA, 529 bp, Homo sapiens
  misc_feature: GYAE6OF01BEGHF.24.87.H10.1.454.CMB.1.raw
  modified_base (203)..(203): a, c, t, g, unknown or other
  misc_feature (203)..(203): n is a, c, g, or t
  modified_base (403)..(403): a, c, t, g, unknown or other
  misc_feature (403)..(403): n is a, c, g, or t
  modified_base (481)..(481): a, c, t, g, unknown or other
  misc_feature (481)..(481): n is a, c, g, or t
  modified_base (500)..(500): a, c, t, g, unknown or other
  misc_feature (500)..(500): n is a, c, g, or t
  modified_base (518)..(518): a, c, t, g, unknown or other
  misc_feature (518)..(518): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaacctggccaggctcccaggctcctcctctatcgctcgtctccaccagggccccctggtcgtccccagccgtaggttcgttgggcggtgggtctgggactgatttcgactctcaccatcagcgcctccagtctgaagtntttgctactttattctgtacatactatgtgactcggctccgtactacgttttcggccgtagggtaccaacgtgaacgntacaaacgtactagtcgtntcgcacatctgtactacnctcctcccgtc

SEQ ID NO: 219166 - DNA, 532 bp, Homo sapiens
  misc_feature: GYAE6OF01AKMOQ.24.87.H10.1.454.CMB.1.raw
  modified_base (203)..(203): a, c, t, g, unknown or other
  misc_feature (203)..(203): n is a, c, g, or t
  modified_base (409)..(409): a, c, t, g, unknown or other
  misc_feature (409)..(409): n is a, c, g, or t
  modified_base (441)..(441): a, c, t, g, unknown or other
  misc_feature (441)..(441): n is a, c, g, or t
  modified_base (509)..(509): a, c, t, g, unknown or other
  misc_feature (509)..(509): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccaccctgtctgtgtctccaggggaangccaccctctcctgcagggccagtgagaatgttggcagcaacttagcctggtaccagcagaaacctggccaggctcccaggctcctcctctatgctgtctcccgaccgacgggcccctggtcgtccccagccgtaggttcgttcgggcggtggggtcgtggggactaggtactttcactctcaccatcagcgcctcagtctgagtntttgctactttattctgtctaacactatggtncttggcctcgtactcgtttggccgtagggtaccaagtcggatatacgaaacgtagtgtgctgcacctntcgtgttctctcttccgtccgtc

SEQ ID NO: 219167 - DNA, 545 bp, Homo sapiens
  misc_feature: GYAE6OF01B9GUE.24.87.H10.1.454.CMB.1.raw
  modified_base (203)..(203): a, c, t, g, unknown or other
  misc_feature (203)..(203): n is a, c, g, or t
  modified_base (366)..(366): a, c, t, g, unknown or other
  misc_feature (366)..(366): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
  modified_base (521)..(521): a, c, t, g, unknown or other
  misc_feature (521)..(521): n is a, c, g, or t
  modified_base (533)..(533): a, c, t, g, unknown or other
  misc_feature (533)..(533): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggcctcccaggcctcctcctctatgctgtcctccaccgacgggcccctgggtctccccagccaggttcgtggcggtgggtctgggacaggtnttcactctcacatcaggcgcctcagtctgagtntttgctactttnttctgtactaactactatggtacgactcggtcctccgtacttaccgttttcgggaccgaacggggtaccaaacgtggacgtatacgaaacgtacgtgtcggctggcacgntcgtctcttacncttcctccgtcc

SEQ ID NO: 219168 - DNA, 615 bp, Homo sapiens
  misc_feature: GYAE6OF01BOBJB.24.87.H10.1.454.CMB.1.raw
  modified_base (208)..(208): a, c, t, g, unknown or other
  misc_feature (208)..(208): n is a, c, g, or t
  modified_base (391)..(391): a, c, t, g, unknown or other
  misc_feature (391)..(391): n is a, c, g, or t
tcagactactatgtcacgaccggtgctcgatttagcagtactgcgttggggtttgggggaggaactgactcagttaggacccagacggaaccatggaagccccagccgcagcttctcttcctcctgctactctggccttcccagataccactggagaagtagtcatgacgcagtctccagccacctgtctgtgtctccgaggggaaancgccaccctctccgtgcagggcccaggtgagatggttggcagcaacttgcctggtaccagcagaacctggccaggcctccaggcctcctcctctatgctgtcctccaccacgggccccttggtcgtccccgagcctaggttcgtggcggttgggtctgggacagtctttcgactctacacctntcgacggccggtcctccgacgtctagtaagtactttcgacttactttatttctagtaccaacgtacttagtggtcgactcgggtcccttccgtaccttacgttttccggacccgtaacgggaaccctaacgtacggacgtacgtacgtaaacgtactcggtacggtcgtacgacctacctattaccgttcgttaccttaccgtacgttcccgttcccggtaccc

SEQ ID NO: 219169 - DNA, 627 bp, Homo sapiens
  misc_feature: GYAE6OF01BT3EK.24.87.H10.1.454.CMB.1.raw
  modified_base (400)..(400): a, c, t, g, unknown or other
  misc_feature (400)..(400): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttagcctggtaccagcagaaacctggccaggctcccaggctcctcctctatgctgtcctccaccacgggcccctggtcgtcccagccgtaggttcgttggcggtgggtctgggcagatttcactctcaccatcagcggcctcagtctgaagtnttttcgctactttatttcttgtactaactactagtggtcgtactcggtccttccgttaccttaccgttttcgggacccgtaacggggtaaccctaaacggtgggtaacgtaacgtaaccgtaaaaccggtaacgttacgggtacggtaccgtcggtaccctaaacccgtaacgttacccgtttcggttaccctttaccgtacctttccccgttccccccggtaaccc

SEQ ID NO: 219170 - DNA, 523 bp, Homo sapiens
  misc_feature: GYAE6OF01BBUDA.24.87.H10.1.454.CMB.1.raw
  modified_base (398)..(398): a, c, t, g, unknown or other
  misc_feature (398)..(398): n is a, c, g, or t
  modified_base (431)..(431): a, c, t, g, unknown or other
  misc_feature (431)..(431): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagatgttggcagcaacttagcctggtaccagcagaaacctggccaggctcccaggctcctcctctatgctgtctccaccacgggcccctggtcgtcccagccagggttcgtggcggtgggtcgtgggacagtatttcactctcaccatcagccgcctcagtctgaagtntttgctactttattctgtctaactactagtgtnactcggcctccgtactacgtttcggccgtaggggaccaacgtggagatacaaacgactggtcgntcgcaccntctgtcttcatcctccgtcc

SEQ ID NO: 219171 - DNA, 588 bp, Homo sapiens
  misc_feature: GYAE6OF01AXNNT.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccaggggaaangccaccctctcctgcagggccagtgagaatgttgcagcaacttgcctggtaccagcagaacctggccaggcctccaggcctccctcctctatcgtctcgtcctccaccgacgggtcccctggtcgtccccagtccgtagggttccgtgggccggtgggtctggggacagtactttcgactctcacctatcgaggccggcctccgagtctagacgttatttcgcttactttattctacgtactaactactagtcgtgtactcgtcctcgtactcgtttcggaccgtacgggtacctaacgtcggtacgtacgtacgaaacgtacgtaggtcggtactacggccaaccgtatcgttacgttcttacctacttccgttcccgtaccg

SEQ ID NO: 219172 - DNA, 556 bp, Homo sapiens
  misc_feature: GYAE6OF01B8Y4O.24.87.H10.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (368)..(368): a, c, t, g, unknown or other
  misc_feature (368)..(368): n is a, c, g, or t
  modified_base (401)..(401): a, c, t, g, unknown or other
  misc_feature (401)..(401): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctntcctgcagggccagtgagaatgttggcagcaacttagcctggtaccagcaagaaacctggccaggcctccgaggcctcctcctctatgctcgtctccaccgacgggcccctggtcgtcccgagccgtaggttcgttggcggtggctgggacagtnttcactctcacatcagcgcctcagtctgaagtntttgcttacttttattctgtacaactactagtggtcgacgttcgccttcgtactcgtttcggaccgagggtaccaacgtggaactctaacgaaacgtacgtcgtcggactgccaacctatccgttacttacttccgaattcccgttccccgtacc

SEQ ID NO: 219173 - DNA, 543 bp, Homo sapiens
  misc_feature: GYAE6OF01AHU5M.24.87.H10.1.454.CMB.1.raw
  modified_base (203)..(203): a, c, t, g, unknown or other
  misc_feature (203)..(203): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (507)..(507): a, c, t, g, unknown or other
  misc_feature (507)..(507): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanacgccaccctctcctgcagggccagtgagatgtgcagcaacttgctggtaccagcagaacctggccaggctcccaggcctcctcctctatgctcgtctccaccacgggcccctgggtcgtccccagccaggttcgtgggccggtagggtctggggacaggtattcacgttcncaccntcgagccgcctcgngtctgagtntttcgcttactttattctgtaccacgtattatggtcgacttcggaccttcgtactcgttcgccgtagggaccaacgtgacgtatacgtaaaccgaggtgtcggntacgcaccgtatccgtgtcttcacttctcccgtacc

SEQ ID NO: 219174 - DNA, 558 bp, Homo sapiens
  misc_feature: GYAE6OF01CVUXS.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagngccaccctctcctgcagggccagtgagaatgttggcagcaacttagcctggtaccagcagaaacctggccaggctcccaggctcctcctctatgctgtcctccaccgacgggcccctggtcgtccccagcctagggttcgttgggcggtgggtctggggacagtatttcactctcaccatcacgcgcctcagtctagaagtatttgtctactttattctgtactactactatgtgactcggtcctaccgtactacgtttcggccgtagggtacctaacgtggagtactacaaacgtactcgtggtctcgccaccgtattccgtcgttccttactacttccgttccccgtaccg

SEQ ID NO: 219175 - DNA, 719 bp, Homo sapiens
  misc_feature: GYAE6OF01CY0MT.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangcccaccctctcctgcagggccagtgagaatgttggcagcaacttagcctggtaccagcaagaaacctggccaggcctcccgaggcctcctcctctatcgctcgtcctcccaccgacgggtccccttgggtccgtccccgacggcccgtagggttccggttgggcgggttggggtcgtggggacctaggttacttttccactttcctcgtaaccctagttccgacggcccgggtaccctaccgtacgtcgtacgtaacgttacgttttacgtacctttactttttacgtttccgttacgttacctaaacgttaccttagttacggttacgtaccgttacggtcccgttacccgttaaccgttacggtttttaccgggacccggtaacggggtaaccctaaacggtacgggaacgtaacgtaaccgaaaaccgtaacgttacggtacgggtaccgtacggaccctaacccgtacgttacgttcgttaccttactaccttccccgttccccgtaccc

SEQ ID NO: 219176 - DNA, 560 bp, Homo sapiens
  misc_feature: GYAE6OF01E1OGQ.24.87.H10.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgtgcagcaacttagcctggtaccagcaagaaacctggccaggctccaggctcctccnctatgctgtcctccaccacgggcccctggtcgtcccgacgcctagggttcgtgggcggtgggtctgggatagtntttcactctcaccatcagcggcctccagtcagtagtatttgcttactttatttctgttcaactactagttggtactacgtcggcccttccgtaccttaccgttttcgggacccgtacggggacctaagtcggagtactacgaaaaccgagtggtcgntcgcacctntcgtcgttacttctacttcctccgtacc

SEQ ID NO: 219177 - DNA, 673 bp, Homo sapiens
  misc_feature: GYAE6OF01BU61O.24.87.H10.1.454.CMB.1.raw
  modified_base (204)..(204): a, c, t, g, unknown or other
  misc_feature (204)..(204): n is a, c, g, or t
  modified_base (653)..(653): a, c, t, g, unknown or other
  misc_feature (653)..(653): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangcccaccctctcctgcagggccagtgagaatgttggcagcaacttagcctggtaccagcagaaacctggccaggcctccaggcctcctcctctatgctgtcctccaccgacgggccccctggtcgtccccaggtccctagggttccgtcgggcggttggggtcgtggggactaggtactttcgacttccgtacacctattccgaggccgggccctacccgagttccgtaggtaacgttacttttcgaccttaacgttttatttccgttacgttacctaaacctacttagttcggttcgtaaccgttcgggtacccttcccgttacgttaccgttttcgggacccgtaacgggggtaaccctaaacggtggaacgtaacgtaaccgtaaaaccggtaaccgttgggtacggtccgtacggacccaccgtattccgttcgttcctttaccncttcccgttccccgtaaccg

SEQ ID NO: 219178 - DNA, 605 bp, Homo sapiens
  misc_feature: GYAE6OF01EG9F3.24.87.H10.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (364)..(364): a, c, t, g, unknown or other
  misc_feature (364)..(364): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgcccaccctctcctgcagggccagtgagatgtgcagcaacttagcctggtaccagcaagaacctggccaggctccaggctcctcctntatcgctcgtctccaccgacgggtcccctggtcgtcccagccgtaggttcgtggcggtggtcgtggacagtntttcactctacactatcgacgccgtcctccacgtctagaacgttagttttcgcttactttactttcttcgtactaactactatggtcgtacgtcgtcctccgttacgtacgtttcgggaccgtaaggggtaaccctaacggtacggaacgtacgtaaccaaaacggtaagttcggtacggtctacgtaccgtaacctacgttccgttacggttccttactaccttcccgttccccgtaccc

SEQ ID NO: 219179 - DNA, 794 bp, Homo sapiens
  misc_feature: GYAE6OF01ACZMC.24.87.H10.1.454.CMB.1.raw
  modified_base (298)..(298): a, c, t, g, unknown or other
  misc_feature (298)..(298): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaacagccacctctcctgcagggccagtgagaatgttggcagcaacttagcctggtacccagcagaaacctggccaggctcccaggcctcctcctctancgctctctccaccgacgggtcccctggtccgtcccaggccgtaggttccggttcgggcggttgggtcgtcggggtacctaggtactttccgacgttcctaccgtaacctaacgttccgaacggtcccgggtacccgttacccgtaacggttcccgttaaggtaaacggtttacgtttttacggaccgtttaaccttttttaacgttttacccgttacggttaacctaaaccgttaaccgtttaacgttaccgggttacggtaaccggtttcccgggtaacccgtttaccccggttttaaccgttaaccggttttttaccggggacccgggttaaaccgggggtaaacccctaaacgggttacggaaacgtaaccgttaaccgaaaaaccgggtaaccgtacgggttcgggaccgtttacggaccccgtaaccgttaacgttacccgttacggttaccctttacctaaacccgttcccgtttacccccggtaacccg

SEQ ID NO: 219180 - DNA, 558 bp, Homo sapiens
  misc_feature: GYAE6OF01BG0RY.24.87.H10.1.454.CMB.1.raw
  modified_base (291)..(291): a, c, t, g, unknown or other
  misc_feature (291)..(291): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagatgttggcagcaacttagcctggtatcaacagaaacctggccaggctccaggctcctcntctatggtatatccagcagggccactggtctcccgagccaggttcaggtggctaggtgggtctggggacagtacgttcacgttctccaccatcacgcagtctgctagtctagtaacgtagttttgtcgttagtttacttacgtcgtacctagcagcctacgtagtcgtacgtcggcccgtcgttcgtacgtttccgggacggtaacgggacccgtaagggtaggagtacgtacgaaacggaacgtggtacggactcggctacgtacg

SEQ ID NO: 219181 - DNA, 578 bp, Homo sapiens
  misc_feature: GYAE6OF01BFO4P.24.87.H10.1.454.CMB.1.raw
  modified_base (203)..(203): a, c, t, g, unknown or other
  misc_feature (203)..(203): n is a, c, g, or t
  modified_base (330)..(330): a, c, t, g, unknown or other
  misc_feature (330)..(330): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (401)..(401): a, c, t, g, unknown or other
  misc_feature (401)..(401): n is a, c, g, or t
  modified_base (439)..(439): a, c, t, g, unknown or other
  misc_feature (439)..(439): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagatgtggcagcaactagcctggtaccagcagaaacctggccaggctcccaggcctcctcctctatgctgtcctccaccgacgggcccctggtcgtccccnggcctagggttccgtgggcggtgggtctgggacagtntttcactctcaccntcagcgcctcagtctgaatnttttgcttactttattctgtactaactacttagtggtntaccgtggtcccttccgtacttacgttttcggaccggtaaggggacccaaagtcggaagtactaccgaaaacgtaactgggtacggctacgccaccgtattccgttacgttcctttacactttcccgttccccgtaccc

SEQ ID NO: 219182 - DNA, 551 bp, Homo sapiens
  misc_feature: GYAE6OF01AZLCD.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatgccaccggagacattgtgttgacacagtctccagccaccctgtctttgtctccgaggggaaanagccaccctctcctgcagggccagtgacaatgttaggaattgttagcctggtatcaacacaaacatggccaggctcccggctcctcatctatgatgcatccaagacgggccactggcatcccagacaggttcagtgcagtggtctgggacagacttcacttcacaccatcagcagtgtagagtcctagaagtatttagctagtttattactgtacagcgtaccgtacgaactaacgtcggtaccctacgtttccggccttacgggacctacgtacgtcggaactacgtacccgaacgtaactcggtggcctacgacgtaacccacgttactcgttacttcgtacccg

SEQ ID NO: 219183 - DNA, 573 bp, Homo sapiens
  misc_feature: GYAE6OF01BCS1V.24.87.H10.1.454.CMB.1.raw
  modified_base (203)..(203): a, c, t, g, unknown or other
  misc_feature (203)..(203): n is a, c, g, or t
  modified_base (460)..(460): a, c, t, g, unknown or other
  misc_feature (460)..(460): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagatgttggcagcaacttgcctggtaccagcagaacctggccaggctcccaggctcctcctctatcgctgtcctccaccgacgggtcccctggtcgtccccagccctagggttcggttgggcgggtggggtcgtggggacctagtactttcacttcctccacctatcgacgtccggccctccagtctagtaagtattttcgcttactttatttctgtacaactctagtggtntactcgccttccgtactacgtttcggccgaacgggtacctaacgtggaatagtacaaacgtacgtgtcggtctcggcacctatctcgttcttactacttccgttccccgtacc

SEQ ID NO: 219184 - DNA, 571 bp, Homo sapiens
  misc_feature: GYAE6OF01B5JCL.24.87.H10.1.454.CMB.1.raw
  modified_base (203)..(203): a, c, t, g, unknown or other
  misc_feature (203)..(203): n is a, c, g, or t
  modified_base (410)..(410): a, c, t, g, unknown or other
  misc_feature (410)..(410): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctccgaggggaaanagccacctctcctgcagggccagtgagaatgtgcagcaacttagctggtaccagcagaactggccaggctccaggctcctcctctatgctgtcctccaccgacgggcccctggtcgtcccgagccgtagggttcggttgggcggttggtcgtgggactagtatttcgacttctcacagtcacgccggacctcgacgtctagtaagtntttgacttacgtttatttctgtactaactactatggtgacgtcgtcctccgtactcgtttcgggaccgagggtaactaacgtggaacgactacgaaacgtactacggtcggatcgaccgtacctagttcgtacgttcttacgtacttccgttccccgtacc

SEQ ID NO: 219185 - DNA, 658 bp, Homo sapiens
  misc_feature: GYAE6OF01EZIBX.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttagcctggtaccagcagaaacctggccaggctcccaggctcctcctctatgctgtcctcccaccgacgggcccctgggtcgtccccagcccgaggttccgttgggcgggttggggtcgtggggacaggtactttccgacttctccaccctatccaggtccggccctccacgttctaggaagtattttgacttacttttatttctgttacctaaactacttagtggtgtaccgtcggtcccttccgttacgttaccgttttcggggacccgtaacgggggtaaccctaaacggtcgggaacgtacgttaaccgaaaaccggtaaacgttgggtaccgggtacctacgggtacctaacccgtagttcccgtttcggttacctttaccaactttccccgttccccgtaccccg

SEQ ID NO: 219186 - DNA, 783 bp, Homo sapiens
  misc_feature: GYAE6OF01BLOIT.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagctccagcgcagcttctcttcctcctgctactctggctcccagataccactggagaagtagtcatgacgcagtctccagccaccctgtctgtgtctccgaggggaaanacgccaccctctcctgcagggccagtgagatgtggcagcaacttgcctggtaccagcaagaacctggaccaggcctcccgaggcctcctcctctatcgctgtcctccaccgacgggtcccctgggtccgtcccgaggcccgtagggtttccggttgggccgggttcggggtcgtacggggactacggttacttttccgaacttcccgtacctaacccgtacgttacccggaacgggtcccgggtaccccttacccggtaaccggtttacccgttacgggttaaaacgtttacgtttttacggtacccgttttaaaccgtttttttaacgttttccgttacggttaacctaaaccgttaacgtttaaggttcgggtttacgtaaccggtttccgggtaccccgtttacccggttaaccgtttaccggtttttaccggggacccggtaaaccgggggtaaccctaaaccggttcgggtaacgtaacgtaaccgtaaaaccgtaaccggttcggttacggacctcggaccctaaccgtacgttccgttacgttaccctttcctaccgttcccgttacccccg

SEQ ID NO: 219187 - DNA, 892 bp, Homo sapiens
  misc_feature: GYAE6OF01CI2OW.24.87.H10.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagcccacctgtctgtcgtctccgaggggaaancgccacctctccngcgaggccagtgagatgtgacagctaagtgccgtgaccagcaagaaaccgtggccaggcctccgacggtcctctcctctagtcgctcgtcctaccgaccgaccgggcccctggtccgtaccccgacggtccgttacgggtttcggttcggggtccgggttcggggtcgttagggggaactacgggttactttacccgaccttacccgtacctaacctaagtcccgacgggtccccggtacccttacccggtaacgttaccggttaacgggtaaacgttttacgtttttacggtaccttttaacgtttttaccgttttacgttaccgttaaaccctaaaccgtttaacccggtttaggttaccgggttaacccgttacggtttaccccggtaccccgttttttaaccccgttaaccggtttttaaacccgggtttttaccccggggggaaacccgggttaaacccgggggttaaaacccctaaaaccgggttcggggtaaaaccgttaaaccgggttaaaacccgtaaaaaccggttaaccggtttacggggtaccgggtacccggttaaacccgtaacccgttaaaccccgtttacgtttaacccggggtttccgttttacccccttaaacccgtttcccgttttcccccggttacccccggtttaaaccccg

SEQ ID NO: 219188 - DNA, 568 bp, Homo sapiens
  misc_feature: GYAE6OF01EIG6T.24.87.H10.1.454.CMB.1.raw
  modified_base (203)..(203): a, c, t, g, unknown or other
  misc_feature (203)..(203): n is a, c, g, or t
  modified_base (367)..(367): a, c, t, g, unknown or other
  misc_feature (367)..(367): n is a, c, g, or t
  modified_base (526)..(526): a, c, t, g, unknown or other
  misc_feature (526)..(526): n is a, c, g, or t
  modified_base (538)..(538): a, c, t, g, unknown or other
  misc_feature (538)..(538): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaagngccaccctctcctgcagggccagtgagaatgttggcagcaacttgcctggtaccagcaagaaacctcggccaggctcccaggcctcctcctctatgctcgtctccaccacggcccctggtcgtcccacgccgtaggttcgttggcggtgggtcgtgggacagtntttcactctcaccatcagccggtcctccgattcgtagaagttattttcgcttacttttatttctgttactaactcttagtgtgtacttcggcctccgtactcgttttcggaccgtacggggtaaccaacgtggacgtataccgaaacgacgtgtcggtntaggccaccgtntcgttctacttacacttcccgtcccgtacc

SEQ ID NO: 219189 - DNA, 621 bp, Homo sapiens
  misc_feature: GYAE6OF01A9KZ8.24.87.H10.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctccngcagggccagtgagatgtggcagcaattgcctggtaccagcagaacctggccaggctccaggcctcctcctctatcgctgtcctccaccgcgggcccctgggtctcccagtcctagggttcggtcggcggtgggtcgtggggacagtcgtttcactctcacntcagccgcctccagtctagtaagtntttgctactttattctgtacctaactcgtagtcggtacgtcgtccggtcccttccgtacttaccggttttcggacccggtaacgggtaaccctaaacggtcgggtaacgtaacgtaccgtaaaacggtaccggttacggtcgggtaccctgggaccctaacccgtacttaccgttccggttaccctttacctaccgttccccgttcccggtaacccc

SEQ ID NO: 219190 - DNA, 792 bp, Homo sapiens
  misc_feature: GYAE6OF01DGH9G.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctaccgaaggggaaagcgcccaacccttctccctggccgaacggggccaaggttgaagtaaatggttaggcaggcgtaaacttggcctaggaccagacgaacgaaaaccgtggaccgaacggtcctacccgacggtcctaccgtcctctatcgtctcgtcctaccgaccgtccgggtcccctggtccgtcccgacgtccgtacgggttcggttcgggcgggttcggtcggttagggaactagtacgtttccgacctctaccaccgtactccgtacggcccggtccctaccgtacgttaccgtaggtaacgtttacgttttccggacctttaaccgttttacgttttccctacggtacccttaaaccgtactttaaggttcgggtacccgttaacggcccgggttaacccgttccggttaaccctttaccgggttttccggggaacccggttaaaccgggggtaaaccctaaaccgggtagggtaaaacccgtcgtaaaacccggtaaaacggttaccgtacgggttacgaccggttacgacccgtaaaccgttcgtttaaccgttccgttacttaccgtccgtttccccgtaccccgtaaccg

SEQ ID NO: 219191 - DNA, 704 bp, Homo sapiens
  misc_feature: GYAE6OF01B5ZDG.24.87.H10.1.454.CMB.1.raw
  modified_base (670)..(670): a, c, t, g, unknown or other
  misc_feature (670)..(670): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctcgaggggaaagacgccaccctctcctgcgacgggccagtgaagtaatggttggcagactaacttacgccgtaggtaacccaggacaaacggaaaaccgtgggacccaacgggcctaccccgaaggtcccttcctccctactatcgccttcgtccctaccgacccgtacgggtcccccgtagggtccgtacccacggccgttacgggtttcggttcggggcggttcggggtcgtaggggactaggtactttcgacttctaccacgtatccgacgtccggtcctaccgtacgttctaggtaacgttcttttacggtacctttaacttttaacgtttctacgtactaaactacgtttactggtacgtacgttccgtacccgttaccgttacgttacgttttcgggacccgtaacggggtaaacctaacggtggaacgtaactaacgtaaaacgtacgtggtacggtctacggtccaccgtnttccgtagttacttactacttcccgtcccgtacc

SEQ ID NO: 219192 - DNA, 621 bp, Homo sapiens
  misc_feature: GYAE6OF01C74KG.24.87.H10.1.454.CMB.1.raw
  modified_base (204)..(204): a, c, t, g, unknown or other
  misc_feature (204)..(204): n is a, c, g, or t
  modified_base (430)..(430): a, c, t, g, unknown or other
  misc_feature (430)..(430): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtataagaagcaaactcttagcctggtatacaacagaaacctggccaaggctcccaggctcctcatctatggtatatccagcagggccacgtggtcgtcccacgcctaggttcaggtggacgaggtcgggtactggggactaggacgtttcaccgttctccacccactcacgctagtctcgctagtcttagaagttnttttgtacttaagttttactttaccgttgaccgtagacgagccaacgttagtcgacgttcggtcccgtcgttaccgtacggtttaccggggccgggtaacggggaaccggtaacggggtagggaacggttaacgtaaccgtaaaacggtaacggttcggtacgggtccttaccggccgtacccgttaccgg

SEQ ID NO: 219193 - DNA, 845 bp, Homo sapiens
  misc_feature: GYAE6OF01DKLRY.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaancgcccaccctctcctgcgagggccagtgagaatggttggcagcaacttgctggtaccagcaagaaacctggccaggcctcccgaggcctcctctctatcgctgtcctaccacccgacgggtccccctgggtccgtaccccgacggtacccgttacgggttttcggttcgggggtccggggtttacgggggttcccgttagggggggaacctaacgggttaacttttttacccggaaccgtttccctacccgtaaaccctaacggttacccgaaccgggtccccgggtccccccgttaacggttaccggttacggttaaacggttaaacgttttttacgggtttcccgtttaaaccgttttttaacttttttaaccgttttccggtttaaccgttaaacctttaaaacccgttaacggttttaccggggttagggtttaacccggttacccgggtttcccggtttaaccccgtttaacccgtttaaccgttttccgggtttaaccgggacccgggtaaacccgggtaaccgtaacgggtacgtaacgtaaccgtaaaccggtaaacggttggtacgggtaccgtcggtacaccctaacgttcttccgttccttacttactacccgttccccgtaccgtacg

SEQ ID NO: 219194 - DNA, 258 bp, Homo sapiens; identical to SEQ ID NO: 219036
  misc_feature: GYAE6OF01DVWJE.24.87.H10.1.454.CMB.1.raw
  modified_base (256)..(258): a, c, t, g, unknown or other
  misc_feature (256)..(258): n is a, c, g, or t

SEQ ID NO: 219195 - DNA, 583 bp, Homo sapiens
  misc_feature: GYAE6OF01AF1KI.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagatgttggcagcaattgcctggtaccagcagaacctggccaggctccaggctcctcctctatcgctgtcctcccaccgacgggcccctggtcgtccccagtccgaggtttcggttggggccggttggggtcgtggggactagtactttcactctcacctatcagccggcctccacgtctgtaagtactttgcttactttatttcttcgttactaactacttatggttgtacgtcggtaccttccgttacgtaccgttttcgggacccgtaggggaccctaacgtcggtaagactacgtaaacgtaactggtcggctcgcacctatcttcgtcttactccttccttcccgtacc

SEQ ID NO: 219196 - DNA, 567 bp, Homo sapiens
  misc_feature: GYAE6OF01C8KVJ.24.87.H10.1.454.CMB.1.raw
  modified_base (204)..(204): a, c, t, g, unknown or other
  misc_feature (204)..(204): n is a, c, g, or t
  modified_base (530)..(530): a, c, t, g, unknown or other
  misc_feature (530)..(530): n is a, c, g, or t
tcagactactatgtcacgaccggtgctcgatttagcagtactgcgttgggtttgggggaggaactgctcagttaggacccagacggaaccatggaagccccagcgcagattctcttcctcctgctactctggctcccagataccactggagaagtagtcatgacgcagtctccagccaccctgtctgtgtctccgaggggaaangcccaccctctcctgcagggccagtgagaatgtggcagcacttgcctggtaccagcagaaacctggccaggcctccgaggcctcctcctctatgctgtcctccaccgacgggcccctggtcgtccccagccgtagggttcgttgggcggttgggtcgtgggactagtatttcacttctcaccatcgacggccgcctcctacgtctagtaagtatttgtcttacttttacttcttgtactaactactagtggtgtacgtcggtcctccgtactacgtttcggccgtacgggaacctaacgtggagtatacgaaacgtactggtcgtntcgcacctatcgttcttacttctctccgtcccgtacc

SEQ ID NO: 219197 - DNA, 537 bp, Homo sapiens
  misc_feature: GYAE6OF01AZ5N8.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtgacaatgttaggagttgttagcctggtatcaacacaaacatggccaggcctccccggctcctcatctatgatgcatccaagtacgggccacgtggcactccccagacaggttcagtggcaggtgggtctgggacagtacttcactctcaccatcagcagtgtagacgtctagaagtatttgcttagtttatactgtcagcacgtgactacgtcgtccctacgttccggccgtcggacctacggacgtcggacctacgtaccgaacggtacttcggtcggtactcggacctaccgtatccttgtccttcc

SEQ ID NO: 219198 - DNA, 548 bp, Homo sapiens
  misc_feature: GYAE6OF01DBW2J.24.87.H10.1.454.CMB.1.raw
  modified_base (219)..(219): a, c, t, g, unknown or other
  misc_feature (219)..(219): n is a, c, g, or t
  modified_base (505)..(505): a, c, t, g, unknown or other
  misc_feature (505)..(505): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccacctgtctgtgtctccgaggggaaagcgcccaccctctccngcgagggccagtgagaatgttggcagcaacttgcctggtaccagcagaaacctggccaggctccaggctcctcctctatgctgtctccaccagggcccctggtcgtcccagccgaggttcgttggcggttggtcgtggggacagtagtttcactctcacatcagcgcctcgagtctgaagtatttgctactttattctgtactaactactatgtgactcgtcctccgtacgtacttttggccgtacgggtactaacgtggagtagtaacaacgtaactggtcggtntacgacaccattcgttcgtacttcaactcccttcccgtacccg

SEQ ID NO: 219199 - DNA, 639 bp, Homo sapiens
  misc_feature: GYAE6OF01EEM72.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcaagaaacctggccaggctccaggctcctcctctatgctgtcctcccaccgacgggcccctggtcgtccccagccgtaggttccgtggcggtgggtctgggacagatttcactctcaccatcagccggtcctccagtctagaagtattttcgcttactttatttcctgtactaacgtactagttggtgtacctcggtaccttccgttactaccgttttcggacccgtaacgggggtaaccctaaacgtacgggtaacgtaacgttaaccgtaaaaccggtaaaccgttaggtacgggtaccttacggtaccctaaccccgtatttacccgttacggtttacctttaccgttaccgttaccccgttccccgtaaccccg

SEQ ID NO: 219200 - DNA, 635 bp, Homo sapiens
  misc_feature: GYAE6OF01D6JHG.24.87.H10.1.454.CMB.1.raw
  modified_base (417)..(417): a, c, t, g, unknown or other
  misc_feature (417)..(417): n is a, c, g, or t
  modified_base (586)..(586): a, c, t, g, unknown or other
  misc_feature (586)..(586): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagacgccaccctctcctgcagggccagtgagatgtgcagcatagctggacagcagaacctggccaggcctccaggcctcctcctctatgcctgtcctcccaccgacggggccccttgggtccgtcccacggtccgtacgggtttcggttggggtccgggtggggtcgtggggacagtatttcactctcacatcagccgcctcagtctagtaagtnttttgcttacttttcttctgttacctaactacttagttgggttcgtaccgttcgggtcccttacccgttacttacgttttcggggaccgtacggggtaacctaacggtagggaacgtaagtacgtaaaaaccggtacgttggtaccgggtacttacggcctaacccttnttaccggttcgttaccctttacctaacttcccccgtttccccggtaccc

SEQ ID NO: 219201 - DNA, 685 bp, Homo sapiens
  misc_feature: GYAE6OF01EI0VV.24.87.H10.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (305)..(305): a, c, t, g, unknown or other
  misc_feature (305)..(305): n is a, c, g, or t
  modified_base (387)..(387): a, c, t, g, unknown or other
  misc_feature (387)..(387): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccaccctgtctgtgtctccgaggggaaanacgcccaccctctcctgcagggccagtnagatgttggcagacaacttgcctggtaccagacaacgaacctggaccaggcctacccaggtcctccttcctntatcgcctgtcctacccgaccgtacgggcccctggtctcccgacggtccgtagggttcgtcggggcggttgggtctgggacngttacttcactcgtacacctatccgacgtccggccctacgtacgtcgtagtaagttacttttcgacctttaacttttatttccgttagtacctaacctacgttagttcggtacgtaccgttcgggtacccttaccggttaacctttaccggttttcgggacccggttaacggggtaaaccctaaacggttggtaacggtaacctaacggtaaaaccggtaacgttcgggtacggtacctcggtaccctaaccgtacttaccgtttcgttaccttaccgtacttccccgtccccgtacc

SEQ ID NO: 219202 - DNA, 738 bp, Homo sapiens
  misc_feature: GYAE6OF01BVC28.24.87.H10.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagcccaccctgtctgtcgtctccgaaggggaancgcccaccctctccngcagggccagtgagtatggttggcagctaacgttagccgtcggtaccagcaacgaaaccgtggaccacggcctacccgaggtcctccgtcctctactcgtcctcgtcctccaacccggtccgggtccccgtggtccgtcccgacggccgtacgggttcggtcgggtcggtcggtccgtagggactacgtacgtttaccgacttaccgtccgtaaccgtacttaccgacggtcccggtcccctaccgtacgttccgtaacgtaacggtttacgtttacgtaccgtttaacgtttttacttaccgttacggtaacctaaacgttaccgttagtacgggttacctacggttccgtacccgttaccgtttaaccgttaccgggttttaccggaacccggtaaccgggtaaaccgtaaccggtggtaaacgttaacgtaaaccggtaaacgtaacgtcgggtcgtacacgtacccgtaccgtattccgttacttccttacctacgttccccgtcccgtacg

SEQ ID NO: 219203 - DNA, 657 bp, Homo sapiens
  misc_feature: GYAE6OF01BNQUZ.24.87.H10.1.454.CMB.1.raw
  modified_base (205)..(205): a, c, t, g, unknown or other
  misc_feature (205)..(205): n is a, c, g, or t
  modified_base (387)..(387): a, c, t, g, unknown or other
  misc_feature (387)..(387): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaangcccaccctctcctgcagggccagtgagatgtgcagcacttgcctggtaccagcagaacctggccaggcctccgaggtcctcctcctctatcgctcgtcctccaccgacgggtcccctgggtctcccgagcctagggttccgtgggcggttgggtcgtggggacagtcttcactctcacctntcacggccgtcctcacgtctagtaagttactttgacttactttactttctacgtactaactacttagtcgtcgtacgtcggtccttaccgttacgttacgttttcgggaccggtaacggggtaaccctaaacggtacgggaacgtaacgtaaccgtaaaaccggttaacgttacgggtacggtacctaccggtaccctaacccgttacgtttaccgtttaccggttacctttaacccgttacccgtttccccgttaccccggttaacccc

SEQ ID NO: 219204 - DNA, 592 bp, Homo sapiens
  misc_feature: GYAE6OF01BX38B.24.87.H10.1.454.CMB.1.raw
  modified_base (205)..(205): a, c, t, g, unknown or other
  misc_feature (205)..(205): n is a, c, g, or t
  modified_base (368)..(368): a, c, t, g, unknown or other
  misc_feature (368)..(368): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaangccaccctctcctgcagggccagtgagaatgttggcagacaacttagcctggtaccagcaagaaacctggccaggctcccaggcctcctcctctatgctgtcctccaccacgggcccctgggtcgtccccagccaggtttcgtgggcggtgggtctggggacnggtattcactctcaccatcagccgcctccagtcctagtaagtattttgacttacttttatttcctgttacctaacacttagtggtagtcgtggtcccttccgtacttacgttttcgggacccgagggtaacccaacgtgggaacgtagtaccgaaacgtaaccgtggtcggtactcggacctaccagttccgtgttaccttacctacttccccttccccgtacc

SEQ ID NO: 219205 - DNA, 769 bp, Homo sapiens
  misc_feature: GYAE6OF01BPGYS.24.87.H10.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
tcagactactatgtcacgaccggtgctcgatttagcagtactgcgttgggtttgggggaggaactgctcagttaggacccagacggaaccatggaagccccagcgcagccttctcttcctcctgctactctggcctcccagataccactggaagaagtagtcatgacgcagtcctccagcccaccctgtctgtgtctaccgaaggggaaancgcccacctctccgngcgagggccagtgagatggtgcagactaatcgccgtagtaccagtcgaacgaaccgtcggaccacggtccctacccgacggtcccttcctacctcgtacgtcgtccttcggtaccctacccgaccggacccgggttccccttgggtacccgtaccccgaacggtccggtttacggggtttccgggttggggtcccgggttgggtaccggtaggggactacgttacgttacctaccgtcctacacccgtagtccgacgggtccccgtaccgttaccgtaggttaccgttaagttaaggtttcttttaccggtacttttaacgttttactttaccggtaacttaacctaaacttcgttaggtcggttacgtacgttcccggtaccgtttaccgttaaccgttacggtttacggggacccggtaaacgggtaaacctaaggtacgggtaataaccgtaaacgtaaaccggtacgttcgggacgttcgtaaccgacctaaccgttgtccgtttacgttaccttaccgtaccttccccgtcccgtaac

SEQ ID NO: 219206 - DNA, 611 bp, Homo sapiens
  misc_feature: GYAE6OF01DW5J2.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctccccaggcctcctcctctatgctgtcctccaccgacgggccccctggtcgtccccagccgtagggttcggttgggcggttggggtcgtggggactaggtatttccgacttctccaccatcacgccggtccctccgagttcctaggtaagttattttgtccttaacttttatttccttagtactaaacctacttagttggttcgtactcgggtcccttccgttacttacgttttcgggacccgtaggggtaaccctaaacgtggagtactacgaaaccgtacgtggtcggatcgcaccgtatcgttacttcttactacttccgttcccgtacc

SEQ ID NO: 219207 - DNA, 862 bp, Homo sapiens
  misc_feature: GYAE6OF01CZPKS.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanacgcccaccctctcctgcgagggccagtgagaatgttggcagcacttagcctggtaccagcagaaacctggccaggctcccgaggcctcctcctctatcgctgtcctcccaccgacgggcccctggtccgtcccgacgtcccgtagggttcggttcgggcgggttggggttcgtacggggacctaggtactttttccgaactttccctccgtaaaccctaacttcccgaacgggtcccggttccccgttacccgtaaccggtttcccgttaacgggttaaaacgttaacgtttttttaccggtaccttttaaacctttttttaaacgtttttacccgtttaccggtttaaccttaaacccgtttaaaccgtttaacggtttacgggtttacggtaaccccggtttcgggttaccccgtttaaccccggttttaaccgtttaacccgggtttttttaccgggaccccggggttaaaccggggggtaaaccccgttaaaaccgggttacggggtaaaccgtaaacgttaaacccggaaaaaccgggttaaccggttacgggttaccgggtaccgttacgggtaccctaaacccgttacgttaccggtttaccggtttacctttccgttaacccgttttccccgtttcccccggtaacccg

SEQ ID NO: 219208 - DNA, 538 bp, Homo sapiens
  misc_feature: GYAE6OF01A8LBG.24.87.H10.1.454.CMB.1.raw
  modified_base (203)..(203): a, c, t, g, unknown or other
  misc_feature (203)..(203): n is a, c, g, or t
  modified_base (377)..(377): a, c, t, g, unknown or other
  misc_feature (377)..(377): n is a, c, g, or t
  modified_base (507)..(507): a, c, t, g, unknown or other
  misc_feature (507)..(507): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagatgttggcagcaacttagcctggtaccagcagaacctggccaggctccaggctcctcctctatgctgtctccaccacgggcccctggtcgtcccagcctaggttcggttggtcggtgggtctggggacagtactttcactctcaccntcagccggcctcagtctgtaagtatttgtctactttatttcttcgtactaactactatgtgtactcgcctccgtactacgtttcggaccgtagggacctaacgtggacgatacaaacgacgtgtcggtcncgcaccatctcgtcttatcttcctcccgtcc

SEQ ID NO: 219209 - DNA, 723 bp, Homo sapiens
  misc_feature: GYAE6OF01BCZH8.24.87.H10.1.454.CMB.1.raw
  modified_base (152)..(152): a, c, t, g, unknown or other
  misc_feature (152)..(152): n is a, c, g, or t
  modified_base (206)..(206): a, c, t, g, unknown or other
  misc_feature (206)..(206): n is a, c, g, or t
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
tcagactactatgtcacgaccggtgctcgatttagcagtactgcgttgggtttgggggaggaactgctcagttaggacccagacgggaaccatggaagccccagcgcagcttctcttcctcctgctactctggctcccagataccactgganaagtagtcattgacgcagtctccagcccacctgtctgtgtctccgaggggaagngcccacccgtctcctgccagggcccgagtgagatgttggcagcaacttgcctggtaccagcagaacctggccaggcctccaggcctctcatctatgatcgtcaccagnggtcacgtcggccgtcccncgacgttcaggtggctaggtcggtcgtagggacctagaccgtttcaccgtttccgtaccgacccggtacgacggtccgtaccgtacccgttaaggaaccgtacccgttaaggaaaggttttacgtttttcgggtaacccgggtttttactaacgttcggttaccgtacggtacgtaccggttcccggtttcccggaccgttacgggtacccgtaaccgtttaaccggggttttcccggggggaaccggggggtaacccggtagggggttacgggaacgggtaacgggtaaccggtaacggtaacgttgggtccgggtaccgtcggacccgaaccgttcgttaccgtttcgttacccgtttacgttacccttccccggttcccccgtaccg

SEQ ID NO: 219210 - DNA, 641 bp, Homo sapiens
  misc_feature: GYAE6OF01AZ07M.24.87.H10.1.454.CMB.1.raw
  modified_base (421)..(421): a, c, t, g, unknown or other
  misc_feature (421)..(421): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggtctcccagataccactggagaagtagtcatgacgcagtctccagccaccctgtctgtgtctccgaggggaaagcgccaccctctcctgcagggccagtgagaatgttggcagcaacttagcctggtaccagcagaaacctggccaggcctcccaggctcctcatctatgatcgtctaccaacgtcgggtcacgtcgggcccgtcccccgcgtaggttccaggtcggcaggtgggtctgggacaggacttcgacttctcaccgtcacgcacgcctagacgcctagaagtnttttcggacggtttactacgttgtcagcgacgtccgttccgcgtcgggcccgttacggttaaccggtttccgggggaccggggggtaccgtagggggtacggacgggtaacggggacgggtaaccggtaaacggttcgggtacgggtccgtacggtacccgtaaccgtacggttccgttacgttcccgtttaccgtaccgtttccccgttccccgtaccg

SEQ ID NO: 219211 - DNA, 567 bp, Homo sapiens
  misc_feature: GYAE6OF01BTWJ8.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtcctccaccagggcccctggtcgtcccagcctaggttcgtggcggtgggtctggggacaggatttcgactctacaccatcgacgccggcctccgagttctgtaacgtattttcgcttactttactttctgtactaactacttagtggtcgtacgtcggtcccttccgtactacgttttgggacccgtacggggaacccaacgtcggagataccgaaacgtacgtggtggcgtagccaccatctgttcttcattcccgttcccaccg

SEQ ID NO: 219212 - DNA, 674 bp, Homo sapiens
  misc_feature: GYAE6OF01C9EB6.24.87.H10.1.454.CMB.1.raw
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (655)..(655): a, c, t, g, unknown or other
  misc_feature (655)..(655): n is a, c, g, or t
  modified_base (668)..(668): a, c, t, g, unknown or other
  misc_feature (668)..(668): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatgccaccggagacattgtgttgacacagtcctccagcccaccctgttctttgtcctaccgaaggggaaanacgcccaccctctcctggcacgggccagtgaactaagtggttaggaagtttgtagccgttggtataccaaacaacaaacngtggccaggcctccccggntcctccatctagtgatcgacactccgaagtacggccacgtggacctactaccccaaggtacgtacggtttacgaggttcgggacgtaggggttcgggtaccggtaggggtaactacggtaaccgtttaccaacctttcctacccaaacctattaccggaagtccgtaaggttacggtaagaccgttacgtaggtaaacgtttgtttacggactttaaggttttacttacgtgtacacgtacgtaccgtagaaccaccgtccgacccttacgttccgggacctacgggaccctaaggaccgtcggaaccacgtacccgaaacgtagtcgtcggactcgacctacctntacctcgttcctntacccg

SEQ ID NO: 219213 - DNA, 736 bp, Homo sapiens
  misc_feature: GYAE6OF01BR35G.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgcccaccctctcctgcagggccagtgagatgtgcagcatgctgaccagcagaacctggacaggcctccgagcctcctctctatcgctctcctaccaccgcgggtcccctggtcctcccgagtccgtacgggttccgccggggtcgggttcgggtccgtaggggtaacctagggttacttttaccgaccgtttccctaccgaaccgtacgtacccggtacgggcccggttacccctaccgtacgttacgtaacggtaacggtttacgtttttacggtacctttaaccgtttttacttttaccgttacggttaacctaaccgttaaccgtttaggttcggtacgttaccggttcccgggttacccgtttacccggttaccgtttaccggtttaccgggacccggttaacggggtaaccctaaacggtacgggtaacgtaaccgtaacgtaaaccgtacggttacggtacggtaccgtacggacctaccgtacgttaccgttccgttacttaccttccttcccgtcccgtaccg

SEQ ID NO: 219214 - DNA, 664 bp, Homo sapiens
  misc_feature: GYAE6OF01ADTF9.24.87.H10.1.454.CMB.1.raw
  modified_base (440)..(440): a, c, t, g, unknown or other
  misc_feature (440)..(440): n is a, c, g, or t
  modified_base (640)..(640): a, c, t, g, unknown or other
  misc_feature (640)..(640): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtcctccagcccaccctgtctgtgtctccgaaggggaaagcgcccacccttctcctgccgagggccaggtgagtaatggttcggcagctaacttggccgtggtaccagacgacgaacctcggccaggcctcccgaggtcctcctccctctagtcgccttcgtacctcccaaccggtccgggtccccgttcgggtcgtccccgacggtccggtacgggtttcggtcggggtcgggttcgggtcgtcggggactgtacgtttccaccgtctccncccgtatccgaccgccggtaccctccgagtcgtcgaagttcgtttcgtcttacgttttacttctcgttacaactacttagtggttcgtacctcggttcctaccgttacgttccgtttcggaccggtacgggacgtaacgttacggactacgtacaaaccggtacgtggtcggtctacgtccacgtacgttctaccgtttnttacccgacttcccgtcccgtacc

SEQ ID NO: 219215 - DNA, 612 bp, Homo sapiens
  misc_feature: GYAE6OF01AGUWJ.24.87.H10.1.454.CMB.1.raw
  modified_base (205)..(205): a, c, t, g, unknown or other
  misc_feature (205)..(205): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
tcagactactatgtcacgaccggtgctcgatttagcagtactgcgttgggtttgggggaggaactgctcagttaggacccagagggaaccatggaagccccagctcagcttctcttcctcctgctactctggctcccagatgccaccggagacattgtgttgacacagtctccagcccaccctgtctttgtctccgaggggaaanacgccaccctctcctgcagggccagtgacaatgtaggattgtagcctggtatcaacacaacntggccaggcctcccggntcctcatctatgatcgcatccaagtacgggccacgtggacactccccaggtacaggtttcaggttcggctaggtgggtacgtagggacaggtacttcacttcacaccatcgacgccgcctccgagtctagtaagtatttcgtacttacttttatttctagtacaactacttagtcggtacgtaccgtcggtcccttaccgttaccttaccgttttcggacccggtacggggtaacctaaaccggtggaacgtaacgttaaccgaaaccggtacgttaggtcggtacgtacgacctaccctacttaccgttcgttccgttcgttacccg

SEQ ID NO: 219216 - DNA, 615 bp, Homo sapiens
  misc_feature: GYAE6OF01BJPQ7.24.87.H10.1.454.CMB.1.raw
  modified_base (205)..(205): a, c, t, g, unknown or other
  misc_feature (205)..(205): n is a, c, g, or t
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
  modified_base (596)..(596): a, c, t, g, unknown or other
  misc_feature (596)..(596): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagngccaccctctcctgcagggccagtgagatgtggcagcaacttagcctggtaccagcagaacctggccaggctccaggctcctcctctatgctgtcctccaccgacgggtcccctggtcgtcccagtccgtagggttcggttggggtcggtggggtcgtggggaccagtactttcactcctacaccntcgacgtccgcctccagtcctagtaacgtnttttcgcttacttttatttctgtacctaactacttagtggtcgtacgttcggtcccttccgtacttacgttttcgggacccgtaacggggaaccctaacggtggaacgtaagtaccgtaaacgtaacgttcggtcgggcgttacgcctaaccctagttccgttcggttcttaccnctttcccgtccccgtaccg

SEQ ID NO: 219217 - DNA, 654 bp, Homo sapiens
  misc_feature: GYAE6OF01E1B43.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaagngccaccctctcctgcagggccagtgagatgttggcagcaacttagcctggtaccagcaacgaaacctggaccaggcctccgacggcctccctcctctagtcgcctgtcctcccaccgacgggtcccctggtcgtccccgagccgtagggtttcggttcgggcggtgggtcgtaggggactaggtactttcgacttcgtaccaccgtatccgacggcccggtcccttccgacgttcgtagtaagttacgttttcgtactttacttttatttcctagttacctaactacgtagtggtacgtacgtcgtacccttccggttaccttacgtttcgggaccgtaacggggtaacctaaacggtggaacgtacgtaacgtaaaccggtaacgttcggtcggtactacggtccacccgtattccgtcgttaccttactacttcccgtcccgtacc

SEQ ID NO: 219218 - DNA, 661 bp, Homo sapiens
  misc_feature: GYAE6OF01DUN0S.24.87.H10.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaaatagtgatgacgcagtctccagccaccctgtctgtntctccgaggggaanagccaccctctcctgcagggccagtcagagtataagagcaacttcttagcctgtatcaacagaaacctggccaggcctccgagcctcctcctntactgtctgtcctccgaccacgggtcccctggtctcccagccgtaggttcgttggcggttgggtcgtgggactagtacttcaccttcgtccaccatccgacgtccggtcctccgtacgttctagtaagttagtttttcgaccttacttttactttctacgttaccgaaacttacgttacgttggttacgttacgttccgggtacccttacccggttaacgtttaccgttttccgggaacccggtaacggggtaaccctaaacggttggaaacgtactaaccgaaaacgtaccgttacgggtacgtacgtcgtaccctaccgtacttcgttacgttcctttaccaccgttcccgttccccgtaccg

SEQ ID NO: 219219 - DNA, 780 bp, Homo sapiens
  misc_feature: GYAE6OF01A8Y9T.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanacgccaccctctcctgcgagggccagtgagaagtgttggcagactaacgttacgccgttggtaacccagaccgaacgaaaaccgtcgggacccgacgggcccttaccccgaacggccccttccccgttcccttaccgttaacgttcggtcctttcggttccccttacccgaacccggtaccggggtccccccgtttgggtcccgttaccccgaacggtccgttacggggtttccggtttcggggcgggttcggggtcgtggggactaggtacgtttcgaccgttccgtaccaaccgtattccgacgggtcccggtacccctccgtaacggttccttaaggtaacgtttacgttttcggacctttaacgtttttactttcgtacgttacctaaacgttaccttagttcggtacgtacgttccggtacccgttaccgttaacgttaccgttttcgggaccggtaaccggggttaacctaacggtaggaacgtactaaccgaaaccggtacttagggacgtacgtacgaccgaaccttacgttcttacgttactttaccacttcccgttaccccgtacc

SEQ ID NO: 219220 - DNA, 731 bp, Homo sapiens
  misc_feature: GYAE6OF01BGUJ0.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgcccaccctctcctgcagggccagtgagatgtggcagcaattagcctggtaccagcagaacctggccaggcctccgaggtcctcctcctctagtcgctcgtccgtccacccgacgggtcccccttgggtcctaccccgacggtccgtacgggttttcccggttaggggtccgggttggggttccgttacgggggactacgggttactttcgaccttccgtaccacccgtatcccgacggtcccggacccgttccgtacgtcgttaaggtaagttacgtttacgtacttaaccgttttactttccgtttacgtactaaaccgtacgtttacgttcggttacgtaccgttccggtcccgttacccgttaaccgttaccgttttacgggaccggttaaccggggtaaccgtaaccggttaggtaacgtacgtaaccgtaaaccgtaacgttacggtacggtaccgtcggtacccgtaccgtacgttaccgttacgttaccttaccgtacgttccccgttcccgtacccg

SEQ ID NO: 219221 - DNA, 709 bp, Homo sapiens
  misc_feature: GYAE6OF01C2ENV.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagcgccaccctctcctgcagggccagtgagaatgttggcagcacttgcctggtaccagcaagaacctcggccaggcctcccgaggcctcctcctctacgctcgtcctcccgaccgaccgggcccctggtccgtaccccgacggtcccgtacgggtttccggtgggccggttgggtccgtgggactagttacttttacctcctacaaccctatcgacggtccgtcctaccgtagttcctaggtaacgttattttcgaccttactttttacgtttcgtacgttacctaacgttacgttaagttcgggtacgtaccgttcgggtcccctttacccggttaacgtttaccggttttacgggacccggtaacgggggtaacccctaaaggttacgggaacgtacgttaaccgaaaaccgtacgtcgggtacggaccgtacggaccctaaccgtacgttccgttacgtttccttaccgtacctttccccgttacccccgacttaccgttaccg

SEQ ID NO: 219222 - DNA, 644 bp, Homo sapiens
  misc_feature: GYAE6OF01CAJ94.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaanagcccaccctctcctgcagggccagtgagaatgttggcagcaacttagcctggtaccagcaagaaacctggaccaggctcccaggcctcctcctctatcgctgtcctccaccgacgggcccctggtcgtccccagcctaggtttccgtgggcggtgggtcgtggggacaggtactttcacgttctcaccgatccacggtcctacggtcccttaccgacgttcgtagtaacgttagttttcgtactttacttttactttctacgttacctaactaccttaagttcggtacgtacgttcggtcccttaccgttacgttaccgttttcggaccgtaacggggtaacctaacggtcggtaagtaacgtactaaaacggtacttcgggtagtacgtcgtaccaacctacgttccttacgttaccttactcgttcccttaccccg

SEQ ID NO: 219223 - DNA, 863 bp, Homo sapiens
  misc_feature: GYAE6OF01CCIO8.24.87.H10.1.454.CMB.1.raw
  modified_base (211)..(211): a, c, t, g, unknown or other
  misc_feature (211)..(211): n is a, c, g, or t
tcagactactatgtcacgaccggtgctcgatttagcagtactgcgttgggtttgggggaggaactgctcagttaggacccagacggaaccatggaagccccagcgcagcttctcttcctaaaaaaaacctgctactctggctccagataccactggagaagtagtcatgacgcagtctccagccaccctgtctgtgtctccgaggggaaangccaccctctcctgcagggccagtgagaatgtggcagcaattagctggtaccagacaagaaacctggaccaggcctcccaggcctcctcctctatcgctcgtcctccgaccgacgggtcccctgggtccgtcccgagtcccgtagggtttcggttcgggtccgggttggggtaccgttagggggaacctaggttacttttccgaacctttccctacctaaccctaagtcccgaacgggtacccggtccctttaccgaacggttccgttaagggtaaaggtttaacttttttcgggaaccttttaaccgttttttaagttttaccctttacggttaacctaaaccgtttaaacccgttaggtttaacgggttcggttaacccgtttccggggtaccccgtttaccggtttaaaccgtttaaccggttttttaccggggaaccccggttaaaacggggggtaaacccccttaaaacgggtttacggggaaaacggttaaaaccgttaaaaccgggaaaaaaccgggttaaaacccggtttgggttaacgggggtacccctttaacggaaccccggtaaacccttaacgtttcccgtttacgggtttaccctttaacccgggttaacccttttccccgtttacccccggtaaccc

SEQ ID NO: 219224 - DNA, 577 bp, Homo sapiens
  misc_feature: GYAE6OF01D530R.24.87.H10.1.454.CMB.1.raw
  modified_base (204)..(204): a, c, t, g, unknown or other
  misc_feature (204)..(204): n is a, c, g, or t
  modified_base (367)..(367): a, c, t, g, unknown or other
  misc_feature (367)..(367): n is a, c, g, or t
  modified_base (382)..(382): a, c, t, g, unknown or other
  misc_feature (382)..(382): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagatgtgcagcaacttagcctggtaccagcagaaacctggccaggcctcccgaggcctccctcctctatcgtctgtcctccaccgacgggcccctggtcgtcccagtccgtaggttcgtcggcggtgggtcgtggacngtattcactctcacntcacgcgcctcagtctagagtagtttgtcttactttattctgtactaactactacgtggtcgtactcggtcctccgtacttacgtttcgggaccgtacggggaacctaacgtaggaacgataaccgaaacgtacgttggtcggtctacggccaccgtattacgtcgttaccttactaccttcccttccccgtacc

SEQ ID NO: 219225 - DNA, 679 bp, Homo sapiens
  misc_feature: GYAE6OF01BQKHG.24.87.H10.1.454.CMB.1.raw
  modified_base (300)..(300): a, c, t, g, unknown or other
  misc_feature (300)..(300): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
tcagactactatgtcacgaccggtgctcgatttagcagtactgcgttgggtttgggggaggaactgctcagttaggacccagacggaaccatggaaaccccagcgcagcttctcttcctcctgctactctggctcccagccatcaccggaggaattgtgttgacgcagtctccaggcaccctgtctttgtctcgaggggagagagccaccctctcctgcagggccagtcagagtgttagcagcagctactagcctggtaccagcagaaacctggccaggcctccaggcctcctcctctancgctcgtcctccgaacccgcgggtcccctggtcgtcccaggtccctaggtttcgtggcggtgggtcgtgggacagtactttcacgtcctcacctntcgagtccggcctccgngtactagtaatagttttcgaccttactttactttctacgttactaactacttacgtggtcgtaccgttcggtacccgttccgtaacgtttaccgttttacgggacccgtaacggggtaaccctaaacggttcgggaaacgtacgttaaaccgtaaaccggtaacggttcggttacgggtacccttacgggtacccaacccgttacgttacccgtttacgtttacccctttacccgtaccctttcccggttaccccccgttaaccccg

SEQ ID NO: 219226 - DNA, 536 bp, Homo sapiens
  misc_feature: GYAE6OF01EUFCU.24.87.H10.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (467)..(467): a, c, t, g, unknown or other
  misc_feature (467)..(467): n is a, c, g, or t
  modified_base (502)..(502): a, c, t, g, unknown or other
  misc_feature (502)..(502): n is a, c, g, or t
tcagactactatgtcacgaccggtgctcgatttagcagtactgcgttgggtttgggggaggaactgctcagttaggacccagacggaaccatggaagccccagctcagcttctcttcctcctgctactctggctcccagataccactggagaaatagtgatgacgcagtctccagcccaccctgtctgtgtctccaggggaaangcccaccctntcctgcagggccagtcagagtataagagcaactactagcctggtatcaacagaaacctggccaggcctcccaggcctcctcatctatggtatatccagcagggccacgttggtcgtcccaggccctagggttcaggtggctaggtgggtcgtggggactaggagttcacgtctacaccatcagcagtctggctagtctaggtaagtatttgcttagtttattacgtgacctagcagcacgagtcgactggccnctcgtaccgttcggcggagggaccgagggtgagtntaaccgaaagtacgtgacggtactgccacgtacg

SEQ ID NO: 219227 - DNA, 599 bp, Homo sapiens
  misc_feature: GYAE6OF01AMTJO.24.87.H10.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctntcctgcagggccagtgagaatgttggcagcaacttagcctggtaccagcagaaacctggccaggctcccaggcctcctcctctatcgcttcgtcctccgaccgacgggtccccctggtcgtccccagccgtagggttccgttgggcggtggtcgtgggacaggtattcactcgtcacctatcgacgtccggccctcgacgtctagaacgtattttcgacttacttttacgtttctcgttactaactacgttagtcggtcgtacgtcggtccgttaccgttacgttacgttttcggaccgtacgggtaacctaacgtggagtacgtacgtaaacgtacgtaggtcgacgtgccacgattcgtgttacttctacttccgttcccgtacc

SEQ ID NO: 219228 - DNA, 693 bp, Homo sapiens
  misc_feature: GYAE6OF01EJYU2.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaagcgcccaccctctcctgcgaggccagtgagatgtgcagctaactgccgtggtaccagcaagaaacctggccaggcctcccaggcctccctcctctagtcgtctcgtcctcccaccgaccgggtcccctgggtccgtcccgacgccgtagggttccggtcgggtcggtcgggtcgtggggactaggttactttcaccttcctaccacctatccgacggccggtaccctccgtacggttcgtaggtaacgtttcgttttacgtaccttacttttactttccgtacgtaccctaactacgttagtggtacgtacgtcgtcccttaccgttaccttacggtttccgggaaccgtaacggggtaaccctaaacgggtgaaccgtaaacgtaaccgtaaaaaccgtcggtttacggtcgggacgttacgaaccctaccgttacttaccggtttcgttaccttacccgttaccgtttcccccgtccgtaaaccccg

SEQ ID NO: 219229 - DNA, 725 bp, Homo sapiens
  misc_feature: GYAE6OF01AJP7V.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagatgtggcagcaacttagcctggtaccagcagaaacctggccaggcctcccaggcctccctccctctatcgcctgtcctcccacccgacggggtccccctgggtccgtccccgaggcccgtagggtttccggttggggccgggttggggtcgtggggactaggtacgttttccaacttcctcctaaccctacgttccgacggccgggtccctcccgtagttccgtaggtaacgttacgtttttcggtaccggttttactacgttcgtactacggtctacggtccggttcccgcccgttcgggcccgtaccgtttaaccgggtttccgggggaccgggggggtaccctaggggggttcgggaacgggtagggaacggtaaccggaacggttcggggtacgggccgttacgggccctacccggtaacgttccgttccgttaccgtttaccgtaaccgtttccccgttcccccgtaccgtaccgttccgttaaaccgg

SEQ ID NO: 219230 - DNA, 712 bp, Homo sapiens
  misc_feature: GYAE6OF01CZBOP.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaaancgcccaccctctcctgcgacgggccagtgagaatggttggcagctaacttagccgtaggtaccagcaagaacctggccaggcctcccgaggcctcctcctcgtactcgcttacgtccctacccgaccggtaccgggtccccctgggtacccgtccccgtacgtcccggttacgggtttcggttcggggccgggttggggtccgttaggggaactagtactttccgacttcgtaccactacgtcgaacggccgtccctaccgtacgtacgtacgtaagtttaacgtttcgttacttactttttactttcgtacgttacctaaactacgttagttcggtacgtaccgttcggtcccgttaccgttaacttaccggttttcgggacccggtaacgggaacctaacggtcggtaacgtaacgtaaccgaaaccgtaacgtcggtacggtaccgtacggtaccctaccgtattccgttacttacgttaccttacccttcccgttacccgtaccg

SEQ ID NO: 219231 - DNA, 592 bp, Homo sapiens
  misc_feature: GYAE6OF01DTPSL.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctcgaggggaaanagccaccctctcctgcagggccagtgagaatgtggcagcaacttagcctggtaccagcagaactgcagctccagctcctctctatgctgtcctccaccgacgggccctggtcgtcccagccgtaggttcgtgggcggtgggtctgggacagtattcactctcactatcgacgcgcctccgagtcgtagtaagttatttgtacttactttatttctcgtactaactactagtggtacgtacgtcggtccttaccgttacttacgttttacgggaccgtaacggggacctaaacgtggaacgtaacgtaaccgaaacgtaacgtaggtacggtacgtcgtacccacctagttaccgttcgttaccttactaccttcccgttccccgtaccg

SEQ ID NO: 219232 - DNA, 712 bp, Homo sapiens
  misc_feature: GYAE6OF01EQVOD.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagcccaccctctcctgcagggccagtgagtaatgttggcagctaactagcctggtaccagcaagaaacctggccaggcctccgaggcctcctcctctatgcttcgtcctcccgaccacgggtccccctggtctccccacgccgtacgggttccgtgggcgggttagggtcgtggggaaccagtactttccgacttccgtaccaacctactccgtaacggccggccctacccgtaacggttccgttagtaacgttagttttcgtaccttaactttttaactttccgttacgttacctaaacgtacgttagttacggttacggtaaccgttcgggtacccttcccggttaaccgttaccgtttttcgggacccgttaacgggggtaacccttaaaaccggtcgggtaacgtaacgttaacccggaaaacgtaacgtacgggtcggtacgtacgaccgtaacccgtacgttcgttcgttacctttacctactttcccgtccccgtaacccg

SEQ ID NO: 219233 - DNA, 260 bp, Homo sapiens; identical to SEQ ID NO: 219041
  misc_feature: GYAE6OF01EJ7SD.24.87.H10.1.454.CMB.1.raw
  modified_base (256)..(260): a, c, t, g, unknown or other
  misc_feature (256)..(260): n is a, c, g, or t

SEQ ID NO: 219234 - DNA, 705 bp, Homo sapiens
  misc_feature: GYAE6OF01B04G5.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccaggggaaancgcccaccctctcctgcagggccagtgagatgtggcagcaacttagcctggtaccagcacgaaacctggccaggctcccgaggcctcctcctctatcgcttcgtcctcccaccgacgggtccccctgggtcgtccccagcccgtagggtttcgtgggcggtgggtcgtcggggactaggtctttcgactctaccacctattccgacggtcccgggtcccttcccgacggttccgtaggtaacgttacgtttttcggacctttacgttttacttttccgttcgtaccctaaactaacgtttagttcgggttaggtacccttacgggcccctttaccgttaccgttaaccggtttttcgggaccccggtaacggggtaaccctaaacgtacgggtaacgtaaccgtaaccgtaaaaccggtaaccgttacgggtacggtccgtacggccctaacccgtacgttccgtcgtttaccttactacctttcccgttccccgtacccg

SEQ ID NO: 219235 - DNA, 614 bp, Homo sapiens
  misc_feature: GYAE6OF01D1QIU.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagatgttggcagcaacttgcctggtaccagcagaaacctggccaggcctcccgaggcctccctcctctactgctcgtctccaccgacgggtcccctggtcgtcccagccgtaggttcgtggcggtggtcgtgggactagactttcacttcctcgaccgtcagcagtcctagcgccgtagtaagttattttggtacgtttaactctgtcagtcgtacgtccgttcccgcgtcggccgtacgttaaccggtttcggggaccggggaccgtaggggtcggaggaacgggacgaacggaacgtcggtacgggccgttacggccgtaaccgtacttcgttccgttcttaccgtacctttaccccttcccgtacctacttccggtaaacg

SEQ ID NO: 219236 - DNA, 838 bp, Homo sapiens
  misc_feature: GYAE6OF01DZAZ6.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccaccctgtctgtgtctccgagggaancgcccaccctctcctgcagggccagtgagtatgtgcagctaactgcctggtaccagcaagaacctggaccaggcctccgagcctcctcctctatcgtctcgtcctacccgaccggtaccgggccccttgggtcctaccccgtacggtcccggttaggggtttccgggttcgggggtccgggttcggggtccggtaggggaacctaaggtttaccgtttaccgaccgtttccgtacccctaaccgttacgtacccggaaccggggtccccggttccccttaccggtaacggtttaccgttaacggttaaacggtttacgtttttccggtaaccttttaacctttttacttttaccgttacgtttaaccgtaaacttacgtttacgttacgggtacgttacccggttaccgggttaccgtttacccggttaaccgtttaccggttttaccgggaacccggttaaccgggggtaaacccttaaaccgggtacggtaacggtaaaccgttaaaccggtaaaaccggtaacggttacgggttccggtaaccgttaccggaaccccttaccgttaaccgtttaccggttacctttacccggtttacccgttaccctttccccgttcccccggttaaacccg

SEQ ID NO: 219237 - DNA, 661 bp, Homo sapiens
  misc_feature: GYAE6OF01APLJ8.24.87.H10.1.454.CMB.1.raw
  modified_base (206)..(206): a, c, t, g, unknown or other
  misc_feature (206)..(206): n is a, c, g, or t
  modified_base (643)..(643): a, c, t, g, unknown or other
  misc_feature (643)..(643): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaanacgccaccctctcctgcagggccagtgagatggttggcagctaacttagcctggtaccagacgacgaaaccgtggaccaggcctccgaggtcctccctctctatcgctcgtcctccaccgcgggtcccctggtccgtcccgacgtccgtacggttcggttggggcggttggggtcgtggggactggtactttccgacttccgtacacctacgtcgacggccggtaccctccgtacgtacgtagtaacggttactttttcgcctttacttttaactttcgttacgttaactaaccgtaacttaggttcgggtacgtaccgttcggtcccttaccgttacttaccggttttcgggaccgtaacggggacctaacggtgaacgtaacgtacgaaaccggtagtggtacgtcgtacgcacgtactcgtttctacgttaccncgttaccctcccgtaacc

SEQ ID NO: 219238 - DNA, 550 bp, Homo sapiens
  misc_feature: GYAE6OF01BD7CQ.24.87.H10.1.454.CMB.1.raw
  modified_base (204)..(204): a, c, t, g, unknown or other
  misc_feature (204)..(204): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcagaaacctggccaggctcccaggctcctcctctatcgctcgtcctccaccgacgggtcccctggtcgtcccagccgagggttcgtgggcggttgggtcgtggggacagtatttcgactctccacatcgagccgcctcgagtctagagtatttgctactttattctgtcaactntatggtnacgtcgcctcgtactcgtttgccgagggacctaacgtgagtactacgaaacgtacgtagtcggctgccacacttcgtacgttcttacctcttcccgttccccgtacc

SEQ ID NO: 219239 - DNA, 781 bp, Homo sapiens
  misc_feature: GYAE6OF01BX5YP.24.87.H10.1.454.CMB.1.raw
  modified_base (210)..(210): a, c, t, g, unknown or other
  misc_feature (210)..(210): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccactggaagaaatagtgatgacgcagtctccagcccaccctgtctgtcgtctaccggaaggggaaancgcccaccctctcctgcgacgggccagtcaagtagtaataaagaacgactaacttacgttacgccgttaggtaactaccgaaacgaacgaaaccgtcggaccgaacggtccctacccgaggtccccttcctacctaattccgttaagttacggtaacttaccgtaccgaggaccgtaaccggggtaccctaaccggttcggttacccggtaccccgacggaccggtttaacggttacggtaacgggtcgggtacgtacggggttcggggtccggtaaggggtaaccgtaggttaccttaccggtaaccttccgtaaccctaacctagtaccgtacggtactacggttcgtacgtcgtaacgttacgtaagtaagtttcgttacgtacgtttagtttaacctcggtacgaccgacgtacgtaacgacgtaacgtacggtacgtccggttacggtccctagttcccggtagggtttcccggggaaccggttaacgggaaccggtagggaacgtacgtaacgtaaacccgtaacggttacgtcgggttaccgactccggtaccgtacgttaccg

SEQ ID NO: 219240 - DNA, 617 bp, Homo sapiens
  misc_feature: GYAE6OF01BC1SG.24.87.H10.1.454.CMB.1.raw
  modified_base (204)..(204): a, c, t, g, unknown or other
  misc_feature (204)..(204): n is a, c, g, or t
  modified_base (389)..(389): a, c, t, g, unknown or other
  misc_feature (389)..(389): n is a, c, g, or t
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
  modified_base (577)..(577): a, c, t, g, unknown or other
  misc_feature (577)..(577): n is a, c, g, or t
  modified_base (595)..(595): a, c, t, g, unknown or other
  misc_feature (595)..(595): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgccaccctctcctgcagggccaggtgagaatggtggcagcaacttagcctggtaccagcagaacctggccaggctccaggctcctctctatgctgtcctccaccgtacgggccccctggtcgtccccagcccgtggttccggtgggcggtgggtctgggactagtctttccactctaccacctntaccgcgtccggccctcgagtctagtaacgttnttttcgacttacttttntttccgttgttaccaaacgttacttaggttcggtacgtacgttcgggtacccttacccggttacgtttaacgtttcgggtacccggaacggggtaaccctaacggttaggacaagtaacccgaaaggtactggtcgtncgtcaccgtattccgttntccctatcttcccgtcccgtac

SEQ ID NO: 219241 - DNA, 746 bp, Homo sapiens
  misc_feature: GYAE6OF01A47S7.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaancgcccaccctctcctgcagggccagtgagatgtggcagcaacttgcctaggtaccagcaagaacctggaccaggcctccaggcctccctcctctatcgctcgtcctccgaccgacggggtcccctgggtccgtccccgacggtcccgtacggggtttccggttcggggtccgggttggggttccggtagggggtaccgtaggttacgttttccgaaccgttccgttacccgaaccctacgttccgaacgggtcccgggtaccccttacccggtacgttccggttaacggtaacggtttacgtttttacggaccttttaacttttttaacttttaccgttacgtttaacctaaaccgttaccttaggttacggttacgtaccggttccgggtcccgtttacccgttaaccgtttaccggttttcggggacccgtaacggggtaaccctaaacggtgggaacgtacgtaaccgtaaacgtaacgttaggtcggtactcgacctaccgtagttcgttcgttcttactccttcccttcccggtacc

SEQ ID NO: 219242 - DNA, 542 bp, Homo sapiens
  misc_feature: GYAE6OF01COSVH.24.87.H10.1.454.CMB.1.raw
  modified_base (202)..(202): a, c, t, g, unknown or other
  misc_feature (202)..(202): n is a, c, g, or t
  modified_base (383)..(383): a, c, t, g, unknown or other
  misc_feature (383)..(383): n is a, c, g, or t
  modified_base (416)..(416): a, c, t, g, unknown or other
  misc_feature (416)..(416): n is a, c, g, or t
  modified_base (450)..(450): a, c, t, g, unknown or other
  misc_feature (450)..(450): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (534)..(534): a, c, t, g, unknown or other
  misc_feature (534)..(534): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctcgaggggaaancgccacctctcctgcagggccagtgagatgtggcagcaacttgctggtacagcagaacctggccaggcctccgagcctcctcctcgtactcgtctcgtcctcccaccgacgggtcccctggtcgtcccagccgtaggttcggttggcggttgggtcgtggggacaggtactttcacttccncaacagtcacggccgtcctccagtctagacttnttcgcttacttttatctgtacaactctagtgtanacgttcgtcctcgtataccgtttggcctagtcgaaccagtgaagtactacaaagcgtgnggntcggactacattctctacttcntccctccg

SEQ ID NO: 219243 - DNA, 680 bp, Homo sapiens
  misc_feature: GYAE6OF01BY43C.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgccaccctctcctgcagggccagtgagatgttggcagcaacttagcctggtaccagcaagaacctggccagcctccaggcctcctcctctatcgctcgtcctccaccgacgggcccctggtccgtccccgagtcccgtagggtttcggtcgggcggttcgggtcgttaggggactaggtactttcacgttctaccacctagtccgacggtccggtccctaccgaggttctaggtaacgttattttcgactttaacttttacttttcgtacgttactaaacgtacgtttagttcggttacgtaccgttcggtacccttaccgttaacttaccggttttcggacccggtaaacggggtaccctaaacggtacggtaacgtaacgtaaccgaaaaccgtaacgtcgggtacggtactacggacccgtaacctaagttccgttacgttccttacacccgtttcccgtccccggtaaccc

SEQ ID NO: 219244 - DNA, 666 bp, Homo sapiens
  misc_feature: GYAE6OF01BXB1R.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagcccaccctctcctgcagggccagtgagaatgttggcagcaattgcctggtaccagcagaaacctggccaggctcccaggcctccctcctctatcgtctgtcctcccaccgacggggtccccctgggtccgtccccagccgtagggttccggttgggcggtggggtcgtggggacagtactttcgactctctaccatcacgccgtcctccgacgtcgtgtaagtattttgacttacttttactttcttacgtacctaactacgtagttcgggtacgtactcggtcccttccgtacgttaccgttttcgggacccggtaacggggaaccccgtaaacggtacgggtaacgtaacgttaaccgtaaaaccggtaaccgttgggtacggtaccgtacggtacccaacccgttaacgtcccttacggttacctttacccgtacttcccgtttcccccgtaacccg

SEQ ID NO: 219245 - DNA, 876 bp, Homo sapiens
  misc_feature: GYAE6OF01EBVFD.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagctcagcttctcttcctcctgctactctggctcccagataccacgtggagaagtagtcatgacgcagtctccagccaccctgtctgtgtctccgaggggaanacgcccaccctctcctgcagggccagtgagaatgttggcagactaactagccgtagtaccagacaagaaaccgtggaccacggcctcccgacggtccctccccgttcctactacgtcgtccttcgtccctacccgaccgacccgggtccccttgggtaccgtaccccgacggtcccgtaggggttttccggtcgggggtaccgggttcggggttccggtagggggtaacctacgggtttacttttaccgaccgttcctaccacccgtacgttacccgacgggtacccggtacccgttaccgtacgttaccggttaacggtaacgtttaacggtttttcgtaccttttaaccgtttttaacgttttacccgttacgttaaccctaaacccgttaacgtttaacgggttcggttacgttacccggtaccgggttacccctttaaccggtttaacccgtttaccggtttttaccggggaaccccgggttaaaccgggggtaaacccgttaaacccgggttagggtaaaccgttaaccggtaaacccgttaaaaccgggtaaaccggtttacgggttaacccgggtaccggttaccgtaacccgtaaccccgttactttacccgtttacggtttaccctttaccccgtacgttttccccgttcccccgttaacccg

SEQ ID NO: 219246 - DNA, 761 bp, Homo sapiens
  misc_feature: GYAE6OF01BGQG0.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaanacgcccaccctctcctgcgacgggccagtgagatgtgcagcaacttagcctggtaccagcaacgaaccgtggccaggcctcccgaggtccttcccgtcctcttacgtcgtcctcgtccctacccgacccgtacggggtccccctgggttccgtacccccgtaggccccggttagggttttcccgggttcggggtcggggttcggggtcgtcgggggaactaaggttacttttccggaaccttcccgtacaaccctacgttccgaacggtcccgggtacccttcgtacgttccgtaggtaacgtttagtttttacgtactttacctttttagtttcctacgttaccctaaacctagtttaacgtcggttacgtccgttcggtcccttaccggttaaccttaccggttttccgggaaccggtaaacggggttaaaccctaaacgggttaggaaacgtaaccgttaaccggaaaaccgttacgtacgggtcggtaccgtaaccgccgtaaccgtacgttcgttaccggtttacttaccgcctttccccggttccctaaccg

SEQ ID NO: 219247 - DNA, 699 bp, Homo sapiens
  misc_feature: GYAE6OF01BBTP4.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaancgccaccctctcctgcagggccagtgagatggtggcagcaactagcctaggtaccagcacgaaacctggaccaggcctcccgaggtcctccctcctctactcgctcgtcctcccaccgacgggtcccctgggtccgtccccgagtccgtagggttcggtcggggtcgggtcggggtcgtggggacctagtactttcaccgttctaccacctatccgacggtcccggtcctaccgtacgttctaggtaacgttacttttacgactttacttttatttccgttacgttacctaaacctacgttaagttgggttacgtaccgttccggtcccgttacccgtttaaccgttaccggtttttaccggggacccggttaacggggtaaccctaaacggtacgggaacgtacgtaaaccgaaacggtaaccggtcgggtaccggtcgtaccggactaccctagttccgtcgttacccttactaccttcccgttccccgtaccg

SEQ ID NO: 219248 - DNA, 613 bp, Homo sapiens
  misc_feature: GYAE6OF01BQ3DS.24.87.H10.1.454.CMB.1.raw
  modified_base (343)..(343): a, c, t, g, unknown or other
  misc_feature (343)..(343): n is a, c, g, or t
  modified_base (367)..(367): a, c, t, g, unknown or other
  misc_feature (367)..(367): n is a, c, g, or t
  modified_base (441)..(441): a, c, t, g, unknown or other
  misc_feature (441)..(441): n is a, c, g, or t
  modified_base (580)..(580): a, c, t, g, unknown or other
  misc_feature (580)..(580): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagcgcccaccctctcctgcagggccagtgaagatgttggcagacaacttgcctggtaccagacaacgaaacctggccaggcctcccgaggtcctcctcctactactcgctcgtcctccaccgacgggccctggtcgtccngcctggttcgtcggcggtgggtcnggggactgtattcactctcgacactcgacgccggtacctccgagtctagtaacgttattttcgacttacttttntttcctagttacctaactacgttagtggtcgttactcgggtcccttaccgttacttacggtttcggacccgtaagggtaacctaacggtaggaactacgtaaccgaaacggtacgttggtccgtacgacgtccaacctnttcgttacttcctactacttcccgtcccgtacg

SEQ ID NO: 219249 - DNA, 648 bp, Homo sapiens
  misc_feature: GYAE6OF01C4HH3.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggcctccaggctcctcctctatcgctcgtcctccacgacggcccctggtcgtcccagccgtaggttcgttcgggcggttcgggtcgtgggactagtactttcgacttcgtcacccgtatccgacgtccggtccctcccgagttcgtacgtaacgttgttttcgacttacttttacttttctacgttactaaactcttaagttcggtacgtacgttcggtcccttacccgttacttaccgtttttacgggacccgtaacggggtacctaaaccggtggtaacgtaacgtaccgaaaacggtaaccgttggtacggtactacggcctaacccgtattccgttacttacccgttacctacttcccgttccccgtacc

SEQ ID NO: 219250 - DNA, 674 bp, Homo sapiens
  misc_feature: GYAE6OF01C6V4A.24.87.H10.1.454.CMB.1.raw
  modified_base (205)..(205): a, c, t, g, unknown or other
  misc_feature (205)..(205): n is a, c, g, or t
  modified_base (437)..(437): a, c, t, g, unknown or other
  misc_feature (437)..(437): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaanacgcccaccctctcctgcgacgggccagtgagaatggttggcagcaacttcgcctggtaccagcaagaaacctggaccaggcctcccgaggcctcctcctctatgctgtcctccaccgacgggcccccggtgtccccacgccgtacgggtttcggtggcggtcgggtcgtgggacagtagtttcactcgtaccacctatccacggccggccctcgacgttctagtaacgttnttttcgactttactttattttctcgttacaactacttagtggttacgtacgtcgggtcccttaccggttaccttaccggtttttcgggacccgtaaccgggggtaaccctaaacggttgggaacgtaacgttaacccggaaaaccggtacgttaggtccgggtacgtaccggaccctaccgttacttccgttacgtttcctttactaccgtttccccctacccggttccttaaccgg

SEQ ID NO: 219251 - DNA, 724 bp, Homo sapiens
  misc_feature: GYAE6OF01BAS92.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaanagccaccctctcctgcagggccagtgagaatgtggcagcaacttagctggtaccagcagaacctggaccaggcctaccgaggcctccgtcctctatcgctgtcctccaccgaccgggtcccctgggtaccgtccccgtacggtccgtaggggtttccggttcggggtccgggttcggggtaccgttacggggggactaacgggttacttttacccgaacccgttcctaccgtaaccccgtagttacccggacgggtacccgggtccccttaccggtaacggtttccgttacgggttaaaccggttttagttttttacccggaccgttttaaccttttttaacgtttccgttacggttaaccctaaaacgtttaccgttaagttcgggtacgtaaccgttcgggtacccttacgtaccgttacggtttcggaccgtaacgggtacaacgtaggacgtataccgaaacgtactggtcgacgtcgacctacgagttcgtcgtcttactccttcgttcccgac

SEQ ID NO: 219252 - DNA, 659 bp, Homo sapiens
  misc_feature: GYAE6OF01AETP2.24.87.H10.1.454.CMB.1.raw
  modified_base (208)..(208): a, c, t, g, unknown or other
  misc_feature (208)..(208): n is a, c, g, or t
  modified_base (254)..(254): a, c, t, g, unknown or other
  misc_feature (254)..(254): n is a, c, g, or t
  modified_base (365)..(365): a, c, t, g, unknown or other
  misc_feature (365)..(365): n is a, c, g, or t
  modified_base (626)..(626): a, c, t, g, unknown or other
  misc_feature (626)..(626): n is a, c, g, or t
tcagactactatgtcacgaccggtgctcgatttagcagtactgcggttggggtttgggggaggaactgctcagttaggacccagacggaaccatggaagccccagcgcagcttctcttcctcctgctactctggctcccagataccactggagaaatagtgatgacgcagtcctccagccaccctgtcctgtcgtctccgaggggaancgcccacccgtctcctgccagggcccagtccagagtactaaggacncaaaccttcgttagccgttaggtactcaaacgtacgaaccgtgggaccctaggcctccccggaggtcctaccctacgacttcctaagttcgattcgtacctaccgtaacgngggtcaccgtcgggcccgtccccgctagggttccaggtcggctaggtcgggtcgtacgggacacgtacctcgaacctctccgaccgtcacgtcacgtcctagacgcctaggtaacgttgtttcgtcggtttacctacgtcggtcacgaccgtcggtaccgttccggccgtcggtaccgtaccgttacgggttcccggggcgggggactacggggtgggacggtacgggagtaccggtagtacggtcgtcgtcgcgaccgtntccggttcgtcttaccgcttcccgtccgtaccg

SEQ ID NO: 219253 - DNA, 606 bp, Homo sapiens
  misc_feature: GYAE6OF01CIW0V.24.87.H10.1.454.CMB.1.raw
  modified_base (204)..(204): a, c, t, g, unknown or other
  misc_feature (204)..(204): n is a, c, g, or t
  modified_base (572)..(572): a, c, t, g, unknown or other
  misc_feature (572)..(572): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatacccactggagaagtagtcatgacgcagtctccagcccaccctgtctgtgtctccgagggganagacgcccaccctctcctgccgagggccaggccggagtgttagtaagtacttaggctggtaaccaacagaaacctggccaggcctacccaggctcctcatctatgatgtctaccaacgagggtcacgtcggcccgtcccccgactacggttcaggtcggcgtaggtcgggtcgtcggggacagtacttcaccttctcaccgtcgaacgcacgcctagacgcgtagaagtgttttacgtacggtttactaacgttcgtacagtccgtacgtccgttccccgtcgtcggaccgtacgttaccggtttcggggaccgggggtaccgtggggtaggagagggacgaacggtaacgtggtacggctcgccacncttcgtcgtcttctcttcctcccnctntcgtacg

SEQ ID NO: 219254 - DNA, 642 bp, Homo sapiens
  misc_feature: GYAE6OF01DTXWU.24.87.H10.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (322)..(322): a, c, t, g, unknown or other
  misc_feature (322)..(322): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactgganaagtagtcatgacgcagtctccagccaccctgtctgtgtctccgaggggaaanagccaccctctcctgcagggccagtganatgtgcagcaacttgctggtaccagcagaaacctggccaggcctccaggcctcctcctctatgtctgtcctccaccgacggccctggtcncccgagcctaggttcgtggcggttggtcgtaggggactagtactttcgactctacgaccatcgacgccggtacctccgacgtctacgaagttattttcgtacttacttttactttacgtcgtactaactacgttagttacggtcgtacgttcggtcccgtttaccgtaaccgttacgttttccgggaccgtaacggggtaaccctaaacggtcgggtaacgtaacgttaaccgaaaaaccggtaacttagggtaccggtacgttcggaccacccgttaacttccgttcgttaccttactactttccccgttcccgtaccc

SEQ ID NO: 219255 - DNA, 732 bp, Homo sapiens
  misc_feature: GYAE6OF01CP9GC.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtcgtctccgaaggggaaagacgccaccctctcctgcacgggccagtgagaatgttggcagcaacttgcctggtaccagcaagaacgtgccacggcctccgacggtcctcctccctactacgtcgcttcgtcctcccgaccgtaccgggccccgttggtccgtcccgacggtcccgtacgggttccggttcggggcgggttacggggtcgtaggggactacggtactttccgacttccgtaccaccgtacgtccgacggcccggtccctaccgtacgttaccgtaggtaacgttacgtttcgtacctttacttttacttttccgtacgttacctaaacgtcgttagtcgggttacgtacgttccgggtacccttacccggttacgttaccggtttcgggaacccggttaacggggaaacctaacggtaggaacgttaacgtaaccgtaaaaccggtacgttaggtaccgggtacctcggtaacccctaaccgtactttcccggttacgtttacccttaccgtaaccttccccgttacccgtacccg

SEQ ID NO: 219256 - DNA, 812 bp, Homo sapiens
  misc_feature: GYAE6OF01D041X.24.87.H10.1.454.CMB.1.raw
  modified_base (218)..(218): a, c, t, g, unknown or other
  misc_feature (218)..(218): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcaatggacgcagtcctccacgccctaccctgtctggtcgtccgtccggaaaggggaacncgacccctacctctcgtgacgacgggcaggtgaagtagttggtcgacacgtactaacgtcgacgttacgacgacgactaacgaaccgtcggaccacgggtaccctccgacggtccctaccgtcccttagtactcgtcttccgcctacccgaaccggtcccggtcccggtcggttccgaccccggtacggtccggttcgggttcgggttcgggcggggttcggtacgggtacgggacttacggtactttccgtaccgtacctaccgacgtactccggacggtcccgtaccgtaccgttcgtacggttaagttaacgtttcgtttacgttacctttagtttttacgtacgtttaccctaagaaacccgttgtttacgttaccgggttacgttaaccggttcccggtaccgtttaccccgttaacggtttcccggttaacgggtaacccgggtaaaccggggtaaacttacgggggtaccaaacggttaacctaaacggaaaacccggttagggtacggtaccggtactacccggacgttaaccgttagtccgtttacggtacccttccgttaacccggttcccgtacccgtaaccg

SEQ ID NO: 219257 - DNA, 964 bp, Homo sapiens
  misc_feature: GYAE6OF01DAMAW.24.87.H10.1.454.CMB.1.raw
tcagactactatgtcacgaccggtgctcgatttagcagtactgcgttgggttgggggagaactgctcagttaggacccagacggaaccatggaacgcccagcgcagcttctcttcctcctgctactctcggcctcccagactacccacgttaggagtaagtagtcatcggaccgcacgtcctccacgccctacccgtgtctgtcgtcctacggaagggaacgccgccccacccttcctccgtcggaccggacgggacctaggtagaagtagtttcggtacgacgaacgtaccgttaaccgttcggtacccgtaggtaacccgcggaaccgtaaaccggtaacccgtcggaacccggtaccgtccccgtaccggtccggttccccttccccgtttacccgttcgtaccgttccgtttccgttacccggttccccgtaccccggtaacccgggtcccccgggtttacccgtttcggtacccccggtaccggtccggtttaccgggttttcggggtttccggggtccggggttacggggttccgggttaccgggtaacggtaaccgtttacgttttaccccgttaccgtacccgttacccgtaacccctaacggttcccgacggtccccggtaccccgttacccgtacgttacgtttaacggttaacgtttaacgttttaccgttaccgtttaaaccttttagttttaccgttacccgttaaccgttaaccttaaccgttcgggtttaccggttaccggttaccgtttacccggttccccgttacccggtttaaccgtttacccggttttacgggtaccccggtaaaacgggttacccggtaaaccgttacgggtacggtaaaccgttaaccgaaaaccgttacggttacgttcggccgtttacgaccctacccgtacttccgttccgttaccgttaccttacccgtcccttacccgtcccttaacg

SEQ ID NO: 219258 - DNA, 714 bp, Homo sapiens
  misc_feature: GYAE6OF01DK59S.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccaccctgtctgtcgtctaccgaaggggaaacgacgccaccctctcctgccgagggccaggtgaagaagtggttggcagactaacttacgccgtaggtaccagcaaacggtaaacctcgggaccaacgggtcctaccccgaacggtcccttccccgttaccgttcttaacgtccggtccttccggtccctaccccgaaccggaccgggtcccccgttgggtacccgtccccgacggtcccgtagggttcggttcgggcgggttcgggtcgtagggactaggtactttccgacttctaccgacctagtccgacgtccggccttaccgtacgtacgtagtaacgttacttttacgtacttaacttttactttacgtacgtaactaactacgttatacggtcgtacgtccgtcctaccgttaccgttacgtttccgggtaccgaaccggggtaacctaacgtgggtaatacgtaacgaaaaccgtaacgtacggtacgagtacgtccactacgtcttcgtctacctacttccctccgtacc

SEQ ID NO: 219259 - DNA, 706 bp, Homo sapiens
  misc_feature: GYAE6OF01DD1FU.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanacgccaccctctcctgcagggccagtgagatgtgcagcaatagctgacagcaacgaacctggcctcggcctcccgaggcctcctcattctagtcggtcgccgtccaccgacgggcctacgtggcgtccgcggacgtcgggttcaggtgcgtagggtcggtcgtttagggacctaggtacttcacgtctacagtcacgtcgacacggtacgtcggaacgtacccggtaagttacgttttacggcgttaacggttgtttaactttaccggttcggtaccgttagggttcccgttttgggtttttacccggttccccttttaccgttccccgttttaccgttacgtttaccgtttaacccgttttaccggttttaccgggtacccggttaccggggtttacccgacggggttcgttacggggtaaaccgttacgttaacgtaaacgggtccgttaaacggtcgggttaccggtacttacggtaaccctaacgttcgtttacccgg

SEQ ID NO: 219260 - DNA, 657 bp, Homo sapiens
  misc_feature: GYAE6OF01CS8S7.24.87.H10.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (410)..(410): a, c, t, g, unknown or other
  misc_feature (410)..(410): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccactggagaagtagtcatgacgcagtctccagccacctgtctgtcgtctccgaggggaancgccacctctccngcagggccagtgagaatggtgacagcaattagcctggtaccagcaagaaaccgtggacccaggtcctccgaggccttcctcccgtctacgtcgcctcgttccaccgacgtccggcccttggtccgtcccagtccgtaggttcggtgggccggttgggtactggggactagtactttccgatttccacgacctancgaacgtccgtacctccgtaagtcgtagtaacgttactttggtaaccttatttaagtttctagttactaacgtactagttacggtacgcgttacggcccttacgtaaccgttaccgttttcggggacccgtaaacggggtaacctaaaccgtgggtaaacgtacgttaaacgaaaccgttaagacgggttacggctacggccaacgtcgttacctaggttacccttacgacttcccgtcccgtaccg

SEQ ID NO: 219261 - DNA, 609 bp, Homo sapiens
  misc_feature: GYAE6OF01EGMRW.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttggggtttgggggaggaactgctcagttaggacccgagacggaaccatggaagccccagcgcagcttctcttcctcctgctactctggctcccagataccactggagaagtagtcatgacgcagtctccagccaccctgtctgtgtctccgaggggaaancgccaccctctcctgcagggccagtgagaatgttggcagactaacttagcctggtaccagcaagaaacctggaccaggcctcccgaggctccctctctatcgctgtcctccaccgacgggtccctggtctcccagtccgtaggttcgtggcggtgggtctggggacagtacttcacgtcctacactatcgacggcgaccctccgacgtctagaagttatttgacttattttattctgttactaactacttagtgtagtacgtcgtccttaccgttacttacgtttcggaccgtacggggtaacccaacgtacggaacgtaacgtaccgaaacgtaacgttaggtcggtacgtacggcctaccgtactccgttacgttaccttataccttcccgtcccgtaccc

SEQ ID NO: 219262 - DNA, 864 bp, Homo sapiens
  misc_feature: GYAE6OF01CFAR0.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgagggaaagacgcccaccctctcctgacgagggccaggtgagtaagtggttggcagactaacgttagccgtacggtaaccagaccgaaggtaaacccgtggacccgaacggtccctaccccgtacggtcccttcccttacccttccgttacgtcgtccttcggtcccctacccgaacccggccgggtcccccgttgggtcccgtacccgacgttcccggtacgggtttccggttcggggtccgggttcgggtccgtaggggaacctaggttactttccaacgttcctaccctaaccgtacgttaccgccggttacccggtacccgttacccgaacggtttaccgtaacggttaacggtttacgtttttaccgtaccgttttaaccttttttaacgttttaccgttaccgtttaacccttaaaccgttaccgtttaacgttaccggggtttaccgtaccgtttacccgggttacccctttacccgggttttaaccgttttaacccggttttccgggggaaaccccggttaaaccggggttaaaccctaaaccggtagggtaaccggtaacctaaccggtaaaaccgtacggttacgggtccgttacgtacgacccgttaaccgttacttccgttacttaccgttacctaccgttcccgtccccgtaaccg

SEQ ID NO: 219263 - DNA, 673 bp, Homo sapiens
  misc_feature: GYAE6OF01A8F0D.24.87.H10.1.454.CMB.1.raw
  modified_base (439)..(439): a, c, t, g, unknown or other
  misc_feature (439)..(439): n is a, c, g, or t
  modified_base (467)..(467): a, c, t, g, unknown or other
  misc_feature (467)..(467): n is a, c, g, or t
  modified_base (647)..(647): a, c, t, g, unknown or other
  misc_feature (647)..(647): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactgggaagaagtagtcatgacgcagttcctccagccacctgtctgtcgtctcgaaggggaaactcgcctaccctctcctgaccgagggtccaagtgaagaatggttggcagtcaacgttagccgttggaccagacgaacgaaacctcgggaccacggtcctaccacgggtccttcctcctacttagtcggtcctcgtaccgtccaccggcggtccccgttggtcctccgacgtccgtggttcgtgggtcggtgtacgtggactaggtctttacgcttcgactcgatcgcggccnctccgagtcgtagtaacttgtttacgtnttaacttttcgttcgtacttacctaacgacgttacgttcggtacgtacgtacccggttcccttaacggttaaccgtttccggtttacggaacccgtttacgggacgttaaaccccgtaagtcgggtaaataacggtacaaaacgggttccgtacggtgacgttacgacctacacgtttcngtttacctaccgtacgttaccgtccc

SEQ ID NO: 219264 - DNA, 739 bp, Homo sapiens
  misc_feature: GYAE6OF01D9POV.24.87.H10.1.454.CMB.1.raw
  modified_base (206)..(206): a, c, t, g, unknown or other
  misc_feature (206)..(206): n is a, c, g, or t
  modified_base (657)..(657): a, c, t, g, unknown or other
  misc_feature (657)..(657): n is a, c, g, or t
  modified_base (706)..(706): a, c, t, g, unknown or other
  misc_feature (706)..(706): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtcgtctccgaggggaaacncgcccaccctctcctgccgagggccagtgaagtagtgtggcagctaactgccgtagtaccagcaacgaaccgtggaccaggccctccccgaggtccctcccttccgtactactcgtccttcgtccctacccgaacccggtccgggtcccccttgggtacccgtcccgtacggtaccggttacgggtttccgggttacggggtcggggttgggttaccggtaggggtaccgtacgttacgtttttcccaaccgttccgtacccgtacctacgttaccgacggtaccccggtcccttacccgttaggttacccgttaagtaacggttttcttttaccggcttttaaccgttttaagtttccgtttacgtactaaacctacgttagttcggttacgtacgtccggtcccttaccgtacgttccgttacgggaccggtaacgggtacctaacggnggaactaacgtaacgtaaaccgtaggtccgtacgtcgacgtaccaactnttaccgtcgtttccactccgttccgtcctaccg

SEQ ID NO: 219265 - DNA, 645 bp, Homo sapiens
  misc_feature: GYAE6OF01EUYJ0.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagatgttgcagcaacttagcctggtaccagcagaaacctggccaggctccaggctcctcctctatgctcgtcctccaccgacgggcccctggtcgtcccagtccgtaggttcggtggcggttgggtcgtgggacagtatttcactctccacctatccacggccggcctccgacgttctagaacgttattttgtaccttacttttatttccttgtacctaactacttagtcggtagtacgtcggtccgtacccgttacgttacgttttcgggacccgtaacggggtaaccctaaacggtacgggacgtaacgttaaccgaaaaccggtaccgttaggtacggtaccgttcggacccgtaaccgtacttccgttacgtttacccttacctaaccgtttcccgttcccccgttaacccg

SEQ ID NO: 219266 - DNA, 611 bp, Homo sapiens
  misc_feature: GYAE6OF01A6EJV.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagatgtgcagcaacttgcctggtaccagcagaaacctggccaggctcccaggcctcctcctctatcgctcgtcctacccacccgacggggccccctgggtcgtccccgacgcccgtagggtttccgtttggggccggttggggtcgtgggggacagtacttttccaacgttcctccgaccctatccgacggccggccctccgacgtctagaagtattttgcttactttaatttctgtactaactactaagtcggtgtactcggcccttccgttactaccgttttcgggaccggtaacggggaaccaacggtggaacgtactacgaaaccgtaactggtcggtctacgccaccgtatctcgttcttcacttccgtcccgtacc

SEQ ID NO: 219267 - DNA, 620 bp, Homo sapiens
  misc_feature: GYAE6OF01BO9TH.24.87.H10.1.454.CMB.1.raw
  modified_base (204)..(204): a, c, t, g, unknown or other
  misc_feature (204)..(204): n is a, c, g, or t
  modified_base (388)..(388): a, c, t, g, unknown or other
  misc_feature (388)..(388): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttagcctggtaccagcaagaaacctggccaggcctcccaggcctcctcctctatgctgtcctccaccgacgggtccctggtcgtcccacgccgtaggttcgtgggcggtgggtcgtgggactagtctttcactctccacctntcgacggccgtcctccgacgtcgtagtaagttacgttttcgacttacttttatttcctagtacctaactacttagtcggtcgtaccgtcgtacccgttccgtaccgttacgttttcgggaccgtaacgggtaaccctaacggtacggaacgtactaccggtaaaaccgtacgttaggtcggtcgtacgacctacctacttcgtcgttaccttcaccttccgtccccgtaccg

SEQ ID NO: 219268 - DNA, 684 bp, Homo sapiens
  misc_feature: GYAE6OF01D4VRR.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaagagcccaccctctcctgcgagggccagtgagattgtggcagcattagcctggaccagcaagaaccgtgaccaggcctcccgaggtcctccctctctatcgtctcgtcctcccgaccgccgggtcccctggtccgtcccgagccgtagggttcggtcgggcggttgggtcgtagggacgtagtactttccgacttcctaccgacctacgtcgacgggcccggtacccttaccgtacgttccgtaagtaacgtttacgttttacggttacctttaactttttactttccgttagttaccctaaaccttacttaggttcggtacgtacgttccgggtacccttccgttaaccttacggttttcgggacccggtacgggtaaccctaacggtaggacgtaacgtaaccgaaacgtacgttgggtcgtacgtcgaccaccgttgttaccgtcgttaccttactaccgtttcccgtccccgtaccg

SEQ ID NO: 219269 - DNA, 616 bp, Homo sapiens
  misc_feature: GYAE6OF01BTXPP.24.87.H10.1.454.CMB.1.raw
  modified_base (379)..(379): a, c, t, g, unknown or other
  misc_feature (379)..(379): n is a, c, g, or t
  modified_base (609)..(609): a, c, t, g, unknown or other
  misc_feature (609)..(609): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagcgccaccctctcctgcagggccagtgagatgtggcagcaacttagcctggtaccagcaacgaacctggccaggcctccgaggcctcctcctctacgctgtcctcccgaccgcgggccctggtcgtcccagcctagggttcgtcggcggtggtcgtgggactaggttacttttacnctcacctagtccgaggccgtccctcgagtacgtagtaacgttatttacgaccttacttttatttctagtacctaactacgttagtggtacgtcctcgtcccttaccgtactacggtttcggaccggtacggggaacctaacgtgggtaacataaccgaaacgtagtcggtaggtacgtacgcctaactcgtaccttgttaccgttctaccgtttcccttaccccgacgtnttacccg

SEQ ID NO: 219270 - DNA, 729 bp, Homo sapiens
  misc_feature: GYAE6OF01BGMB5.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagatgccaccggagacattgtgttgacacagtctccagccacctgtctgtgtctcgagggaagcgccaccctctcctgcgaggccagtgagaatggtggcagctaacgtagccgtggtaccagcaacgaaaccgtggaccaggcctaccggacggtccttccgtcctctacgtcgtcgttcgtcccgtcccacccggtccgggtcccctgggtccgtcccgtacggtccgtacgggtttcggtcggggtcggtcgggtcgtacgggacgtacgtaccttcgacctcgtacctacctacgtccgacgtacgtagttacggtacgtacggtaccgtaaggtaaacgtttacgttttacgtacgtttaacgttttaacgtttacgtcggttaccgacgtacccgtaaccggtacgtaacccgtaaccgttccggtaccccgttaccggtttcccgggtacccggtaccgggtaaccgacggttaaccgtacggtaacctaacggtaaccccgaaacgtaccgtacgggtcgtacctacgaccctaaccgttcttccgttcggttacccttacgttacccttcccgttcccgtacc

SEQ ID NO: 219271 - DNA, 651 bp, Homo sapiens
  misc_feature: GYAE6OF01B5H3M.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaaggggaancgccaccctctcctgccagggccagtgactaatgttaggagttgtagcctggtatcaacacaaacatggaccaggcctccccggctccctcatctatgatgcataccaagtacgggccacgtcggacactcccgaagtaccaggtttcaggtcgggacagggttcgggtcgtagggaactaggtaccttacgacctcgtaccacctactcgacgccgtaggtacgtaacgtacgaccgtaaggtaagttagttttcgacgtttaagttttacttacgtgttaccgacggtaaccctaccggtacgaaccgtaaccgttccgggtacccccttaacggtttcccgggacccgtacgggaacccgtaacgtaccgtcggtaaacctaccgtaacccgaaacggtacgtcggtacgccgtcgacctacctattccgttcgttctttaccg

SEQ ID NO: 219272 - DNA, 671 bp, Homo sapiens
  misc_feature: GYAE6OF01CQVR1.24.87.H10.1.454.CMB.1.raw
  modified_base (204)..(204): a, c, t, g, unknown or other
  misc_feature (204)..(204): n is a, c, g, or t
  modified_base (550)..(550): a, c, t, g, unknown or other
  misc_feature (550)..(550): n is a, c, g, or t
  modified_base (571)..(571): a, c, t, g, unknown or other
  misc_feature (571)..(571): n is a, c, g, or t
  modified_base (580)..(580): a, c, t, g, unknown or other
  misc_feature (580)..(580): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtcgtctccgaggggaanacgccaccctctcctgcgacgggtccaggtgagaagtggttcggacaggactaacttaggccttaggtaccaggacaagaaaccgtgggacccacggccctaccccgaggtcctccctctatacgttaacgttcggtcgtaccgtcccgaaccgtacgggacccgacggttcggccggttacggccggtaacgtagggttccgaggttcggacggtaggtcgggtcgtttacgggactacggtactttcgaacgttcctacgtactacgtacaccgaagtaggaccgttgggaaaccgtacccgtaaagtttactttacgacgtagtttagtacttactgtacgtntgtttacgttcccgccctttnttccccttntagtttaccgtacttacggtttcggccgttacggttcgaggtcgtaggacgacttacgaagtccgagttcggatccgtacncncttgttcg

SEQ ID NO: 219273 - DNA, 814 bp, Homo sapiens
  misc_feature: GYAE6OF01C0IP2.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagcccaccctgtcttgtgtctccgaggggaaancgcccaccctctcctgcgagggccagtgagagtgttgcagctacttgcctggtaccagcaagaacctggccagcctccgaggccctcctcctctatcgtctgcctcccaccgacgggtcccctgggtccgtaccccgagtcccgtaagggttcggttggtcgggtcggggtccgttcggggactacgggtactttaccgaccgttctccacccgtagttaccgacggtacccggtcccttaccgtaacggttaccgtacgggtaacgttacgtttttaccggtaccgtttaacgtttttacgttttacccgttacgttacccgttaaaccgttaaccgtttacgttacgggtttccgacggtttacccgggtttaacccggtttaccccgttttaaccgtttaacccgggtttttttccggggaaccccgggttaacgggggttaaaccccgttaaaccggttaggggtaaaacgttaccggtaaaccgtaaaaaccgggtaccggttaacggttacgggtacccgttaccgacccgttaaccgtaccgtttacccgttacgtttacccggtttaccttacccgtttccccgttcccccgttaaccccg

SEQ ID NO: 219274 - DNA, 945 bp, Homo sapiens
  misc_feature: GYAE6OF01DMR1Y.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagacaacttacgcctaggtaccagccaagaaacccgtggaccaggcctccccgaggccttccctcctctatcgccttcgtcctcccgaccgtacgggtcccccgtgggtccgtccccgaggtcccgttaggggtttccggttcgggggtccgggttcggggttccgtacgggggacctaagggttacttttccgacctttccgtacccgtaacccgtaacgttacccgaacgggtcccgggttacccctacccgtaacggttaccgttaacgggttaaacggtttacgtttttttaccggtaaccgttttaacctttttttaacgttttacccgtttacggtttaacccttaaaccgttaaaccgtttaacggtttacggggttttaaccggtaacccggttttacccgggggttaccccgttttaaccccgggttttaacccgtttaacccgggtttttttaccgggggaacccccggggttaaacgggggggttaaaacccccttaaaaccggggttacggggtaaaaccggttaaaccgtttaaaacccggtaaaaaacccggggtttaaccgttaccgggggttaccgggttaaccccggttaaccggtaccccgtaaacccgttacgtttacccggtttaccggttttacccgtttacccgtttaaccgtttcccccgtttacccccgggttaaacccc

SEQ ID NO: 219275 - DNA, 627 bp, Homo sapiens
  misc_feature: GYAE6OF01AQBD8.24.87.H10.1.454.CMB.1.raw
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtntctccgaggggaaangccaccctctcctgcagggccagtgagatgttggcagcaacttgcctggtaccagcaagaacctggccaggctccgaggcctcctctntatgctgtcctaccgaccgacgggcccctgggtcctcccaggccgtaggttcgtggccggtgggtctggggactaggtactttcgacttccgtacgacctagtccgacgtccggtcctaccgtacgtctaggtaacgttactttcgacttaactttacttcgtcgttactaacgtaccgttagtcggtacgtacgtcggtaccttaccgtacgttacgtttcggaccgtacgggtaacctaacggtcgtaacgtacgtaccgaaacgtacgtggtacggacgttacggaccgtacctacgttacgtcgttacttactcgttcccgttcccgtaccg

SEQ ID NO: 219276 - DNA, 553 bp, Homo sapiens
  misc_feature: GYAE6OF01E1GPT.24.87.H10.1.454.CMB.1.raw
  modified_base (204)..(204): a, c, t, g, unknown or other
  misc_feature (204)..(204): n is a, c, g, or t
  modified_base (430)..(430): a, c, t, g, unknown or other
  misc_feature (430)..(430): n is a, c, g, or t
  modified_base (530)..(530): a, c, t, g, unknown or other
  misc_feature (530)..(530): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangcccaccctctcctgcagggccagtgagatgtgcagcaacttgcctggtaccagcagaacctggccaggctcccgaggcctcctcctctatcgctgtcctcccaccgacgggtcccctgggtctccccagccgtaggttcgttgggcggttgggtctggggacagtatttcactctcacctatcgacgccggccctccacgtctgtaagtatttgtacttactttntttctgtactaactactagtggtcacgtcggtcctccgttactacgttttcggacccagggtaccaagtggagtactacaaacgtactggtgctgcactnttctcttactcacttctcccgtc

SEQ ID NO: 219277 - DNA, 830 bp, Homo sapiens
  misc_feature: GYAE6OF01CFN5U.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtcgtctccgagggaaancgcccaccctctcctgcgagggccagtgagtaatgtggcagctaattcgcctagaccagacaagaaaccgtggccaggcctacccgacggtcccttcctcctctagtcgtccttacgtcccacccgtaaccggtcccgggtccccttgggtaccctaccccgtacggtcccggttacgggttttccggttcgggggtcggttacgggggtccgttacgggggacttaaggtttcccgttttaaccgacccgtttacctaccctaaaccgtacgttaccccgggaaccgggtccccgggttacccttcccgtaacggttaccggttaagggttaaaacgtttaccggtttttaccggttaaccttttaacgtttttaacgttttacccgttacggttaaccctaaacgttaacggtttacgtttacgggtacgttaacccgtccgggttacccctttaccggttaaccgttttccggtttaccgggtaacccggtaaaccggggtaacctaaaccgggttgaaacgtacgttaaacgaaaaccggttacgttacggtacggtactaccggtacctaccgttaacttccgttacgttaccttcctaacccgttcccgttacccgtacc

SEQ ID NO: 219278 - DNA, 742 bp, Homo sapiens
  misc_feature: GYAE6OF01BFJSX.24.87.H10.1.454.CMB.1.raw
tcagactactatgtcacgaccggtgctcgatttagcagtactgcgttgggtttgggggaggaactgctcagttaggacccagagggaaccatggaagccccagctcagcttctcttcctcctgctactctggcctcccagagaccaccggagaaattgtgttgacacagtctccaggcaccctgtctttgtctccgaggggagagacgcccaccctctcctagccgacggggccaggccggtagttgttaagtaagtacgttaggctaggtaaccaagacgaaaccgtggaccacggcctcccgaggcctcctacactctactgattcgtacctaccgaacgtacggtacacgtcggccgtccccgcgtacggttcacggtcggacctagggtcgggtcgtacgggaactacggtaccttcgtaccgtcctaccgtaccgtacgacgtccgacggtaccgtaaggtaccgtaccgtaggtaacgttacgttttcggtaccggttttacacgtttcggtacgacgtaccgtacggtcccggttccgtaccgttccggacccgtacgtttaacgggttcccggggacgggggtaacccgagggggtacggaacgggtacgggtacggtaaccggtaacggtggtcggtccgtacggtacccaccggttacgtccgttacgttacccgttcctaccgttccccgttaccccgtcgttaaccttcgaacgtaccttaggttaacgg

SEQ ID NO: 219279 - DNA, 865 bp, Homo sapiens
  misc_feature: GYAE6OF01A9RI9.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtcgtctccgaggggaaagcgcccacccgtctcccgtgccgagggtccagtgagtaatggttggcagacaacgttacgccgtacggtaccagacgacgaaaccgtggaccgaggcctacccgaggtcctaccctcctcgtatcgtccgtcgtccctaccgacccgaccgggtccccgtcggtccgtccccgtacggtccgtagggtttccggtgggtccgggtcgggttcggtcggggtaacgtacggtttacctttaccgtaccgttccgtaccgtaaccgtacgttccgaacgggtcccggacccgttaccgtacggtttacgtaacggttaaggttttaacgtttttccggtaccttttaaaccgtttttacgttttaccgttacccggtttaacctaaaccgttaccgtttaacgttacggggttcgttaacccgttacggtaccccgtttaaccggttaacgtttccggttttaaccggtaccccggggtaaacgggtaaacccgttaaaccggtcggtaaaccggtaaaccgttaaccggaaaaccggttaacgtttacggggtaccggttacccgttaaccgggtaccctaaacccggtttccgttaacccggtttcgtttaccccttaacccggtttacccttttaccccggttccccccgtttaacccg

SEQ ID NO: 219280 - DNA, 717 bp, Homo sapiens
  misc_feature: GYAE6OF01EK5YT.24.87.H10.1.454.CMB.1.raw
tcagactactatgtcacgaccggtgctcgatttagcagtactgcgttggggtttgggggaggaactgctcagttaggacccagacggaaccatggaagccccagcgcagcttctcttcctcctgctactctggcctccagataccactggagaagtagtcatgacgcagtctccagcccacctgtctgtcgtctccggaaggggaaacgacgcccaccctctcctgcgacggccagtgaagagtgtcggcagactaacttacgccgtaggtaccagcgaaacgaaccgtggccgaacgggtcctacccggacggtcctcccttacctctacgtcgtctccggtcctacccgaaccggtccgggcccgttacggtcccgtacccgacggtccgtagggttcggtcggggtcggttcgggtcagggtactacggttacttcacgtactacaacgtcgtcgacggtcccgtactacgtacggttcaaggttacgttactttagtaccttttactttacgttactacgttaaacaacgttcgtaggtcggttactacggtccgtaccttcgtaacgtttaccggttacggacccggttaaacgggaaccttaagggactaaccgtaaacgtaacgtaaaaccgtacggtacgggtccgtacgactaccctacgtacgtttaacgttcgtttaccttacccgttctttcccccgtcgtaccc

SEQ ID NO: 219281 - DNA, 581 bp, Homo sapiens
  misc_feature: GYAE6OF01E0KPE.24.87.H10.1.454.CMB.1.raw
  modified_base (204)..(204): a, c, t, g, unknown or other
  misc_feature (204)..(204): n is a, c, g, or t
  modified_base (384)..(384): a, c, t, g, unknown or other
  misc_feature (384)..(384): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanacgccaccctctcctgcagggccagtgagaatgttggcagcaacttagcctggtaccagcagaaacctggccaggctcccaggcctacctcctctatgctcgtcctccaccgaggcccctggtcgtcccagcctaggttcgtggcggtcgggtctgggacagtactttcgactctcacgntcgagccgtcctcgacgtctagaagtactttcgtacttactttagtttcctgtactaactattagtggtagtacgtgtcctacccgttactaccgttttgggacccgtaaggggaaccctaacgtacggagtaacgtacctaaaagacgttcggtaggactcggacacgtactcgtcttactctactctcccgtacg

SEQ ID NO: 219282 - DNA, 807 bp, Homo sapiens
  misc_feature: GYAE6OF01CEOAJ.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtcgtctccgaggggaaancgccaccctctcctgcgacgggcagtgagaatggtgacagacaacgttacgccgtaggtaccagcgtaacgaaacctggaccacggcctacccgacggtcctcctccttctagtcgtctcgtccctcccgaccggtccggtccccgtggtaccgccccgacggtccgttacgggttcggttcggggtccggtacggggtcgtacggggtacaggtttacttccgaacttccgtaccacgtacgtccgacggtccggtaccgtccgtacgttcgttaacggtaacgtttacgttttacggttactttaaccgtttttactttccgtaacttaaccgttaacgttacgttagttacgggttacgtacggttcccgggtacccgttttaccgttaaccggtttaccggtttttacccggggaacccgggtttaaaccggggtaaacccgttaaaaccgggttacgggtaaacgttaaaccggttaaaccgtaaaaccgggttaaaccggttcggttaccgggtaccggttaaccggtacctacccgttactttacccggttctttacccttaccgtttcccgttaccccgttccccggttaacccg

SEQ ID NO: 219283 - DNA, 669 bp, Homo sapiens
  misc_feature: GYAE6OF01ALZSH.24.87.H10.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagcccaccctgtctgtgtctaccgaggggaaancgcccaccctctcctgcgagggccagtgagatgtgnagcactgctgtacngcagaacnggaccagccnccagcctcctcctntagtcgtctcgtcctccgaccgtcggtccccgtggtcgccccgaggccgttaggttcggttcgggcggtgggtcgtgggactagttcttcaccttctaccaccgtagtccgacggtcccgtccgtccgtacgttcgtaacgtaagttacgttttacgtaacctttacgttttaccgtttacgttaccgtaaccttaacctacgtttacgtacggttacggttaccgtccggttcccgttaccgttaccgttacggtttccggacccgggtaacggtaacccgtaagtacggaacgtaccgtaaccggaacgtacggtcggtacggtactacggacctacgtacttcgttcgtaccgttactacccttcccgttcccgtaccg

SEQ ID NO: 219284 - DNA, 798 bp, Homo sapiens
  misc_feature: GYAE6OF01C9CB7.24.87.H10.1.454.CMB.1.raw
  modified_base (204)..(204): a, c, t, g, unknown or other
  misc_feature (204)..(204): n is a, c, g, or t
  modified_base (267)..(267): a, c, t, g, unknown or other
  misc_feature (267)..(267): n is a, c, g, or t
tcagactactatgtcacgaccggtgctcgatttagcagtactgcgttgggtttgggggaggaactgctcagttaggacccagacggaaccatggaagccccagctcagcttctcttcctcctgctactctggctcccagagaccaccggagacattgtgttgacacagtctccagccaccctgtctttgtctccgaggggaaancgccaccctctcctgcagggccagtgacaatgttaaggagttgtagctggtatcaacacaacntcggccaggcctcccggctcctcatctatgatgcactaccgaagtcgggccagtcggactactcccgagacgtaggttcaggtcggacgtagggtcggggtcgtaggggtaacacggtacctttacgaccttccgtaccaacccgtaattaccgaaggtaccgtaacgggttaggttaaacgggaccggttacccgttaagggttaaacggttttaacgtttttacggaacccgtttttaaggttttttaaaccgtttaaccgtttcgggttaacctaaccgggtaccccgtttaaacccggggttaaccgtaaacccggttaaaccggttccccggggttaaccccctttaacccgggttttccccggaccccgggtttaccgggaacccgtacgggtaacccgttacggtaaacccgtaccgttaacccggaaaaccggttaacccggtgggttaaccggtcccgttaccggaccctaacccgtacgtttaccgttaccgtttacccttccgttaccgtttaccccccg

SEQ ID NO: 219285 - DNA, 677 bp, Homo sapiens
  misc_feature: GYAE6OF01DA7GO.24.87.H10.1.454.CMB.1.raw
  modified_base (203)..(203): a, c, t, g, unknown or other
  misc_feature (203)..(203): n is a, c, g, or t
  modified_base (668)..(668): a, c, t, g, unknown or other
  misc_feature (668)..(668): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgcttactctggctcccagataccactggagaagtagtcatgacgcagtctcagccacctgtctgtcgtctccgagggganagacgcccaccctctcctgccgagggccaggccggtagtgttaacggtaacgttacttagggctacggtaaccaaacgacgtaaaccgtggaccgacggcctcccgaggtcctcctcattctagtgtactcgtcctaccaccgacgggtccccgtggtccgtccccgagtccgtacgggttcggtgggtcgggtcgggttcgtaggggtactagtacgtttccacttcgtacaccagtcgacggtccggcctacgagttctaggtaacgttaacttttcgacttactttttacttcgttagtcctaacgtacttaagtcgggtactaccgtttcgggacccttaccggttacttacgtttcgggaccggaacgggtaaccaaacggtcgaagtacaccgaaacgtactcgggtgccgtcgacgtacttgtacgttcgtacctttacaccgttcccgttaccccgntcttaaccg

SEQ ID NO: 219286 - DNA, 634 bp, Homo sapiens
  misc_feature: GYAE6OF01BPO6W.24.87.H10.1.454.CMB.1.raw
  modified_base (367)..(367): a, c, t, g, unknown or other
  misc_feature (367)..(367): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaaggggaaagcgcccaccctctcctgcagggccagtgagatggttggcagcaacttagcctggtaccagcaagaacctggccaggctcccaggcctcctcctctatgctcgtcctccaccgacgggcccctggtcgtcccagccgaggttcgtggcggtgggtctggggacngtactttcactctcaccatcagccggtcctaccgagttctagtaagtacttttggaccttacttttagtttcctgttacctaacgtacttagttcggtacgtacgttcggtcctaccgttacttaccgttttcggacccgtaacgggtacccaaagttggaacgtaactaccgtaaaaccgtacgttagggtacggtactacggccctaaccgtattacccgttcggtttacccttaccgtcctttaccccgttcccccgtaacccg

SEQ ID NO: 219287 - DNA, 645 bp, Homo sapiens
  misc_feature: GYAE6OF01AHI87.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggatagagccaccctctcctgcagggccagtgagatggttggcagcaacttgcctggtaccagcagaaacctggccaggcctcccaggcctcctcctctatcgctcgtcctccacccgacgggcccctgggtctccccgaggccctagggttccgttgggccgggtcggggtcgtaggggacaggtactttcgactcctcaccatccgaggtccgtccctccgagtcgtagtaacgttagttttcgacttaactttttactttccttggttacctaactacgttagtcgggttagtaccgttcggtcccttaccggttaccctacgttttcgggacccgtaagggtaacccaaccggttgggaacgtacgtaaccgaaacggtacgtgggtcggtacgtcggaccaacctagttacttacgttccctttactacttcccgttaccccg

SEQ ID NO: 219288 - DNA, 542 bp, Homo sapiens
  misc_feature: GYAE6OF01ELMFK.24.87.H10.1.454.CMB.1.raw
  modified_base (204)..(204): a, c, t, g, unknown or other
  misc_feature (204)..(204): n is a, c, g, or t
  modified_base (374)..(374): a, c, t, g, unknown or other
  misc_feature (374)..(374): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctacgtctggctcccagataccactggagaagtagtcatgacgcagtctccagccaccctgtctgtgtctccaggggaaangccaccctctcctacagggccagtgagaatgttggcagcaacttgcctggtaccagcagaaacctggccaggctcccaggctcctcctctatgctgtcctccaccacgggcccctggtcgtcccagccctaggttcgttgggcggtgggtctggggacagatttcactcncaccatcagcgcctccagtctgaagtattttcgctactttatttctgttcaactactatggtgtactcgcctcgtactacgttttcggccgtaacgggacctaacgtaggacgactacaaacgtactgtggctggctaccattctcgttcttcatccttcccgctacg

SEQ ID NO: 219289 - DNA, 616 bp, Homo sapiens
  misc_feature: GYAE6OF01ECD8D.24.87.H10.1.454.CMB.1.raw
  modified_base (203)..(203): a, c, t, g, unknown or other
  misc_feature (203)..(203): n is a, c, g, or t
  modified_base (570)..(570): a, c, t, g, unknown or other
  misc_feature (570)..(570): n is a, c, g, or t
tcagactactatgtcacgaccggtgctcgatttagcagtactgcgttgggttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgccaccctctcctgcagggccagtgagatgtggcagcaacttgcctaggtaccagcaagaacctggccaggcctcccgaggtcctcctcctctatcgctgtcctccaccgacgggccccttgggtccgtccacgtccgtaggttcggtgggcgggtgggtcgtgggacgtagtactttcgactcgtaccaccgtataccgtaggcccggtcctccgtacgtacgtagtaagttactttcgtacgttactttatttcctgtacctaactcttagtgtgtacgtcgtccctacgttactacgtttcgggaccgtaacgggtacctaacggtggtaacgtacgtaacgaaacgtacgtggtacggtacncggactaccgtattcgttacgtcttacctacttcccgtcccgtacc

SEQ ID NO: 219290 - DNA, 662 bp, Homo sapiens
  misc_feature: GYAE6OF01DH16S.24.87.H10.1.454.CMB.1.raw
  modified_base (204)..(204): a, c, t, g, unknown or other
  misc_feature (204)..(204): n is a, c, g, or t
  modified_base (618)..(618): a, c, t, g, unknown or other
  misc_feature (618)..(618): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgcccaccctctcctgcgagggccagtgagtaatggttggcagacaacgttgcctggtaccagccaagaacctggccaggcctcccgaggcctcccgtcctctactcgcctgtccctacccgacccgacgggtccccttgggtccgtcccgacgccgtagggttcggtcgggtcggtgggtcgtaggggactaggtactttccacgttcctcacctactcgaccggtccggtccctccgtacgttcgtagtaagtttacgtttcgtacttaccgttttatttccgttacgtactaacctacgttagtggttacgaccgttccggtcccgttaccgttaccgttacggttttcggacccggtaacggggaacctaacggttcgggaactacgtaaccgaaacgtactggacggtntcggacacctattccgtacgttcttactaccttcccgtccctac

SEQ ID NO: 219291 - DNA, 781 bp, Homo sapiens
  misc_feature: GYAE6OF01C8YER.24.87.H10.1.454.CMB.1.raw
  modified_base (223)..(223): a, c, t, g, unknown or other
  misc_feature (223)..(223): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtcgtctccgaaggggaaagacgcccacctctccgngcgacgggcagtgagaatggttggcagacaacgtagccgtacggtaccagacaacggaaaccgtcggaccgaggccctacccgacggtcctcccttccctatacgttcgccttcgtccctacccgaacccggtcccgggtccccgttcgggttaccgtaccccggacggttaccccggttacggggtttccgggtttcggggtccgggggtttcgggtccgggtaggggtaacctaaggtttaccttttccgtaaccgttcctaccgtaacccgtacgtccgaacgggtccccgtacccttaccgtacggttagttaacggtaagtttacgtttttacgtactttaaccgttttactttacgtaccggttaacctaaaccgttacgttacgttcggttacgtacggttccgttacccgtttccgtaaccgtttacggttccgggaaccgtaacgggtaaacgtaacgtgggaactaccgtaacaaacggtaacgtggtacgacctgaccctactacgttcgttacctttacgtacccttactttcccgtacccccgta

SEQ ID NO: 219292 - DNA, 735 bp, Homo sapiens
  misc_feature: GYAE6OF01EN28X.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaagacgcccaccctctccgtgcagggccagtgagatgtgcagcaactgcctgtaccagcaacgaaccgtcggaccaggcctcccgaggtcctcccgtcctctatcgcctcgtcctccgaccgtaccgggtcccctggtccgtccccgtacgtccgtacggtttcggtcgggtcgggtcgggtcggtacgggacgtagtacgtttccgtacttctaccgtaccgtcacgcgacgtaccgtaggacgtccgtagtaacgtttacgttttcggttaccggtttaactacgttcggtactacggtacgtacgtccggtttcccggccggttaccgggtcccgttaaccggtttaacccgggtttccggggggacccggggggtaaccgtaggggggtacgggaagggaacgggtaacgggtaaccggtacggttcgggtaccggtcgtaccggtaccgtaccgttacgtccgtttacgttccgttacccgtaccctttaccccgttaccccggaccttacggttaccgttaaaccgg

SEQ ID NO: 219293 - DNA, 654 bp, Homo sapiens
  misc_feature: GYAE6OF01CQ12A.24.87.H10.1.454.CMB.1.raw
  modified_base (173)..(173): a, c, t, g, unknown or other
  misc_feature (173)..(173): n is a, c, g, or t
  modified_base (209)..(209): a, c, t, g, unknown or other
  misc_feature (209)..(209): n is a, c, g, or t
  modified_base (382)..(382): a, c, t, g, unknown or other
  misc_feature (382)..(382): n is a, c, g, or t
  modified_base (426)..(426): a, c, t, g, unknown or other
  misc_feature (426)..(426): n is a, c, g, or t
  modified_base (489)..(489): a, c, t, g, unknown or other
  misc_feature (489)..(489): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagactaccacgtggagaagtagtcatgacgcagtcnccagcccacctgtctgtcgtcgtcgaaggggaaacncgcccaccctctccgtgacgacgggccagtagagtaagtggtggacacgacgtaacgttcgccgtaggtaccagacgaacgtaaaccgtcggaccgacggtcctacccgacggtcctacccgtctctacgtcgtcctcggtccctaccgaccgccggtcccgtgtccgtcccncgtccgtaggttccggtggtcggtggtcgtgggactgtacttcncgtactcacgtagcgacgtccgcctacgtagtctaagtagttcttacgtacttactttacgtntacgtactagtacgtcgtagtcgtacctagtacccgttcgtacttaccggttacgggacccgtaacggtacctaacggtacggaacgttacgtaacgaaaccgtaggtcgtacggtacgactcccgacttactcgttcgtaacgttcaaccgttcccgtccgtac

SEQ ID NO: 219294 - DNA, 661 bp, Homo sapiens
  misc_feature: GYAE6OF01BY31M.24.87.H10.1.454.CMB.1.raw
  modified_base (317)..(317): a, c, t, g, unknown or other
  misc_feature (317)..(317): n is a, c, g, or t
  modified_base (345)..(345): a, c, t, g, unknown or other
  misc_feature (345)..(345): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaagagcccaccctctcctgcagggccagtgagatggttggcagcaacttagcctggtaccagcaagaaacctcggaccaggcctcccgaggcctccctcctctactcgctcgtccnccgaccgacgggtcccctggtccgcccncggccgtagggttcggtcggcgggtcgggtcgtggggaccagtctttaccgactctacacctagtccgacggtccggtcctccgtacgtcgtagtaacgttatttacgacttacgttttactttcgtacgtactaactacgtagtggtcgtacgtcgtaccgttacccgttacgttcgtttaccgggaccgtaacggggtaaccctaacggtacggtaagtaaccgtacgtaaaccggacgttcggtacgggtcttacggaccctaaccgtacgttcgttccgttacgttaccctacgtttccccgtcccgtaacc

SEQ ID NO: 219295 - DNA, 743 bp, Homo sapiens
  misc_feature: GYAE6OF01DWSUB.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgccaccctctcctgcgagggccagtgagatgttggcagcaacttgctggtaccagcaagaaacctggccaggcctccgaggcctcctcctctatgcttcgtcctccgaccgacggcccctggtcgtcccagccgtaggttcgtgggcggtgggtcgtagggactagtactttccgacgttcctcgaccacgtcgaacggcccggtcctccgtacgttccgttaaggtaacgttacgtttttcggtacctttaactttttacgtttacttacggttacctaaaccttaacgttaaggttcgggttacgtaaccgttccgggtacccgtttaccggtttaacccgttaaccggtttttaccggggaacccgggttaacgggggtaaaccccgtaaaacgggttcgggaaacgttaaaccgtaaaccggtaaaacccggtaacgtttacgggtcgggttaccctacgggtaccctaaccccgtagtttacccgttcggtttaccctttacccttacgtttcccccgttccccgttaacccg

SEQ ID NO: 219296 - DNA, 797 bp, Homo sapiens
  misc_feature: GYAE6OF01DPS45.24.87.H10.1.454.CMB.1.raw
  modified_base (220)..(220): a, c, t, g, unknown or other
  misc_feature (220)..(220): n is a, c, g, or t
tcagactactatgtcacgaccggtgctcgatttagcagtactgcgttgggtttgggggagaactgctcagttaggacccagacggaaccatggaacgccccagcgcagcttctcttcctcctgctactctggcctacccagactacccagtggaagtaagtacgtcatcgacgctagtcctccagcccaccctgtcctgtcgtacaccggaaggggaacncgtcccaccctctccgaggcgacgggtaccaggtagaaggtaacttgggtacggaccaggacctaaacgttcggccgttacgggtaccaggacctaaacggtaaacccgtcggacccgaacgggtccctacccggacgtccccttcccttacctcttacgtcggtcctttcgacccttccccgaacccggaccgggtcccccgtttcgggcccgtaccccggaacggtccccgttacggggtttcgggttcggggtccggggttacgggttcggacgggggtaaccttagggttaacccttctaacccggtcttaacccgaacccttagccggtaacggccccggtaccttaccgtacggttccgtaacgtaggttactttacgtaacctttacttttactttactacgttactaaacgtactacggtacggtcgtacgtccgtaaccgttccgttaacgtcgtttaccggaccgtaaccgggtaactacggaagtactaacgactaaaaccgtgtacggtaccgtgaacctccgactaacgttctaccgttactatacccttccgtaccctacccg

SEQ ID NO: 219297 - DNA, 724 bp, Homo sapiens
  misc_feature: GYAE6OF01BFXFX.24.87.H10.1.454.CMB.1.raw
  modified_base (203)..(203): a, c, t, g, unknown or other
  misc_feature (203)..(203): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (324)..(324): a, c, t, g, unknown or other
  misc_feature (324)..(324): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccaccctgtctgtgtctcgagggaaangtcccacctctcctgcaggcagtgagatgtgcagcaacttgctggtacagcaacgaactggccaggcctccgagcctccnctntatcgctcgcctcaccgcgggtccctggtccgtacccngtccgtaggtttccggtggggcggttgggttcgtacggggtaacacgtacgtttccacttcctaccgaacctacgtccgaacggtccccggtacccttaccgacgttacctaaggttaaacgttaacgtttttcggtaaccttttaacgttttacgtttacctacgttaaccgtaactaacgttaacgttcgggtaacgtacctcccgggtaccctttaacccggtttaacgttacccggttttcgggaaaccgtaacgggggttaacccaaacggttcggtaaacgtaaccgttaacggaaaaccgttacgttacggtacgggtctaacggtaaccttaacccgtagtttcccgttaactttccctttaagtaccctttccccgttccccggtaaaccc

SEQ ID NO: 219298 - DNA, 685 bp, Homo sapiens
  misc_feature: GYAE6OF01CCPBF.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttagcctggtaccagcaacgaaaccgtggccaggcctcccgaggcctccctctctatcgctcgtcctccaccgacgggcccctggtcgtcccagtccgtaggttcgtcggggtcggtgggtcgtgggacgtagtactttcaccgttctcaccgatccgcggccgtcctccgtaggttcgtagtaacgttattttacgcttactttttactttcttacgttacctaaactacttaggttacggtcgtaacggttccggtcccttcccggtttaacgttacccggttttcggggacccgtaacgggggtaaaccctaaaccggtgggaacgtacgttaaccggaaaaccgtaacggttcggtacgggtacctacggccccttaaaccgtcgtttaccgttccggtttccttacgtaccctttccccggtcccccgtaaccc

SEQ ID NO: 219299 - DNA, 729 bp, Homo sapiens
  misc_feature: GYAE6OF01EC3UO.24.87.H10.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccacgtggagaagtagtcagtcgacgcagtcctaccacgccaccctgtctgtcgtcnccgagggaancgccacctctcgtgcgaggccagtgagtagtgttggcagctaactcgccgtagaccagacgaacgaaccgtcggaccacggtcctacccgagtccctcccgtcctacgtcgtcgtccttacgtccctacccgaccggtacccgggtccccgttggttacccgtacccgaggttaccccggttcgggttttccggtccgggggtccgggtttacggggtccgtaacggggtaccgttaacgttacgttttacccgtacgttaccccttacgaacccgtacgttcgaacccggtcccggttacccgtacgtttaccggtacgttaacggttaacgtttcgttttacgtacctttaacgtttttctacgtacgttaccctaaactcgtttacgtggtctaacgttcggtacccttacgttacgttaccgttcgggaaccgaggtaaccaaggtgaactacgtaacaccggtatggtcctacgactaccacgtctacgttcgtcttacgttcctccgtccgtac

SEQ ID NO: 219300 - DNA, 730 bp, Homo sapiens
  misc_feature: GYAE6OF01DPRRO.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttggggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanacgccaccctctcctgcagggccagtgagatggtggcagcacttgctgtaccagcaacgaaaccgtggccacggcctccgacggctcctcctctactgctcgtcctacccacgtacgtccggtccccgttcggtcgtcccgacgtcccgtagggttttccgggttagggtccgggggtttggggtaccggtacggggtaactaacgggttacttttaccgaccgtttccttacccgaaccttacgttaccgaaccggtccgggtccccttaccgacgttcgtacggtaacgtttacgttttcgtactttaacttttacgtttcttacgttaacctaaacgtacttaggttcggtacgtacgttccggtcccgttaccgttaccgtttaccgtttacggacccggttaacggggtaaccgtaaggttacgggaaacttacggtaaccaaaaccgtacgttacgggtaccggtataccgtaccaaccgtacttccgttacgttacctttacgcctttcccgtacccg

SEQ ID NO: 219301 - DNA, 260 bp, Homo sapiens
  misc_feature: GYAE6OF01AFLP9.24.87.H10.1.454.CMB.1.raw
  modified_base (256)..(260): a, c, t, g, unknown or other
  misc_feature (256)..(260): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttctcgccatctgaacatagtagtctgagcgggctggcaaggcgcatagnnnnn

SEQ ID NO: 219302 - DNA, 762 bp, Homo sapiens
  misc_feature: GYAE6OF01D7OMY.24.87.H10.1.454.CMB.1.raw
  modified_base (201)..(201): a, c, t, g, unknown or other
  misc_feature (201)..(201): n is a, c, g, or t
  modified_base (316)..(316): a, c, t, g, unknown or other
  misc_feature (316)..(316): n is a, c, g, or t
  modified_base (743)..(743): a, c, t, g, unknown or other
  misc_feature (743)..(743): n is a, c, g, or t
  modified_base (754)..(754): a, c, t, g, unknown or other
  misc_feature (754)..(754): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctgctcccagataccactggagaagtagtcatgacgcagtctccagccacctgtctgtgtctccgaagggaanacgccaccctctcctggcgaggccagtgagaagttgtggctagcaacttacgcctaggtaccagcaacgaacctcggaccaggcctacccgaggtcctccccgttcctacgtacncggtccgtcgtaccctcccgaaccgtaccgggccctgggtcctccgaacggtccgtagggtttccggtgggccggttagggttcgacggggacgttacggttaacttttcccaacgttcccgtacctaaacccgtcgttacccgaagggttccccgggaccccttacccggtaacggttacccgtaacggttaaaggtttacgtttttacgtaccgtttaactttttacgtttaccgttaacgttaacctaaaccgttacgttaacgttcgggtacgtaacttccgggtaaccctttaccgggttaaacctttaccggttttacgggacccgggtaacgggtaaaccctaaacgtacggtaacgtaacttaaccgaaccgtaacgttagtccgggtactacggacctaaccattcgtacgttacttnaacgtttcccncccgtacg

SEQ ID NO: 219303 - DNA, 658 bp, Homo sapiens
  misc_feature: GYAE6OF01EB2QF.24.87.H10.1.454.CMB.1.raw
  modified_base (150)..(150): a, c, t, g, unknown or other
  misc_feature (150)..(150): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (498)..(498): a, c, t, g, unknown or other
  misc_feature (498)..(498): n is a, c, g, or t
  modified_base (632)..(632): a, c, t, g, unknown or other
  misc_feature (632)..(632): n is a, c, g, or t
  modified_base (646)..(646): a, c, t, g, unknown or other
  misc_feature (646)..(646): n is a, c, g, or t
  modified_base (652)..(652): a, c, t, g, unknown or other
  misc_feature (652)..(652): n is a, c, g, or t
tcagactactatgtcacgaccggtgctcgatttagcagtactgcgttgggttgggggaggaactgctcagttaggacccagacggaaccatggaagccccagcgcagcttctcttcctcctgctactctggctcccagataccactgganaagtagtcatgacgcagtctccagcccacctgtctgtgtctccgaggggaaanacgcccaccctcncctgcagggccagtgagatggttggcagctaacttagcctaggtaccagaccaacgaaaccgtcggaccaggtcctccccgaggtccctcccttccctctactcgtcgttcgtccctaccgacccgtaccgggtcccctgggtcctcccgacgtccgtagggtttccgggtcggggtccggttcggggttcgtacggggaactacggttacttttaccaccgttctacccgtaacctacgtccgtacggcccggtaccctacgtacgtcctagtaacgtttntttacgtccttaacgttttcttcgtacgtactaaactcgttaagtcgtacgtcgtcgtaccgttccgtacttacgtttcggacccggtaggaccaagtcggaatactacgaacgtacgtgtcgctacgccactntacctcgtactacncttccnccgtac

SEQ ID NO: 219304 - DNA, 821 bp, Homo sapiens
  misc_feature: GYAE6OF01B8G19.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagcccagcgcagcttctcttcctcctgctactctggcctccagataccactcggagaagtagtcatgacgcagtctccagccacctgtctgtgtctccgaggggaangccctacctctccgtgcacgggccagtgagaactggttggcagactaacgttacgcctaggtaccaggacaacgtaaaccgtggacctaacgggccctacccgaggtccttcctctctatcgtcgtgtccctccaccgtacggggtccccttagggtccgtaccctacggtccccgtagggtttccggttcggggtccggggttcgggtaccggttaggggtaacctacgggttacttttccgaccgtttcgtacccaaccgtacgtccgacgggtcccggtaccttaccgtaacgttacgttaacggtaagtttacgttttacggtaccgtttaacgttttactttaccgttacggtaccttaaaccgtaaccgtttagttcgggtaccgtaaccgttccggtcccgttaaccgttaacccgttaccggttttaccgggaacccgggtaacgggtaaaccccgtaaacggttacggtaaacggtaaccttaaacccggtaaaacgggtaaccgtttacgggtaccggttacccttaacggtacccttaaacccgtaacgtttacccgtttacggttacccttttaaccctacgtttcccccgttaacccggtaccccg

SEQ ID NO: 219305 - DNA, 609 bp, Homo sapiens
  misc_feature: GYAE6OF01AWG3R.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtcagagtataagagacaactacttagcctggtatcaacagaaacctggccaggcctcccaggcctcctcatctatggtatatccagcagggccacgtggtcgtcccagtccaggttcaggtggactagggtcgggtcgtggggactagggtacgtttccacttcctcaacccgatccgaagctacgtctgctagtctagtagtatttgacttagttttagttactgaccagtcacgactacgaggtctaccgtggtaccgccgttaccgtaccggtttccgggacgggtaaccgggtaaccggtaaaggggtaggaacggtaacgtaaccggtaaaacggtaaccggttcggtacgggtacgtacggtccgtaaccggtacg

SEQ ID NO: 219306 - DNA, 258 bp, Homo sapiens
  misc_feature: GYAE6OF01D4JIJ.24.87.H10.1.454.CMB.1.raw
  modified_base (257)..(258): a, c, t, g, unknown or other
  misc_feature (257)..(258): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaacatagtagtctgagcgggctggcaaggcgtcatagnn

SEQ ID NO: 219307 - DNA, 634 bp, Homo sapiens
  misc_feature: GYAE6OF01DUYXT.24.87.H10.1.454.CMB.1.raw
  modified_base (259)..(259): a, c, t, g, unknown or other
  misc_feature (259)..(259): n is a, c, g, or t
  modified_base (378)..(378): a, c, t, g, unknown or other
  misc_feature (378)..(378): n is a, c, g, or t
tcagactactatgtcacgaccggtgctcgatttagcagtactgcgttgggtttggggaggaactgctcagttaggacccagagggaaccatggaagccccagctcagcttctcttcctcctgctactctggctccagagaccaccggagaaattgtgttgacacagtctccagcaccctgtctttgtctccgagggagagacgccacctctcctgcgaggccagcggagtgttagtaagtacttaggctggtaaccaanacgaaacctggccaggcctccgagctcctcatctatgactgtcctaccaagcgggtcacgtcggccgttacccgctaggttcaggtgctaggtcggtctagggacagtaccttcactcncacgtcagcagcctagacgtctaggtaattacttttcgtacgtttactcgttcgacgagcgtacgtccggttcccgtccgtacggcccgttacgttaaccgggttcggggaccgggggtaacctaggggtacggacggaaggtacggaaccggtagtcgggcgtcctacgaccctaaccgtcgttccgtacgtttaccttacgtacccgtttcccgttacccccgtctaacttcctaacgtaccgtaagttaccgg

SEQ ID NO: 219308 - DNA, 831 bp, Homo sapiens
  misc_feature: GYAE6OF01D7ES3.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaaggggaagcgccaccctctcctgcgagggccagtgagatggtggcagctaactagccgtgtaccagcaagaaccgtggccaggcctcccgaggtcctcccttcctctagtcgtcttcgtcctcccgaccgaccggggtcccccttgggtccgtccccgaggtccccgtaggggttttccggttcgggggtcgggttcgggggttcgtcgggggacgtagggttacttttccgaaccttcgtacccacctacgtccggaacggtcccgggttcccttacccgtacggtttccgtaagggttaaacgtttcgtttttacggtaccttttaacgttttttacgtttaccgtttacggttaacccttaaacctaacgtttacggtttacgggtttaccgttaccgggtccgggttaccccgtttaccccgttaacgttttaccccgggtttttacggggaccccgggtaaacgggggttaaaccccctaaagggttcggggaacgtaaaccgttaaaccggaaaaccggtaaacggtttcgggtacggttccggttaccgacccgtaaaccgtaccgtttacggtttacccgttacccgtttacgtaccccttttcccccggttcccccgttaacccg

SEQ ID NO: 219309 - DNA, 653 bp, Homo sapiens
  misc_feature: GYAE6OF01BVQ90.24.87.H10.1.454.CMB.1.raw
  modified_base (403)..(403): a, c, t, g, unknown or other
  misc_feature (403)..(403): n is a, c, g, or t
  modified_base (437)..(437): a, c, t, g, unknown or other
  misc_feature (437)..(437): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgagggaaagagccaccctctcctgcagggccagtgagaatgttggcagcaacgttagcctggtaccagcaagaaacctggccaggcctcccgacggcctccctcctctatgctcgtcctccaccgacgggtcccctggtcgtccccaggcccgtagggtttccggttgggcgggtcgggtctggggactagtactttcactctcacctntccacggccggccctccgtacgtctaggtaagtnttttcgcttacttttattcgttgtacctaactcttagtggtcgtacgtcggtcccgttaccgttacgttaccgttttcgggaccggtaacggggtacctaacggtacggaacgtactaacgtaaaaccggtacgttacgggtcggtccgtacggtccaacccgttacgttccgttacggtttccttacctacctttccccgttccccgtaaccccg

SEQ ID NO: 219310 - DNA, 635 bp, Homo sapiens
  misc_feature: GYAE6OF01EI0CR.24.87.H10.1.454.CMB.1.raw
  modified_base (322)..(322): a, c, t, g, unknown or other
  misc_feature (322)..(322): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagacgcccaccctctccgtgcgagggccagtgaagaatggttggcagcaacttagcctggtaccagcaagaaacctggccaggcctcccaggcctcctcctctatgctgtctcccgaccncgggcccctggtctcccagtccgaggttcgttggcggtgggtcgtgggactaggtattcactctccactatcacgccggtcctccgagttcgtagaagtagttttcgacttacttttatttccttagtacctaactacttagtcggtcgtacgtcggtccttaccgttaacttaccgttttcgggaccgtaccggggaacctaaacggtcgggtaagtaactaccgtaaaacgaacgttcgggtggaccgttacggtaccctaacctacgttcgttaccgttcgtttacctacttcccgttccccggtaaccc

SEQ ID NO: 219311 - DNA, 611 bp, Homo sapiens
  misc_feature: GYAE6OF01ERIV8.24.87.H10.1.454.CMB.1.raw
  modified_base (205)..(205): a, c, t, g, unknown or other
  misc_feature (205)..(205): n is a, c, g, or t
  modified_base (367)..(367): a, c, t, g, unknown or other
  misc_feature (367)..(367): n is a, c, g, or t
  modified_base (380)..(380): a, c, t, g, unknown or other
  misc_feature (380)..(380): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctcgaggggaaagngccaccctctcctgcgaggccagtgagatgtggcagcaactgcctggtaccagcagaaacctggccaggcctcccaggtcctccttccctctatcgctgtcctccgaccgcgggcccctggtcgtccagccgtagggttcgtgggcggtgggtcgtgggacngtatttcacttcncaccgatccgagccggcctcgagttcgtagaagttacttttgaccttacttttactttccttagtacctaactacttagtggtacgtacgtcggtcccttccgttacgttacgtttcgggaccgtaacggggacctaacgtggaacgtacgtaacgtaaacgtacgttcggacggttacacggcccaacgtactccgtttacgttccttactaccttccgtccccgtaccg

SEQ ID NO: 219312 - DNA, 635 bp, Homo sapiens
  misc_feature: GYAE6OF01BC1JI.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaanacgccaccctctcctgcagggccagtgagatgtggcagcaacttgcctggtaccagcagaacctggccaggctccgaggctcctcctctatcgctgtcctccaccgacggtcccctggtctccccgagccgtaggttcggtgggcggtggggtctgggacagtacttcactctaccgacatcgacggccgtcctccgagttcgtagtaacgttattttcgacttactttactttccgtgtacctaactacgttagtggttacgtacgttcggttcccgttaccgttaccgttaccggttttcggacccggtaacggggtaaccctaaacggtgggtaaacgtactaaccgaaaaccggtacgttcggtacggtccgtaggtccctaacgtacgttcgttacggttactttaccacgttcccctcccggtacc

SEQ ID NO: 219313 - DNA, 762 bp, Homo sapiens
  misc_feature: GYAE6OF01DXKNC.24.87.H10.1.454.CMB.1.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagactaccatggagaagtagtcatgacgcagtctccagccacctgtctgtcgtctacgagggaancgccacctctctgcgagggcagtgagtatgtgcagacatgctgaccagcagaacngcagcctccagcctcctcctctagtcgtcttcgtcctcccgaccgtaccgggtcccctgggttccgccccgtacggtcccgtagggttttccggtcggggtccgggttacgggttcgtacggggactagggttacttttccgaccttaccgtacctaacccgtaacgttccggacggtccccggtacccgttaccgtacggttaccgtacggttaacgtttacggtttttacgtacccgtttaacgtttttacgttttaccgtttacgttaaccgtaaacttacgtttacgttacggttacggtaccggttccggtacccggtttcccggtttaacccgtttaccggtttttacccgggacccggtaacggggtaaacccttaaccggtacggtaacgtaaccgtaaaccgtaaaacggtaccgttacgggtcggtacgtacgtaccctaaccgttacttccgttacgtttaccgttaccttaccttcccgttacccggtaaccc

SEQ ID NO: 219314 - DNA, 608 bp, Homo sapiens
  misc_feature: GYAE6OF01BAG3Q.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagcccaccctgtctgtgtctccgaggggaaancgcccaccctctcctgcgagggccagtgagaatgtggcagctaattgcctggtaccagcaagaacctggaccaggcctccgaggtcctccctcctatatcgctcgtcctccaccgtcgggccctggtcctcccgagtccgtagggttccggttgggcggttgggtcgtaggggactaggtctttcgacctcgtaccactactcgacggccgtcctcgagtcgtagtaagttatttcgacttactttcttctagtacctaactactagttggtacgtacgtcgtccttaccgttacttcggtttccggaccggtacgggtaacctaaggtcgaacgtacgtaaccgaaacgtacgtggacggtctacgctacctattctcgttcctactcttccgtcccgtac

SEQ ID NO: 219315 - DNA, 666 bp, Homo sapiens
  misc_feature: GYAE6OF01C6I4K.24.87.H10.1.454.CMB.1.raw
  modified_base (624)..(624): a, c, t, g, unknown or other
  misc_feature (624)..(624): n is a, c, g, or t
  modified_base (631)..(631): a, c, t, g, unknown or other
  misc_feature (631)..(631): n is a, c, g, or t
  modified_base (649)..(649): a, c, t, g, unknown or other
  misc_feature (649)..(649): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatacccacgtggagaagtagtcatgacgcagtctccagccacctgtctgtcgtctccgaggggaaagcgcccacccgtctcctgcgagggccagtgagtaatggtggcagactaattacgctaggtaccagcaacgaacctggccacggcctacccgaggtcctacccgtctactatcggtctcgttcccaccgaccggacgggtccccagttcgggtaccgtccccgaagggtcccgtagggtttccggttgggtcgggttcgggtcgtagggtacgtaacgttactttaccgacttcgaccgtaccagttccggacgacccggtccctaccgtacgttacggtagtaaacgtttcgttttacgtaccgtttaacttttacgtttctacgttaccaacgtacgttagtggtacgtacgttcggaccttccgtacgttcgttcggaccgtacgggtactacgagtacagtaacgaacgtagtcgngtccgancctaacgcttacgtactnttcacgttcccgtaccc

SEQ ID NO: 219316 - DNA, 567 bp, Homo sapiens
  misc_feature: GYAE6OF01D0KRR.24.87.H10.1.454.CMB.1.raw
  modified_base (383)..(383): a, c, t, g, unknown or other
  misc_feature (383)..(383): n is a, c, g, or t
  modified_base (543)..(543): a, c, t, g, unknown or other
  misc_feature (543)..(543): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagacgccaccctctcctgcagggccagtgagaatgttggcagcaacttgcctggtaccagcaagaacctggccaggcctcccgagcctcctcctctatgctcgtcctccaccgacgggcccctggtccgtcccagccgtaggttccgttgggcggtgggtcgtgggactagtattcactcncacatcacgcgcctcgacgtctagtagtactttcgacttactttattctgttacctaactactagttggtacgtcgtcgtccgttaccgttaccttacgtttcggaccgtacgggaactaacgtgaacgactaacgaaacgtagtgtcgactcgcacctntcgttctctactctccgtcctacc

SEQ ID NO: 219317 - DNA, 985 bp, Homo sapiens
  misc_feature: GYAE6OF01E2UB2.24.87.H10.1.454.CMB.1.raw
tcagactactatgtcacgaccggtgctcgatttagcagtactgcgttggggtttgggggaggaactgctcagttaggacccgtagacggaaccatggaacgccccagcgcagccttctcttcctcctcgctactcctggcctcccagactaccactggacgaagtagtcatggacgcgacgtctccagcccaccctgtctgtcgtcctcccgagggaaagcgcccacccgtccgtcctggacgacgggccctaggtcgtagtaacgttggttacgggacacggtacctaaacctttacggacccgttacgggtaacccgaaggtaaccgtaaaccggtaaaacccgttacggggtaccccgtaacgggtaccccgtacccccgtaaccggtaccccgttacccccgtttaccccgtacccgtttaaaccgttaccgttcccttacggttaccccgttaaccccgaacccgggtaacccggggttacccccgtttacgggttacccggtacccccgtaaccgggtcccgggttaaccggggtttcccgggtttacggggtccggggtttaccggggttaccggttacgggggtaccttaaggggtttacccttttacccggaaccgtttcccgtaccgtaaaccccgtacgttacccgaaccgggtccccggttaccccgttaccggtaaccgtttcgtaacggggttaacggtttacgttttaccgtacccgtttaagttttttacggtttaccgtacgggttaacctaaaccgttacgtttacggttacgggtttaccgtacccggttccggtacccttaacccgggttaacgtttacccgggtttaccgggacccggttaaacggggaacccctaagggtacgtaacgtaaccgtaaacgtaaaccgtacggttacggtcggtacgtaccgtaaccgtacctagttacccgtcgttaccgttacctccgttcccgtccctacg

SEQ ID NO: 219318 - DNA, 575 bp, Homo sapiens
  misc_feature: GYAE6OF01BS1I1.24.87.H10.1.454.CMB.1.raw
tcagactactatgtcacgaccggtgctcgatttagcagtactgcgttgggtttggggggaggaactgctcagttaggacccagacggaaccatggaagccccagcgcagcttctcttcctcctgctactctggctcccagataccactggagaagtagtcatgacgcagtctccagccaccctgtctgtgtctccaggggaagagccaccctctcctgcagggccagtgagaatgttggcagcaacttagcctggtaccagacagaaacctggccaggcctcccaggcctcctcctctatgctgtcctccaccgcggtcccctggtcgtcccaggcctaggttcggttcgggcgggtcgggtcgtggggactaggtatttccacttctcaccatccacggccgcctccacgtcgtagtagtatttgtcttactttactttctgtactactactagtggtgtacgtcggtcctccgtactacgtttacggccgtacgggtaaccaacgtaggagactacgaaacgtacgtacgtcggtctacgcacctatcgtcgttctctacttccgtccgtacc

SEQ ID NO: 219319 - DNA, 661 bp, Homo sapiens
  misc_feature: GYAE6OF01BIHWH.24.87.H10.1.454.CMB.1.raw
  modified_base (210)..(210): a, c, t, g, unknown or other
  misc_feature (210)..(210): n is a, c, g, or t
  modified_base (437)..(437): a, c, t, g, unknown or other
  misc_feature (437)..(437): n is a, c, g, or t
  modified_base (473)..(473): a, c, t, g, unknown or other
  misc_feature (473)..(473): n is a, c, g, or t
  modified_base (490)..(490): a, c, t, g, unknown or other
  misc_feature (490)..(490): n is a, c, g, or t
  modified_base (629)..(629): a, c, t, g, unknown or other
  misc_feature (629)..(629): n is a, c, g, or t
tcagactactatgtcacgaccggtgctcgatttagcagtactgcggttggggtttgggggaggaactgctcagttacggacccagacggaaccatggaacgccccagcgcagcttctcttcctcctgctactctggctcccagataccactggagaagtagtcatgacgcagtctccagcccaccctgtctgtgtctccgaaggggaaanacgcccaccctctcctgcagggccagtgagaagtgttggcagactaacttacgccgtagggtaccaggaccgaacgaaaccgtcggccgaacggcctacccgacggtcctccctcctcgtatcgcctcgtcctcccgaccgccgggtccccgtggtcgcccaggtaccgtacgggttccggtggggcggttcgggtcgtgggactagtacgttcacctctacgaccncgtcgacggccgcccttacgtatccgtagaactttntttcgactttaactttntttctacgtacaaacttactagttcggtacgttctccgggtccttaccggttacttaccggtttcggacccgggtaacggtaacctaaacggtggaactaacgtaaccgaaacgtacgtggtacgtctacggcctaccngttcttcgtcttacgtaccttccgttcccgac

SEQ ID NO: 219320 - DNA, 724 bp, Homo sapiens
  misc_feature: GYAE6OF01B9M4H.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagcgcccaccctctcctgcgacgggccagtgaagaatggttggcagactaacttagccgtggtaccagcaacgaaaccgtggccacggcctcccgacggtcctcctcctctacgtcgtctgtcctcccaccgacgggccccgtggtcgtccccgacgtccgtacgggttcggttcgggcgggttcgggtcgtcgggacgtagtacgtttccaccgttcctacctacctagtccgacggtcccggtccctaccgtacgttccgttaggtaacgtttacgttttacgtacctttacttttactttcgttactacctaaaccttacgttagttggttacgtacgtccggtcccgttaccgttaccgttaccggttttaccgggaccgggtaaccgggtaacccgtaacggtacggtaacgtaccgtaaaccgtaaaccgtaacgttcggtacggtacgtacggtaccctaaccgttacgttcgttaccgttacttaccgtacccttccccgtttcccgtaacccg

SEQ ID NO: 219321 - DNA, 843 bp, Homo sapiens
  misc_feature: GYAE6OF01C0WUM.24.87.H10.1.454.CMB.1.raw
  modified_base (191)..(191): a, c, t, g, unknown or other
  misc_feature (191)..(191): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccactggagaagtagtcatgacgcagtctccagccacctgtctgtgtcnccgaggggaaagcgcccaccctctccgtgcgagggccagtgagaatgtggcagacaacgttagcctaggtaccagcaagaaaccgtggaccaaggtcctacccgaggtcctccctcctacgtatcgctcgtcctcccgtaccgacgggtccccttgggtccgtaccccgtacggtacccggttacgggtttccgggttacggggtcggggttcgggggttaccgttacggggggaaccttaacgggttaccgtttttaccaaccgtttcccgttaacccgtaaacccgtaacgttaccggaccgggtccccgggtaccccgttacccgtaacgggttcccgttaaggtaaacggtttaacgtttttaccgtaaccgttttaacctttttaacgttttaccgttacgttaaccttaaacgttaacgttaacgtttacgggttacggttaccgttccgggtacccttaacccggtttaacgttacccggtttttacgggaaccgggttaaccggggtaaaccctaaacgggttacggaacgttaacgtaaacccggtaaaacggtaacgttacggtcggtacctacggtaccctaaccgttaacgttcgttacggtttaccttaccgttacccgttcccgtttccccgtaaccg

SEQ ID NO: 219322 - DNA, 793 bp, Homo sapiens
  misc_feature: GYAE6OF01DZ7PI.24.87.H10.1.454.CMB.1.raw
  modified_base (207)..(207): a, c, t, g, unknown or other
  misc_feature (207)..(207): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagactaccactggagaagtagtcatgacgcagtctccagccaccctgtctgtgtctccgagggggaaancgcccaccctctcctgccgacggggccaggtgaagtaattggttggcaggacaacttagcctggtaccagcaagaaacctggccaggcctcccgacggtcctccctcctctactcgccttgtcctacccgaacgccgggtcccctggtccgtacccacgccgtacgggtttcggtcgggtaccgggttggggtcgtggggactaggttactttccgacttcctaccgtaacgactaccggacggtcccgggtacccttccgtaacgttccgttaggtaaacgtttacgtttttacgtaccgtttaactttttacgtttccgtttacgttaacccttaaacgttaccgtttaacgtttcggggttacgtaaccgtttccgggtacccctttcggttaacccgtttccgttttaccggggacccggttaacggggtaaacccgtaaacggttacggggaacgtaacttaaaccgggaaaccggttaacggttacgggtaccgggttacgtaccggaccccttaacccttacggttactttccggtttaccctttaacgttaccccgtttccccgttacccgtaccccg

SEQ ID NO: 219323 - DNA, 781 bp, Homo sapiens
  misc_feature: GYAE6OF01B97DP.24.87.H10.1.454.CMB.1.raw
  modified_base (211)..(211): a, c, t, g, unknown or other
  misc_feature (211)..(211): n is a, c, g, or t
  modified_base (460)..(460): a, c, t, g, unknown or other
  misc_feature (460)..(460): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtcctccagcccaccctgtctgtcgtctaccgaaggggaaacncgcccaccctctccgtgacgacgggccaggtgaagtaagtggttggacagactaacgttacgccgttacgggtaacccaggaccgaaacggtaaaaccgtcgggacccgaacgggtcccttaccccgacggtcccttcccgtactaactttccgttaagttcggtaacttacgtcccgaggtccggaccgggtccccgttgggtaccgtacccgaggtccgtagggtttccggtgggtcgggtggtcgnggtactagtacttcacgtctacgactagtcgacgtcccggtcctacgtacgtcgtaggtaacgttacgtttacgtacgtttacttttacttccgttacgttacctaaacgttacgttagtcggtacgtaccggtcggtacccgttaccgttaccgttaccggtttacgggacccggtaacggggtaacccgtaacggtacggtaacgtaaccgtaaaccggtaaacggttaccggttaggttaccggtaccgtaccggtaccctaacgttaccgtttaccgttaccgttaccctttaccttaccgttccccgttaaccccg

SEQ ID NO: 219324 - DNA, 628 bp, Homo sapiens
  misc_feature: GYAE6OF01D0A87.24.87.H10.1.454.CMB.1.raw
  modified_base (204)..(204): a, c, t, g, unknown or other
  misc_feature (204)..(204): n is a, c, g, or t
  modified_base (371)..(371): a, c, t, g, unknown or other
  misc_feature (371)..(371): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagcccaccctctcctgcagggccagtgagaatgttggcagcaacttagcctggtaccagcaagaacctggccaggctccaggctcctcctctatcgctgtcctccaccgacgggcccctggtcgcccagccgtaggttcggtggcggtcggggtcgtgggactagtntttcacttctcaccgatcgacgccggtcctccgtacgtctacgtaagttacgtttttcgactttacttttactttccgttcgttactaaactacttagtcggttgtacgtccggtccttaccgttacttacgttttcgggaccgtacggggtaacctaacgtagggatacgtaacgaaaacgtacgtaggtcgggtctacggtctacccgtattccgttacgttacctttaccgtaccttcccgttaccccggtacc

SEQ ID NO: 219325 - DNA, 710 bp, Homo sapiens
  misc_feature: GYAE6OF01BHYDQ.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaaancgcccaccctctcctgcgagggccaggtgaagaatggttggcagctaacgttagccgtaggtaccagacaacgaaccgtcggaccaggcctcccgacggtcctccccttcctactacgtcgtccttcgtcctaccgacccgacgggtccccgtggtccgtccccacggtccgtaggttactacggttcgggtcggggttgggtccgtacgggaacgtacggtaccttcgacccttcgtaccaacctatccaagccgtacgtccgtagggactaacgtaggtaagttatttagactaagttgttaactttacgtagtacgtacgacgtagtcggtacgaacgtaaccggtcgtaaccccgttacctaacgttaacgtaccgtttacggtttaccgggaccggtaacggggtaacccgtaaacgggcgttaacgggaaccttacggttaaccggaaacgggttaaaccggtaacgttcgggaccggtacctcgtaaccgtaccgtaccg

SEQ ID NO: 219326 - DNA, 717 bp, Homo sapiens
  misc_feature: GYAE6OF01EE7U8.24.87.H10.1.454.CMB.1.raw
  modified_base (202)..(202): a, c, t, g, unknown or other
  misc_feature (202)..(202): n is a, c, g, or t
  modified_base (642)..(642): a, c, t, g, unknown or other
  misc_feature (642)..(642): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgagggaangcccaccctctcctgcaggccagtgagatgtgcagcaacttgccgtggtaccagacaacgaaccgtggaccaggcctccccgaggtcctacccgtcctcgtactgtctcgtcctacccgaccgtaccgggtccccttgggtccgtccccgacggtcccgtagggttttccggttcggggtcgggtcgggttccgttacgggggactaggttacctttccgtaaccttccgttacccgaaccttacgttacccgaacgggtcccggtacccttacccggtaacgtttaccgttaacggtaacgtttacgtttttcggtaccctttaacgttttttacgtttccttacgttaacctaaccgttactttacgttggtacgtacgttccggacccgttccgttaccgttacgtttcggacggtaccgggaacctaagtcggaanacgtaacgaaaccggtagtcggtcgtagtacgcctacctagtccttagtacccttactactcccgtcccgtaccg

SEQ ID NO: 219327 - DNA, 782 bp, Homo sapiens
  misc_feature: GYAE6OF01A4RRK.24.87.H10.1.454.CMB.1.raw
  modified_base (207)..(207): a, c, t, g, unknown or other
  misc_feature (207)..(207): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgatgcagtctccagcccaccctgtctgtgtctaccgaggggaaancgcccaccctctcctgcaggccagtgagatgtggcagcactgcctggaccngcaagaaccgnggccaggcctcccgaggcctccctccgtctactcgtcctcgtccctacccgaccgtaccgggtcccccttgggtccgtcccccgaggtcccggttagggtttccgggtggggtccgggggttcggggtccgtacggggaacctacggttacttttacccgaacccttcctaaacccgtaccgtaacgtcccggaacgggtccccggtcccgttacccgtacggttaccgtaaggttaaacgtttcgttttacggaaccctttaacgtttttacgttttccgtaacggttaaccctaaacgttacgttacggttagggttaccggttaccgttccgggtacccctttacccggttaccgtttaccgggttttccgggaacccggtaacggggtaaccctaacgggtacggtaaacgtaacccgtaaaccggtaaaacggttacgtcggttacgggccttacggacccttacgtacttccggttactttacctaccctccttccccgttaccccg

SEQ ID NO: 219328 - DNA, 787 bp, Homo sapiens
  misc_feature: GYAE6OF01DY0MT.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagcgccaccctctcctgcaggccagtgagatgtggcagcaacttgcctggtaccagcaagaaacctggccaggcctcccaggcctcctcctctatgctcgtcctcccaccgcgggtcccctgggtccgtcccgacgtccgtagggtttccggtgggtccgggttggggtcgtggggactaggtactttcaccgttcctaccgaacctagttccgacggtcccggtccccttacccgacgttccgttaaggtaacgttacgtttttcggacctttaactttttaacttttaccgttacggttaacctaaacccgttaacgttaggtttacgggtaacgttacccgtttcgggttacccccgtttaacccgtttaacccgtttaaccggtttttaccggggaaccccggttaaacgggggtaaccccttaaacgggttacggggaacgtaaaccgtttaacccggaaaaaccggttaaaccggttcggggtacgggtacccgttaccggaacccgttaacccgttaacgtttccgttaccgggtttaccctttaaccgtacccgtttccccgttcccccggtaaccc

SEQ ID NO: 219329 - DNA, 825 bp, Homo sapiens
  misc_feature: GYAE6OF01EU3JM.24.87.H10.1.454.CMB.1.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagactaccactggagaagtagtcatgacgcagtctccacgccaccctgtctgtcgtcncgaaggggaacncgccacctctcctgcagggccagtgagtatgtgcagcacgtcgctggtaccagacaacgaaaccgtggaccagcctacccgacggtccctcccgtcctacgtacgtcgtccgttcgtaccctacccgaccggtacccgggtcccccgttgggtacccgtaccccggaacgtcccggttacgggtttccggtcggggtccggggttgggttaccgggtaggggtaacctaggttacctttaccgaccgttaccctaccgtaacccgtaacgtccgtaacggtacgtaacgggttaggtaacgggtaccggttaccgtaagggttaaacggttttacgttttaacgtaacgtttaacgttttaaacgttcgtttaaccggttaacgtacgtaacccggtacccggttaactaaccgtacccgggtaccggttacccccgttaacgggttttccccgggacccgttaacggggaacccttaacgggtaaccgtaccgtaaaccgaccggttaaaccccgtaaagggttaccgtacggcggttaccgaacgtaccccgtaaacgtctttaccggtacgttttccccgtaaaccttccccgtttccccgttaccccgtaacccg

SEQ ID NO: 219330 - DNA, 668 bp, Homo sapiens
  misc_feature: GYAE6OF01CGVX1.24.87.H10.1.454.CMB.1.raw
  modified_base (210)..(210): a, c, t, g, unknown or other
  misc_feature (210)..(210): n is a, c, g, or t
  modified_base (430)..(430): a, c, t, g, unknown or other
  misc_feature (430)..(430): n is a, c, g, or t
tcagactactatgtcacgaccggtgctcgatttagcagtactgcgttgggtttgggggaggaactgctctagttaggacccagacggaaccatcggaagcccagcgacagcttctcttcctcctgctactctggctccagataccactggacgaagtacgtcatgacgcagtctccagccacctgtctcgtgtcctccgagggggaaacncgccacctcgtcctgcgacgggccagtgacgtaatggttcgcgagtactaacgttacgccgttacggtacctacgacgaaggtaaaacccgtggaccgaacgggtccctaccgtacggtccttcctccgtactaacgtcgtctcggtcctccgaaccgtccgggtcccgtgtccgttacccagccggtacggttccggttgggcggtcggtacgtggacngtactttcgacttccgtacacctactcgaggccgtacctcctacgtcgtcgtaacgttctttcgtacgttactttagttctcgtacacgttactacgtcggtgaaccttggtacctccgtcttacgtttcggaccgtacggtaacctacggttagacgtacctacggtaaccgtacgtggttacggctacgcctacgtcctacgtacgttacctcgttaaccttccgtaccgttaccg

SEQ ID NO: 219331 - DNA, 862 bp, Homo sapiens
  misc_feature: GYAE6OF01C6FBG.24.87.H10.1.454.CMB.1.raw
  modified_base (217)..(217): a, c, t, g, unknown or other
  misc_feature (217)..(217): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccacgtggaagtagtagtcatgacgcagtctccacgtccaccttgtcctaggtcgtacctaccgaaggggtaaacncgtacccacccgtcgtcctggaccgaacggggcctaaggttaggaacgtaaagttcggttacggaccgaacgtactaaacgttacggccgttacgggtaccaggtaccgaacggtaaaccgtcggacccgaacggtccctaccgtacggtccttaccgtccttacgtactcgtctacgtcctccgaccgtaccggcccgtaggtcctaccgacggtccggtacgggtttcggtcgggtacggttgggtcgtagggtacgtacggtaccgtttacgaccgttacctaccgtaccgacgttaccgaccggtccgtaccgttaccgtacgtttacggtacggttaaacgtttcgttttaccggtaccttttaacggttttactttacggtacttaaccgtaaaccgttacgttacggtttacgggttacgttaccgtttaccgggttacccgtttaaccgttaaccggtttaccgggttttaaccgggaacccgggtaaaccgggttaaaccgttaacggttacgggaaacgtaaaccgttaaccggaaaaccggtttacggtcggttaaccggtacttaccggaacctttccgtaaacgtttccgttaccgtttaccttaccggtaccttcccgttaccccgtaacc

SEQ ID NO: 219332 - DNA, 684 bp, Homo sapiens
  misc_feature: GYAE6OF01A6ILH.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaaancgccaccctctcctgcaggccagtgagatgtgcagcattgcctaggtacagcagaacctgaccaggcctccgaggtcctacctcctctatcgtcctgtccctaccaccgtacgggtcccctgggtacctccccgagtccgtagggttccggtcgggtcggtcgggtccgtaggggaacctaggtactttccacgttccgtacaccgtaatccggacgtccggtaccctcgtacgttctacgtaagtttactttcgtacttacgttttacttaccttacgttacctaaacgtaccttagtcggtacggtaccgtccgtaccgttccgttaacgttacggtttcggtaaccggtaacggggtaacctaacggtacggtaacgtacgtaaccgtaaacggtaacgtcggtacgggtactacggtaaccctaaccgtacgttaccgttacgttacccgttacctaccgtttcccgtccccgtacc

SEQ ID NO: 219333 - DNA, 940 bp, Homo sapiens
  misc_feature: GYAE6OF01BSY43.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaagcgccaccctctcctgcagggccagtgagatgttggcagctaacttagcctaggtaccagcaacgaaacctggaccaggcctacccgaggcctcctcctctactcggcctcggtcctccacccggacgggtccccttgggtccgtacccgagtcccggtagggttcccggtttgggggccgggttacggggttccgtacgggggtaaccgtagggtttacttttaccgacctttcccgtaacccgaacccttacgtaccggaaccgggtccccgggtacccctttacccgtaacgggtttacccgttaacggttaaacggtttaccggttttttaccggtaaccgtttttaacccgttttttttaaacgtttttaccccgtttaacgggtttaaacccctaaaacccggtttaaccgttttaacggggtttaccggggttaacccggttttaaacccgggtttcccgggtttaacccccggttttaccccgggttttaaaccccggttttaaccccgggttttttaccgggggaccccggttaaaccgggggggtaaaaccccttaaacgggtacgggtaaaccggttaaaccgttaacccggttaaaaaacccggtacggtttacgggtttaccggggttacccgtaccggtaaccctaacccggtttaacttacccggtttacggttacccttttacccgtaacccgtttttcccccggttccccccggttaaaccg

SEQ ID NO: 219334 - DNA, 678 bp, Homo sapiens
  misc_feature: GYAE6OF01A9A8D.24.87.H10.1.454.CMB.1.raw
  modified_base (659)..(659): a, c, t, g, unknown or other
  misc_feature (659)..(659): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaaggggaaagcgcccaccctctcctgcagggccagtgagaatgttggcagacaacttgcctggtaccagacagaaaccctggaccaggcctcccgaggcctcctaccctctactcgctcgtcctccaccgacgggtccccctgggtcgtccccacgccgtacgggttcgttcggggcggttggggtccgtggggactaggtactttccgacttcctaccaccacgttccgacggcccggacccttccgagttaccgttggtaacgttactttttacggacttaccttttttacgtttcctacgtaccttaaaccgactttagtcgggtaactcgttcggtcccgttccgttaacttaccggttttccgggaacccgtacggggtaaccctaaacggtcgggaaactagtaccgaaacgtacgtcggtaggtacacgccaacccgtattcctcggttccttacncgtttcccctcccgtaccg

SEQ ID NO: 219335 - DNA, 698 bp, Homo sapiens
  misc_feature: GYAE6OF01BZWMO.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggcctcccaggcctcctcctctatgctgtcctccaccgacgggcccctggtcgtccccagtccctagggttcgttgggcggtggggtctggggaccaggtactttcacgttctaccacctatcacggccggcccttccgaggttcctgaacgttatttttcggcttacttttatttccttagttacctaaactacttagtcggtacgtacgttcgggtcccttacccgttaaccttacgtttttccgggacccggtaacgggggtaacccaaacggttacgggaacgttaacgtaaccggtaaaaaccggtaaccgttacgggttacgggtaccgttacggtacccgtaaccccgttacgtttacccgttacggtttacccttttacccgtaaccgttttccccgtttcccccggtaaccccg

SEQ ID NO: 219336 - DNA, 771 bp, Homo sapiens
  misc_feature: GYAE6OF01AZYMP.24.87.H10.1.454.CMB.1.raw
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccaccctgtctgtgtctccgaaggggaagcgcccaccctctccngcaggccagtganatgtgcngacatagctggtacagacagaacctggaccnggcctccgacggtcctcctcgtctagtcgcttcgccctccgaccgtaccgggtccctggtcccgtccgacgtccgttagggtttccggtcggggtcggttgggtacgtgggtaactaggtacctttaccgacgttccctaccgtaacctacgtccgaccgggtcccggtcccgttacccgtaggtttaccgtaacggtaacgtttacgtttttaccgaccgttttacctttttaacgtttaccgtacgttaaccgtaaaacttccggtttaggtaccggtttacgtaccggttcccgggttaccctttaccggtttaaccgtttaccgggtttcccgggaaacccggttaacgggtaaacccgtaagggtaccggaacgttaacgttaaacccggtaaaccggttaacggttgggtaacccggtccgttaacgtcccgtaaacctttcgtttaccgtcgtttacccgttaccttacccggttccccgttcccgtaacccg

SEQ ID NO: 219337 - DNA, 668 bp, Homo sapiens
  misc_feature: GYAE6OF01CIB3C.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangcccacctctcctgcagggccagtgagatgtggcagcaacttgcctggtaccagcaagaacctggccaggcctccgaggtcctccctcctctactcgtctcgtcctccgaccggtaccgggtcccctgggtccgtaccccgaggtccgtacgggtttcggttcggggcgggttcgggtcgtggggtactagtactttcgaccttcgtcctaccagtccgacggtccggtccctaccgtacgttcgtagtaacgttacttttcgactttacttttacgttctacgttacctaacgtacttagtcggtgtaccgttccggtaccttccgttaacgttacgtttcgggaccggtaacgggtaaccctaaggtcggaacgtacgtaaccgtaaaacgtacggttggtcggaccttcggacctaccgtacttacgttcgtttctacctaccttcccgttaccccgtacg

SEQ ID NO: 219338 - DNA, 798 bp, Homo sapiens
  misc_feature: GYAE6OF01CK1TD.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgcccaccctctcctgcgacgggccagtgagtaatggttgcagcaacttagcctaggtaccagacaacgaaaccgtggaccaggcctaccccgaggtcccttccctcctcgtaactcggtccttggtccctcccgaacccggtaccggggtcccccttgggttaccgaccccgacggtccggtacgggttttccggttcggggccgggttcggggtaccttagggggaactaggttaccttttccaaccgtttcctaccgaaccctagttcccgaacgggtcccggtacccttaccgtaacggttccgttaacggtaacgtttagtttttacgacctttaacgtttttacgttttacctacggttaaccctaaaaccgttaccgttaacgtttacgggttacgttaacccggttccgggttaccctttacccgggttaaccgttttaccggttttaccggggaacccgttaaacgggggtaaacccttaaacggtcgggtaaaccgtacgtaaaccggaaaccgtaaaccggttggtacggactacggcctaccgtacttcgttacgttactactaccgttccttacccgtacg

SEQ ID NO: 219339 - DNA, 844 bp, Homo sapiens
  misc_feature: GYAE6OF01B5NS4.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaaggggaacncgcccaccctctcctgacgacgggccaggtcgaagaatggttggacacgactaacgttaacgccgttacggtaccaacggaccgaacgtaaacccgtcggacccgtacgggcccttaccccgacggtccttcccgttaccctctacgtcgtccttcgtccctacccgtacccggaccgggtccccgttgggtccgtacccgacggtccgttacgggtttccggttcggggcgggtttcgggtcgtacgggggtaactacggttacgtttccgaaccttccgtacccgtaacctacgttccggaaccgggtcccgtacccgtttaccgacggtttaccggtaagttaaacggtttctttttaccgaccttttaactttttaacgtttaccgttacgtaaaccttaaccgttacgttacggtttcggtaacgttacccgttccgggttaccctttaccggtaaccgtttaccgggttttcgggaacccgggtaacggggtaaaccctaaacggtacggaaacgtacggttaaaaccgtaaacggtaacggttcggtacccgggtactacggttacccaaccggtttactacggtttaccgtttaccgttaccctttaccgttacccccgttcccgtaacccg

SEQ ID NO: 219340 - DNA, 676 bp, Homo sapiens
  misc_feature: GYAE6OF01AMGKZ.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanacgccaccctctcctgccgagggccagtgagaatggttggcagcaacttgcctggtaccagacacgaacctggccaggcctccgaggcctcctcctctagtcgctcgtacctcctaccgacgggtcccctggtccgtccacgccgtaggttcggtggtcggtgggtcgtgggactagtactttccactcgtccaccgtacgtacgacggtccggtaccctccgagttcgtaagtacgttactttgtacctttacttttactttcctacgttacctaaacgtactttacgttggtaccgtacggttccggttcccttaccgggttaccttaccggttttacgggacccgtaaggggtaacccctaaggtacgggaacgtacgtaaccgtaaaccgtaacgttcgggtcgtacgtacggaccctaccgttacgtcgttccgttacttaccgttcccttccgttcccccgtaacc

SEQ ID NO: 219341 - DNA, 679 bp, Homo sapiens
  misc_feature: GYAE6OF01A2X0X.24.87.H10.1.454.CMB.1.raw
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
  modified_base (599)..(599): a, c, t, g, unknown or other
  misc_feature (599)..(599): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaagagcccaccctctcctgcgagggccagtgagaatgtggcagcaattcgcctggtaccagacgaacgaaacctggaccaggcctacccgacggtcctccctcctctatgctcgtcctccaccgcgggccctggtcgtcccagccgtaggtcgtgggtcggtggtcgngggactagtacgttcactctcacntcgacggccgtcctccgagtcgtagtaattacgtttacgactttacttttactttctacgttactaacctatttacgtaggtcgtacgtaccggtccgtttacccgttaaccgtacggttttaccgggacccgggtaacgggtaacccgttaacgtacgggtaacacgttaaaccggaaaaccggtaccggtttgggaaccggttnttacccgggacctaacccgttacgttttccgttaccggtttacctttacccgtacctttccccgttcccccggtaacccg

SEQ ID NO: 219342 - DNA, 845 bp, Homo sapiens
  misc_feature: GYAE6OF01AJ2NS.24.87.H10.1.454.CMB.1.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccacctgtctgtgtcncgagggaancgcccacctctcgtgcgagggccagtagagattggtggcagacgtaacgttagcccgttaggtaacccaggtaccaacggaaacccgtcgggacccgacgggcccttaccccgacggtcccttaccccgttccgttacgtacgttcgccttcgtacccctacccgaacccggccgggttccccgttggtcccgtaccccgtacggtccggttacggggtttccggttcgggggtaccggggttcggggttaccggtaggggtaaccgtacgggtttaacctttcccgtaaccgtttcccggaccctaacccggttacgtacccggtaccgggtccccggttacccgttaccccggtaagttacccggttaagggttaacgttttaccgttttaccgtaaccgttttaacggtttttaccttttaccgttacgttaacctaaacgttaacgttaggttccggttacgtacggttcccggttacccgtttacccggttaaccgtttaccggtttaccgggaaccgggttaaccggtaaccgtaacggttaggaacgttaacgaaccgttaaacggtacgtcgggtcgacggtacaccgtaccgttattccgttacgtttccttaaccttccttcccgtcccgtacg

SEQ ID NO: 219343 - DNA, 691 bp, Homo sapiens
  misc_feature: GYAE6OF01D82ZX.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaaggggaagcgcccaccctctcctgcacgggccagtgagatggttggcagactaacgttacgcctaggtaccagacaacgaaacctcggccaggcctcccgaggtcctcccttccctctacgtcgtccttcgtcctacccgaccgaccgggtccccttcgggtccgtaccccgacggtaccgtagggtttccggtcggggtcgggtggggttcgtggggactaggtactttccgtactctaccgacctatcgacggccgtcctaccgtagtcgtagtaacgttattttacgtacttacttttctttcttacgtactaaacgtacttagtcggtacgtacgtccgtacccgttccgttaccgttcgtttaccgggaccgtaacggggtaacccaacgtagggaacgtacgtaacaaacggtacgtacggttcggacttacggcctaaccttcgttaccgttcgttacttacctaccgttccccgttcccggtaccc

SEQ ID NO: 219344 - DNA, 756 bp, Homo sapiens
  misc_feature: GYAE6OF01BOEWE.24.87.H10.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
tcagactactatgtcacgaccggtgctcgatttagcagtactgcgttgggtttgggggaactgctcagttaggacccagacggaaccatggaagccccagcgcagcttctcttcctcctgctactctggcctcccagataccactggagaaatagtcgaatgacgcagtctccgagcccaccctgtctgtcgtctccgaggggaaancgcccacccttntacctggcagggccagtcagagtataagagcaactacttagccttggtatcaacagaaacctggaccaggcctacccgaggcctaccctacgactccgttaagtcggtcgccgttacccaccgtacgggcccaacgtcgggccgttcggaccggactagggtttccaaggttcggacgtaacggttgggtacgttttaggggacctaggtacctttcgaaccttcgtaccattaccaattaccgaacgtacgtaaccgtcgggaacgtaccccggtaacgtaacgtttttacggaccgttaacggttacgtttaacgtttacgttacgttaccgtacggttaccgtttacggttttaccgggttcccctttccgttacccctttacccgtttaacgtttacgtttaaccgttaccgtttttccgggtacccgttacggggtttcccgtacgggtaccgttacgggtaacgtacgttaccgaacggtaccgtaaccgttcggtacggtccttacggaccctacctcgttccgttaccg

SEQ ID NO: 219345 - DNA, 667 bp, Homo sapiens
  misc_feature: GYAE6OF01BOQXC.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaaattgtgttgacgcagtctccaggcaccctgtctttgtctccgaggggagagacgcccaccctctccgtgcagggccagtcagagtgttagcagcagctactagcctggtaccagcacgaacctggcctcggcctcccgaggcctcctcactcgtagtggtcgccgtaccacgacgggcccacgtcggcgtccgacggacgtaggtcaggtcggacgtaggtcgggtcgtttagggactacggtaccttcactctacactcactcgacagtacgtacggacgaccgtaagtacgtttcgacgtagtgttaacgttacgtcgtacgtagttcgtttcggtttccgtcccctttaccgttcccctttccgttaacgtttccgttaaccgtttaccggttttaccgggtacccggttacgggtttacccgacgggttaccggtaacgggtacgtacgtaaccgaacggtaccggtaaaccggttcggtacggtaaccgtcgtacccgtaaccgttacg

SEQ ID NO: 219346 - DNA, 725 bp, Homo sapiens
  misc_feature: GYAE6OF01B0G4H.24.87.H10.1.454.CMB.1.raw
  modified_base (210)..(210): a, c, t, g, unknown or other
  misc_feature (210)..(210): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtcgtccgtccgaagggggaaancgcccaccctctcctgcagggccagtgagaatggttggcagctaacttagcctaggtaccagcaagaacctcggccaggcctcccgagtcctcctcctctatcgtctcgtccctcccgacccgtacgggtccccttggtccgtccccgacgcccgttagggtttcggttcggggcgggttcggggtctaggggtactaggtaactttccaccgttccgtaccacctacgtccgacggtcccggtccctaccgtacggttcctacggtaacgttacgttttcgacctttaactttttatttccgttacgttaacctaaacgtacttacggttcgggttacgtaccgttccgggtacccttaccggtttaaccgttaccggtttcggacccggtaacgggtaaccaacggtggaacgtaactaaccgtaaacggtaacgttcggtacggtacctacggaccccaacgtacttaccgttcgttaccctttactaccgtttccccgttccccggtaacc

SEQ ID NO: 219347 - DNA, 626 bp, Homo sapiens
  misc_feature: GYAE6OF01B5JYM.24.87.H10.1.454.CMB.1.raw
  modified_base (170)..(170): a, c, t, g, unknown or other
  misc_feature (170)..(170): n is a, c, g, or t
  modified_base (202)..(202): a, c, t, g, unknown or other
  misc_feature (202)..(202): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (473)..(473): a, c, t, g, unknown or other
  misc_feature (473)..(473): n is a, c, g, or t
  modified_base (514)..(514): a, c, t, g, unknown or other
  misc_feature (514)..(514): n is a, c, g, or t
  modified_base (582)..(582): a, c, t, g, unknown or other
  misc_feature (582)..(582): n is a, c, g, or t
  modified_base (609)..(609): a, c, t, g, unknown or other
  misc_feature (609)..(609): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccatggagaagtagtcatgacgcagtcncgagccacctgtctgtcgtctccgagggaaanacgccacctctccgtgcgacgggccaggtgaagaagttcgttggcagacctaattacgcgttcggtaaccagaccaacgtaaaaccgtggacccaacggcctacccgacggtccttcccgtcctactacgtcgccttcgtcctacccaccgtacggggccccttgggtccgtacccgacgtccgtacggttttcgggtacggcgggttaggtccgtagggactaggtattcactcgtcacngtnacggcgtcctcgagtcgtagaacgttntttgacttacttttattcgtagtacaactagttagcggtanacgtcgacttcgtacttacgttggaccgtacggaactaacgtggaacataacgaaacgtatcggtacnctcgacaccatttccgtcttacgttanaccttcccgtccgtacc

SEQ ID NO: 219348 - DNA, 692 bp, Homo sapiens
  misc_feature: GYAE6OF01DM4QX.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagcccaccctctcctgcgagggccagtgagtaagtttggcagacaacttgcctaggtaccagacaacgaaaccgtcggccacggcctcccgacggtctccctcctctatcggctcgtcctaccaccgacgggtccccgtggtccgtcccgtacgccgtacgggttcggttcggcggggttcggtcgtcggggtactggtacttttcacgttctaccacctacgtcgacgtccggcccttaccgacgttacgtagtaacgtagtttttacgactttactttttattccgttacgttactaacgttacgtagttcggtacgtcgtttacggtccctttacggtaacctttccggtttacggacccggtaacgggtaacccgtaaacgtcgggtacgtaacgttaaaccgaaaccgtacgttaggtacggtccgtcgaacgtaaccctagttccgttacgttcttacgtaccttcccgttccgccctaacg

SEQ ID NO: 219349 - DNA, 634 bp, Homo sapiens
  misc_feature: GYAE6OF01CDPKK.24.87.H10.1.454.CMB.1.raw
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (603)..(603): a, c, t, g, unknown or other
  misc_feature (603)..(603): n is a, c, g, or t
tcagactactatgtcacgaccggtgctcgatttagcagtactgcggttggggtttgggggaggaactgctcagttaggacccagacggaaccatggaagcccagcgcagcttctcttcctcctgctactctggcctccagataccacgtggagaagtagtcatgacgcagtctcagcccacctgtctgtcgtactcgaaggggaaacncnccacctctccngacgagggcctagnganagtgtcggcagctaacttgcctaggtaccagcaagaaaccgtgaccgacggtccaccgacggtcctcctacctactacgtcgtctcgtacctacccgaccgaccgggtccccgttaggtccgtacccgacggtccggttacgggttcggttacggggcgggtcgggtcggtagggactaggttacttaccactctaccacgactcgaacggccgtcctcaggttcaggtaattagtttctacttatttaactcgtatacgtaactactagtggtacacgtcggtcctaccgtacttacggtttacggacgaacgggaactaagtggaataactaacgaaacgtacgtggtacgagtcacctaacncttactcgttactcctaactcgttcccgaag

SEQ ID NO: 219350 - DNA, 822 bp, Homo sapiens
  misc_feature: GYAE6OF01BWVXX.24.87.H10.1.454.CMB.1.raw
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagactaccactggagaagtagtcatgacgcagtctccagcccacctgtctgtcgtcctccgaaggggaaancgcccaccctctcctgcgacgggccagtgaactaagtggttaaggtaagttgtacgcctaggtaactacgaaaccaacaaaacngtcgggacccacggtccccgtcccccggcttccctacgtacttccgtaagtcgtaagtcgaccaacgttaccgaaaggtccgggaccctacggtggaccctactaccccaaggaccgtacgggttcagggttgaccggtagggttcggggtaccggtagggtaacctagttaccgtttacccgacttccctaccaaccgtatacccgagtacgtaagggtacgtaacgggtacgtaccggttaaggtaacggtttacgtttttacgggtaacccggtttttaacacggtttcgtaccgtacggtaccgtaccggttccccgttccgggtaccggttaccggtaccccgggttaccgtttaacccgggggttccgggggaacccgggggggttaccggtaaggggtcgggggtaaacgggtaacgggtaaaccgggtaccggttaacggttcgggggtaccgggtctaaccggtccctaaccggtacgtttcccgttaggtttaccccttcgttacccgtttacccccgg

SEQ ID NO: 219351 - DNA, 826 bp, Homo sapiens
  misc_feature: GYAE6OF01E0DG8.24.87.H10.1.454.CMB.1.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccacctgtctgtntcacggaaggaancnccacctctcngacgnggcagtagagtagtggtcgacagactaacgttggacgtacggaaccaacgaacgtaaccgtcggaccgacggtcctaccgacgtccctcctacgtacttagtagtacgttacgttccgtacccgtaaccgaacgggtacggtacctaccggtccgggaccccgttaccccggacggttacgggttacgacgggtcggtaacggtcgggggtcgggtaccggtacggggaaacctaccgttaccgttaccctaccggttaccctaacccgggtaccgttaccgaaccggtaccgtaacccggtacgttaaccgggaccgttaccggttaaaggtttaacccggttttacgttttacggttaaccggttttaaccgtacgttcgtaaacgtcggaccgttacggttccccgtttacccggcggttacccggaccgtttaaccggtttacgggggtcccggggggaaccggggtaacgggtggggtacgggtaacgggacgggttaacggtaccgggtattgggggtaccgtcggttacccgccgtaaacgttcgtttaccgttaccggttacctacggttacccctttacccgtccccggtaaatttccgg

SEQ ID NO: 219352 - DNA, 760 bp, Homo sapiens
  misc_feature: GYAE6OF01CSHKK.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaaattgtgttgacacagtctccaggccaccctgtctttgtctccgaggggagagacgcccaccctctcctgcgagggccagccggagtgttaagtaagtacttaggctaggtaccaacagaaacctggaccaggcctcccgaggcctcctacactctatgattcgtacctaccgaacgtacgggtccacgtccgggcccgtccccgacgtaggttcaggtcggaccgtaggttcgggtcgtaggggaactacggtaccttccgacttccgtccgtaacccgtcgacggcccgacggtacccgtaaggacgtacccgttaaggtaacggtttacgtttttaccgggtacccggtttttaacctacgttacggttaacgtacggtaccgtaacgggtttccccggttcccgcccggtttccgggtaccccgttacccggtttaaccggggtttccggggggacccggggggtaaccgtaagggggtaccggaagggtacgggaacgtaacgggtacgttcgggtacggaccgtcggacctaccgtagttccgttacgttccttaccgtacttccccgttaccccgacttagtacctagtaaacccgttagg

SEQ ID NO: 219353 - DNA, 757 bp, Homo sapiens
  misc_feature: GYAE6OF01CD5ZG.24.87.H10.1.454.CMB.1.raw
  modified_base (207)..(207): a, c, t, g, unknown or other
  misc_feature (207)..(207): n is a, c, g, or t
  modified_base (329)..(329): a, c, t, g, unknown or other
  misc_feature (329)..(329): n is a, c, g, or t
tcagactactatgtcacgaccggtgctcgatttagcagtactgcggttggggtttgggggaggaactgctcagttaggacccagacggaaccatggaagccccagcgcagcttctcttcctcctgctactctggctcccagataccatggagaagtagtcatgacgcagtctccagccaccctgtctgtgtctaccgaggggaaaancgaccaccctctcagcagggccagtgaagtaatgttggacagacaacttcgccgttgaccagacaacgaaccgtggaccacggcctacccgacggcctcctacctcgtatcgctcgttaccnccgaaccgcggggtcccctggtccgtcccgagccgttaacggttcggtcgggtcgggtacggtcggtacggggaactaggttacttccgacttcgtacccaacctagttaccgaacggtcccggtaccgttaccgtaccgttacgttaacggtaacgtttacgttttacggttactttaacgtttttactttacttacgttaactaaacccgtttaacgtaacgtttacgggttacggtaccgttaccgggtttcccgttacccgtttaaccgttaccggttttaccgggtaacccggtaacgggtaaacccgtaaacggttacggaaacgttaacggtaaaccgtaaacgtaacgtacggtttcgacgtccgaccgtactacgttaccgttcggttacttacttaccgttcccttacccggtaaccc

SEQ ID NO: 219354 - DNA, 633 bp, Homo sapiens
  misc_feature: GYAE6OF01BA2F9.24.87.H10.1.454.CMB.1.raw
  modified_base (204)..(204): a, c, t, g, unknown or other
  misc_feature (204)..(204): n is a, c, g, or t
  modified_base (555)..(555): a, c, t, g, unknown or other
  misc_feature (555)..(555): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttagcctggtaccagcagaacctggccaggcctccaggcctcctccctctatgctgtcctccaccgcgggccccttggtcgtcccagccgtaggttcggttgggcggtggggtcgtggggacaggtacttccgacttctccacctagtccacggtccggaccctccgacgttacctggtaagttacgtttttcggactttacttttacttttactacgttactaaactaccgttagttcggtcgtacgtcggtccttaccgtacttacggttttacggaccgtaacggggaacctaacgtggaacgtanaccgtaaaacgtactggtcggactggacctaccgtacgttcttacgttccgttacctaccttcccgttcccgtacccg

SEQ ID NO: 219355 - DNA, 837 bp, Homo sapiens
  misc_feature: GYAE6OF01DZJ4I.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggcctccagataccacgtggagaagtagtcatgacgcagtcctccagcccaccgtgtcctgtcgtcctaccggaaggggaaacgcgccctaccctctccgtggcgacgggcctaggtagaagtaagtcggttaggacacgactaacgttcgccgttacggaccagacgaacgtaaaccgtcggaccgacggccctaccgacggtccttccccgttacctacgttagtccgtccgttaccgtccctacccgaaccgggcccgggttccccgtcgggtcccgtacccgacggttccggttacggggtttcgggtcggggtacgggttcgggtaccggtaggggtacctaacggttacctttaccgaccgttccgtaccgtaaccgtacgtacccggtaccgggtacccggttccctaaccgggtaacgtttacggttaacggttaaaccgttttcggttttaccgtaaaccgtttttaaccgttttcgtttaaccgtacgttaaacccgtaaccttaggtacggttcggtacgtaccgttccggtacccgtttaccgtaacgtttaccggtacgggtaaccgggtaaaccggtaactaaacggtcggtaacgtaacgtaaccgaaacgtacggttacggaccggtccaacggtaccctacgttacgtcgtttaccttacgttaaccctccgttaacccgcccgttaacg

SEQ ID NO: 219356 - DNA, 764 bp, Homo sapiens
  misc_feature: GYAE6OF01CK9DA.24.87.H10.1.454.CMB.1.raw
  modified_base (201)..(201): a, c, t, g, unknown or other
  misc_feature (201)..(201): n is a, c, g, or t
tcagactactatgtcacgaccggtgctcgatttagcagtactgcgttgggtttgggggaggaactgctcagttaggacccagacggaacatggaagcccagcgcagcttctcttctcctgctactctggctccagataccactggagaagtagtcatgacgcagtctccagcccacctgtctgtcgtctcgaaggggaaanacgccacctctctcgcgagggccagtgagaagtggtggcagactaacgttacgcctacggtaaccagacgaaacggtaaaaccgtcggacccgaacgggtcctacccgacggtcctaccgtcctcgtatcgtcgtacgtcctaccgaccggtacggtcccgtggtccgtacccacggtccgtacgggtttcgggttcgggacgggttcgggtacgtacggggaactaggttaactttccgactccctaacaccgtaactccggacggccggttccctaccgtacggtaccttaggtaacgtttacgtttacgtaccgtttaacgttttacgtttacgttacgttaccctaaagtaccgttaggtttaccggtacgtaacgttcccgggtacctttacccggttaacgttacggtttaccggggaccgtaacggggtaacctaacggtacgggtaactaaacgttaccgaaaacggttacgtacggaccgtagaccggtacctaccgtaacgtttcccgtaacggttttaccaccgttttacctcccgggttaacccgttaccc

SEQ ID NO: 219357 - DNA, 560 bp, Homo sapiens
  misc_feature: GYAE6OF01AX8YO.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccagggggaaanagccaccctctcctgcagggccagtgagaatgttggcagcaacttagcctggtaccagcagaaacctggccaggctccccaggcctcctcctctatgctgtcctcccacccgacgggcccctggtcgtccccaggccagggtttcgttgggcggtggggtctgggacaggtatttcactctcacctatcagcggcctccagtctgtaagtatttgtctactttatttctgtcaactactatggtgactcggtcctccgtactacgttttcggccgtacggggacctaaacgtggacgatacgaaaccgtaagtcgtggctgcacctatctagttcttatacttccttcccgtaccg

SEQ ID NO: 219358 - DNA, 809 bp, Homo sapiens
  misc_feature: GYAE6OF01AHM2X.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaanacgccaccctctcctgcagggccagtgagatgttggcagcaacttagcctggtaccagcaagaaaccgtggccaggcctcccgaggcctcctcctctatcgctcgtcctccaccggacgggtcccctggtccgtcccgacggccgttacgggtttcggttcggggcgggtttcggggtcgttcggggaactaggtacttttccaccgttcctacctacctacgtccgacgggtcccggtccctacccgtacgttccgttaggtaacgtttacgttttacggtaccttttaccgtttttaactttttccgttacggttaacccttaaacgttaaccgtttacggttacgggttaccggttaccggttacccgggttaccccgttttaacccggttaacccgttttacccggtttttaccgggggaacccccgggttaacggggggtaaacccccttaaacgggtacggggtaaacgttaaaccgtaaaccggttaaaaacccgggtaccgttagggttccgggtaccttacgggtaaccctaaccgttacttcccggttacgtttaccctttaaccttccgtttcccccgttaccccggtaaccc

SEQ ID NO: 219359 - DNA, 699 bp, Homo sapiens
  misc_feature: GYAE6OF01DY60D.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagcccaccctctcctgcgagggccagtgagaatgttggcagactaacttagcctggtaccagacacgaaacctggaccaggctcccgaggcctcctcctctagtcgctcgtcctccaccgacgggcccctggtcgtccagccgtaggttcgtggcggtcgggtactgggacctagtatttccacgttcctccgacctactcgtacggccggtcccttacccgtaggttccttagtaacggttagtttttacggtaccttaactttttaacttttcctagttaacctaaacctaccgtttaagttcgggtagtaaccgttccgggtacccttacccggttacgtttaccggtttttacgggtaccggtaacgggggtaacccctaaagggtcggtaacgtaacgtaaccgtaaaacggtaaccttgggttaacggtcgtacgacctaacccttaggtaccttacgttctttaccgtaccttcccggttcccctacc

SEQ ID NO: 219360 - DNA, 648 bp, Homo sapiens
  misc_feature: GYAE6OF01DCMIM.24.87.H10.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgagggaaancgcccacctctccngcaggccagtgagatgtgcngacacttgctaggacagcaagaacctggccaggcctcccgaggcctcctcctctagtcgctcgtccacccgaccgtacgggtcccctggtccgcccgagccgtaggttcggtggtcgggtggtcgtagggactaggttactttcactcctaccacctgtcacggcccgtccgtacctacggtcgtagtaacttagttttcgactttacttttacttcttagtacctaaacttacgttagttcggtacgtacgttccggttacccgttaccgttaccgttacggttttccggaccgggtaacgggtaactaacggtacggaacgtacgtaaccgaaacggtacgtacggtacggcttacggaccaccttagttccgttacgttacttacgtaccttcccgtcccgttaacc

SEQ ID NO: 219361 - DNA, 773 bp, Homo sapiens
  misc_feature: GYAE6OF01BFHG1.24.87.H10.1.454.CMB.1.raw
  modified_base (246)..(246): a, c, t, g, unknown or other
  misc_feature (246)..(246): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaaggggaaagcgccaccctctcctgcgagggccagtgaagtaatgttcggnagactaacgttagccgtaggtaccaagacgaacgaaaccgtcggaccgaggaccctacccgaacggtccttcccgtaccttacgtaactcggtcctcggtccctcccgaccgtaccgggtccccgttggtaccgtacccgacgaccgtaggtttcggttacgggccgggttgggtacgtacggggacttaacggtactttcaccgttacgtaccacctaacgtcgtaacggccgtaccctacgagttaccgtagtaaacgttcgttttacgccgttttaacgttttacgttccgttaggtaaacctaacgttacgttacgtaggtacgtacccggtaccgtacccgttacccggttaacttacggtttacgggaacccggttaacggggaaacccgttaaacggttcgggaacgtaaaccgtaacgtaaaaaccggtaagttaccgggtcgtaccgttacgaaccccgttactagtttaccgtaccggttttaccttaacctacgtttccccggtaccctaacccgg

SEQ ID NO: 219362 - DNA, 779 bp, Homo sapiens
  misc_feature: GYAE6OF01DMLHY.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctccagataccactggagaagtagtcatgacgcagtctccagccacctgtctgtgtctccgagggaaancgccacctctctgcgagggccagtgagtatgtgcagcacttgctcgacagacaacgaaccgtcggaccacggcctaccgacggcccttacccgttccttcttacgtcgtccttcgtcccgtacccgaacccggtccgggtccccgttgggtccgtaccccgtacggtaccggttacgggttttcgggtcggggtacgggttggggttccgtacgggggtaactacgggtttacttttacccaccgtttccgtacccgaaccctagttcccgaacggcccggtacccttcggtacttacgttacggtaacgtttcgttttacgtaccctttaacttttcttaccgttacgtaccttaaacgtccgttaggttcggtacggtacttccgggtaacctttcccgtaactttacggtttccgggaacccgggtaacgtaaaccggtaacgtagggtaacgttaacctaacgggaaaacccggttcgttaccggttaccgggtacttccggaaacccttaacccgtgtttacccgttcgtttaacccttaccgtttacccgttccccgttaaccgtacccgg

SEQ ID NO: 219363 - DNA, 687 bp, Homo sapiens
  misc_feature: GYAE6OF01DRJYP.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgcccaccctctctgcagggccagtgagatgtggcagcaactgcctagaccagcaagaacctggcagcctccagcctcctctactatgctgtcctccgaccgtcgggtccctggtccgtccgacgtccgtagggttcgtgggcggtcgggtcgtacggacgtagtacgtttccacttcctaccgacctacgtccgacggtccggtccctacgtacgttcgtaaggtaacgtttagtttacgtacctttaacgttttactttaccgttacgttacctaaaccttacgttaggttcgggttacgttaccggttaccggtcccgttaacccggtttaccttaccgggttttacgggacccgggtaaaccgggtaacctaacggtacggaagtaaccgtaaccgtaaacgtacgtcggtacggtacgtacggacctaccgtacttccgttacttaccgttacgtacccgttcccgttccccgtaccg

SEQ ID NO: 219364 - DNA, 840 bp, Homo sapiens
  misc_feature: GYAE6OF01D6UM9.24.87.H10.1.454.CMB.1.raw
  modified_base (207)..(207): a, c, t, g, unknown or other
  misc_feature (207)..(207): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagactaccactggaagaagtagtcatgacgcagtcctccagcccaccctgtctgtgtccacgagggaancgcccaccctctccgtgaccgacgggcctaggtgaagagttggtgacacgactaacgttacgccgtacggtaaccagaccaacgaaaccgtcggaccgacggaccacccgacggtccctaccgtaccctctacgttcgtccttaccgtccctacccgacccggtaccgggtccccgttggtcccgtacccgtaccggtacccggttacggtttccggggtcgggtaccgggttcgggtacggtacgggtaccgtaggtttacctttccgacctttcctacccgtaacctaacgttccgaaccggtcccgtacccgttccgtacggttaccgtaagttaacgttttaccgtttacgttacctttttaacgtttttacttcccgtttaacgtaaccttaaacgtttaccgttaggttaccgggtaccgtttaaccggttcccggtaccgtttaccccgttaaccggtttaaccggttccgggaaacccgggtaaccggtaaccgtaacgggtacgggaaccgtaaactacccggtaaaacgtacggttacggtaccgttcgaaccgtccccgtaacgttaccgttaccgttacgtttacccttacccgttaacccttcccccgtaccgtaccccg

SEQ ID NO: 219365 - DNA, 789 bp, Homo sapiens
  misc_feature: GYAE6OF01A3EIS.24.87.H10.1.454.CMB.1.raw
  modified_base (208)..(208): a, c, t, g, unknown or other
  misc_feature (208)..(208): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtcgtctccgaaggggaaacncgcccaccctctcctgcgacgggccagtgagaatggttggcagactaacgttagcctggtaccagacaagaaacctggaccaggcctcccgacggctcctcctctatcgctgtcctccaccgacggtcccctggtctcccgacgtccgtagggttccggttcgggccggtcggggtcgtcggggactaggtacgtttcgaccttccgtacctaacccgtacttccgaacggtcccgggtacccttacccgtaacgttccgttacggtaacgtttacgttttacggtacctttaaccgtttttaacttttccgttacgtttaacctaaaccgtaccgtttaaggttcggttacggttaccgttaccgggttacccctttacccggtttaacccgtttacccggtttttaccgggacccgggttaaaccgggggttaaacccgtaaaccggtagggtaaaccgtacgttaaaccggtaaaaccgtaaccggttacgggtccggtacggtacggtaccctaacccgtacgtttaccgttacgtttacccttaccttacccgttccccgttcccccgtaaccccg

SEQ ID NO: 219366 - DNA, 744 bp, Homo sapiens
  misc_feature: GYAE6OF01CKGXT.24.87.H10.1.454.CMB.1.raw
  modified_base (217)..(217): a, c, t, g, unknown or other
  misc_feature (217)..(217): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctggcctccagataccactggagaagtagtcatgacgcagtcctccacgccctacccgtgtctgtcgtccgtaccggaaggggaaacnccgcctacccgtctccgtgacgacgggccagtagaagtagtggtcgacacgactaacgttacggccgtcggtaaccagacgaaacgaaccgtcggaccgacggtcccaccgcgtccctcctacctgtacgtcgtctccgttcccacccggacggtacccgtccccggttagtcccggtacccgtacggtccggttaggggtttccggtcggggttccggtcggggtcgtaacggggtacctaacggtttacccttacgcctttaccgtacccgaacgtcggtcggacccggtccgttacccgtacgttacgtcgtaacgttaacgtttcgttttacgaccgtttttatttacgtacgtcgtaacttaacgtcgtttaacggtcgtacgtcgtccggttacttaccgttacgttcggtacccggacggtaaccggtaaccttaagtagacgttaaccgaacgtaacgtccgtggccgtcgtaccacgttacctattcgtaccgttcttaccgtcctcccgttccgtac

SEQ ID NO: 219367 - DNA, 703 bp, Homo sapiens
  misc_feature: GYAE6OF01DDOUJ.24.87.H10.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctggctcccagataccactggagaagtagtcatgacgcagtctccagccacctgtctgtgtctccgaggggaacncgccaccctntcctgcacgggccagtgagatgttcggcagcaacttgcctggtaccagcaagaaccgtggccaggctcccaggcctccttcgctagtcgctcgtacctccgaccgtacgggcccttggtcctccaccggtccgtacgggttccggtggtccggtgggtcgtacggggactaggtactttccgacgtctaccgacctacgtcgacggccgggtacctccgacggttacctggacgttacgtttcgaccttacgttttactttccgttacgtacctaaccgtccgttaaggttccgggtacgtaccggttccggtcccgttaccccggttaaccgttaccggttttcgggaacccggtaaccggggtaacctaacggtagggtaaccgtagtaaccggtaaccgtaacggtcggtacgggtaccggtacgtcccgaacccgttactccggttacgttccttaccgtacccgtttcccgttccccggtaacc

SEQ ID NO: 219368 - DNA, 738 bp, Homo sapiens
  misc_feature: GYAE6OF01BZTL4.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccaacgcagcttctcttcctcctgctactctggctcccagataccactggagaagtagtcatgacgcagtctccagccaccctgtctgtgtctccgaggggaaangccaccctctcctgcagggccagtgagaatgttggcagcaacttagcctggtaccagcagaacctggccaggctcccaggctcctcctctatcgctgtcctccgaccgacgggccccttgggtcgtccccaggtcccgtagggtttccggttgggccgggttgggtccgtggggaacctaggtacttttccgaccttctacccgaacctacgttcgaacggtcccgggtccctaccgtacggttctacggtaagttacgttttacgtaccttaacttttacgttttaccttacggttacctaaaccgttaacgttacgttacgggttcggtaacgttcgggtccctttacccggttaaccgttaccggtttttacgggaccccggttaacgggggtaaccctaaaccggttacggaacggtaacgttaaccgaaaaccggtaacgttacgggtacgggtccgttacggacccgtaaccgtacgttccgttacggtttcctttacctacgtttccccttccccgtcccttaaccg

SEQ ID NO: 219369 - DNA, 753 bp, Homo sapiens
  misc_feature: GYAE6OF01CSNVS.24.87.H10.1.454.CMB.1.raw
  modified_base (206)..(206): a, c, t, g, unknown or other
  misc_feature (206)..(206): n is a, c, g, or t
  modified_base (472)..(472): a, c, t, g, unknown or other
  misc_feature (472)..(472): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaaggggaaancgccaccctctcctgcagggccagtgagatggtgcagcaacgttagcctggtacccagaccgaagtaaacccgtgggacccacgggtccctacccgaacggtcctcccctaccgttcttaacgtcggtccttcggtccctacccgaacccggacggggtcccccttgggttcccggtcccccacgtcccggtagggtttccgggtacgggtccgggttcgggtcggtacggggtactacggttacgtttcaccttcgtacccaacnctaccggacgtcccgtcccgtaccgtacgttcgtaagtaacgttagttttacgtacgttacttttacgtttcttcgttactaaaccgttacgtacgttggtacgtaccgttcggtacccgtttaccgtaccgtttaccgtttccgggtaccgtaaccggggtaaccaacggtacggaacgtaacgtaacgtaaaccgtacgttacggttacggaccgtacggtacctaccgtacttccgttacggttaccttaccgttaccttccccgttcccgtaacccg

SEQ ID NO: 219370 - DNA, 911 bp, Homo sapiens
  misc_feature: GYAE6OF01BHQI4.24.87.H10.1.454.CMB.1.raw
  modified_base (889)..(889): a, c, t, g, unknown or other
  misc_feature (889)..(889): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagactaccacgtggagaagtagtcatgacgcagtctccagccacctgtctgtcgtcgtaccgaaggggaaacgcgcccaccctctccgtgccgtacgggccaggtgaagtagttcggtcggacagcctaacgttgccgtacggtaccagacgaacggaacctcggaccgacggtccctacccgacggtccttacccctccttacgttacgtcggtccttccgttacccgtacccaacccggtaccggggttcccccgttgggtcccgtacccccgacggttccccggttaaggggttttcccggttcgggggccggggtttcggggtacccgttaggggaaccgttaacgggtttaccttttacccgaccgttacccgtttaaccgacccgttaacgttacccgggacccgggttccccggtaaccccgtttccggtaaccggtttaccggttaacggttaaaaccggttttgtttttaacccggtaaccgtttttaaccgtttttacgttttaccgttaacccgttaaacccgtaaaccgttttaaccgtttacggtcgggtttaaccggtacccgtttaccgggttacccctttaacccgggtttaacgtttaccgggttttaccggggaacccgggttaaaccgggtaaaccttacgggtaacggtaccgttaacgtaacccgttaaaacgtcggttacggtcggacctacggtaaccctaccgttacgttccgttacttccgttacncccgtttacccgtcccgtaacg

SEQ ID NO: 219371 - DNA, 553 bp, Homo sapiens
  misc_feature: GYAE6OF01BGXHG.24.87.H10.1.454.CMB.1.raw
  modified_base (204)..(204): a, c, t, g, unknown or other
  misc_feature (204)..(204): n is a, c, g, or t
  modified_base (424)..(424): a, c, t, g, unknown or other
  misc_feature (424)..(424): n is a, c, g, or t
  modified_base (528)..(528): a, c, t, g, unknown or other
  misc_feature (528)..(528): n is a, c, g, or t
  modified_base (539)..(539): a, c, t, g, unknown or other
  misc_feature (539)..(539): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttgcctggtaccagcagaacctggccaggcctcccaggctccctcctctatgctgtcctccaccgacgggccccctggtcgtccccagcccgtagggtttccgttgggccggttgggtcgtggggacaggtctttcactcctcacctatccaggccggcctccgagttctagaagttnttttcgcttactttattctgtacaactatgtgtgacttcgctccgtactcgtttcgccgacgggtaccaagtggaagtatacgaaacgtatggcgtcagccacntcgtcgttctncttccgtcccgtac

SEQ ID NO: 219372 - DNA, 784 bp, Homo sapiens
  misc_feature: GYAE6OF01BEUPI.24.87.H10.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (270)..(270): a, c, t, g, unknown or other
  misc_feature (270)..(270): n is a, c, g, or t
tcagactactatgtcacgaccggtgctcgatttagcagtactgcgttgggtttgggggagaactgctcagttaggacccagagggaaccatggaagccccagctcagcttctcttcctcctgctactctggctccagagaccacggaagaaattgtgttgacacagtctccaggcacctgtcttgctccgagggganagacgccaccctntccgtgcagggccaggccggagttgttaagtaagtacgttagggcttagggtaacccaanacgaaaccgtggaccaaggcctcccgaggtcctcctcatctaatgaattcgtacctaccgaaacgtggtaccacgtcggacccgtccccgacgtaggttcaaggtcggtacagggttcgggtccgtaggggaacctaaggtacctttccaaccgtccgtaccgacccgtacaacggtccgtaacggtcccttaaaggaccgtaccgttaaggtaacggtttaacggtttttcgggtaccggttttaaccgttacggttacgtacgacggtacgtaccggtcccggtttcccgccgttcgggccccgttacggttaacgggtttccggggaccggggggtaccgtacgggggttacgggaggtaacgggaacggtaaccgggtaacgttacgggtcgggtacctacgggacccgtaaccgtacggttccgttaggttacccttacccgtaccgtttaccccgttaccccggtacctaaccgttaccgtaaccgtaaaccgttacggtttaaacgg

SEQ ID NO: 219373 - DNA, 781 bp, Homo sapiens
  misc_feature: GYAE6OF01C6TNC.24.87.H10.1.454.CMB.1.raw
  modified_base (223)..(223): a, c, t, g, unknown or other
  misc_feature (223)..(223): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagatacccactggagaagtagtcatggacgcagtcctccagcccaccctgtctgtcgtctccgaaggggaagcgccaccctctcngcgagggccagtgagagtgtggcagactactcgctacgtacagacgacgaaaccgtcggaccgacggcctacccgacggtcctacctctactctactggtatcgtaccacgaacgtacggtacctacggtccggccgtccccgcgtacggttacgacggttggacgtacgggttgggtcgtacgggtctacggtaccttccacgttccgtacgtaccgtacgacgacgtaccgccgtaacggacgtcgttagttaagttcgttttacggtccggttttactacgtcggttacacggtccgtcggttccttcccgttcggtcccggtaccgttacccggtttaaccgggggtttccgggggaaccgggggggttaccggtaacgggggtacggggtaacgggtaaacggggtaacgggtaacccgggtaacgggttcggggtaccgggttaccgttaccgggtaacccgttaacggtttacccggtttacccgggtttcccggtttaaccctttaccccggtaccctttttcccccgggttccccccgtttaaacccgg

SEQ ID NO: 219374 - DNA, 648 bp, Homo sapiens
  misc_feature: GYAE6OF01EWDAJ.24.87.H10.1.454.CMB.1.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
  modified_base (629)..(629): a, c, t, g, unknown or other
  misc_feature (629)..(629): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgccacctctcctgcagggccagtgagaattgttggcagcaacttagctgtaccagacagaactggaccagctaccgaggcctccgtcctctacngtctcggtcctacccgaccgtacgggtccccttggtccgttaccccgaggtacccgtacggggttccgttggggaccgggttggtcgtggggaaccaggtctttacacctcttaccgacctacgtcgacgccggtccctccgagttctagaattacttttgaccttactttatttcctacgtactaaacgtctaagtcggtacgtacgtcggacccttccgtaacgttcgttttacgggacccggaaggggtaaccctaaagtacggacgtaactaccgaaaaccgtacgtggtcggtacgttagacctacgtattcgtacttccgttanaccctttccgacccgtacg

SEQ ID NO: 219375 - DNA, 824 bp, Homo sapiens
  misc_feature: GYAE6OF01B1FOP.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaaggggaagcgccaccctctcctcgacgacgggccaggtggaagtaagtggttacggcaggtactaacgtttacggccgttacggtaaccgacgacgaaacgaaaccgtcggaccgacggtaccctcccgacggtccctcctcctctacgtcgctccgtccctacccgacccgccgggtccccgtaggtccgtacccgtagtcccggttacgggttcggttcggggcggttcggggtcggtacgggacgtacgttacgtttcgaccttctaccgactactcggacgtccgtacctacgtacgtcgttaagggtaactttcggtttcctactttacgttttacttcggtacgttaaccgtaaaccgttatttaacgggttcggtacggttcccgttaccggttacccgttaacccgttttacccggttaacggtttcccggggaacccgggttaaaccgggggtaaacccttaaggggttaccgggtaaaccgtaaaacggttaaccccgaaaacgggttaccggttcgggttaccgggatacccgggtttaaccaacccccgtttggtttaccctttacggtttacccctttaccccgtcctttacccccgggttacccccttaaccgg

SEQ ID NO: 219376 - DNA, 789 bp, Homo sapiens
  misc_feature: GYAE6OF01C7G0Q.24.87.H10.1.454.CMB.1.raw
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
tcagactactatgtcacgaccggtgctcgatttagcagtactgcgttgggtttgggggaggaactgctcagttaggacccagacggaaccatggaagccccagcgcagctttctcttcctcctgctactctggcctcccagataccactggagaagtagtcatgacgcagtcctccagccaccctgtctggtcgtctccgaaggggaaacncgccctaccctcttccncggcgacgggcctaaggtcgaagaacgttggttggacaggacctaacgttacgccgttacggaccagaccgaacgaaccgttcggaccacgggtaccctcccgacggtccttcccgtcccttctactcggtcttcgtccctacccgacccggtacggtcccccgtaggtcctacccgacgtccgttacgggttccggttggggtccggtttcggggtacgtacgggtaacgtacgttacgtttccacgttcctacgaccgtagtaccgacggtccggttacctaccgtacgtcgttaagtacggtttacttttaccggtaccttttaagtttaccttttacgtacgtaacccttaacgtaacgtttacgtaggggttacctaccggtttccgtacccgtacccggtttaaccgttccggttttaaccggggacccgtaaaacggggtaaccctaagggtacggaacggttaactaacccggtaaacgttacggtggtaccgcctacggtccaacgtttctaccgtttctacggtacctacccgttcccgtttcccgaaccg

SEQ ID NO: 219377 - DNA, 630 bp, Homo sapiens
  misc_feature: GYAE6OF01EZ10O.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaanacgcccaccctctcctgcagggccagtgagaatggttgcagcaacttagcctggaccagcagaacctggccaggctccgaggctcctctcatcgctgtcctccaccgcgggccctggtcgtccagccgtaggttcgtggtcggtggtcgtgggactgtactttcacttcctccgacctagtccgacggtcccgtcctccgacgtcgtagtaacgttagttttcgtacttacttttactttcttgtacctaactacgttagtggtacgtacgtacggtcccttaccgtaccttacggtttcgggacccggtaacgggtaacctaacggtaggaacggtactaacgaaaaccgtaacgttcggtacggtacgtacggtaccctaccgtacttcgttaccttcttaccctactttcccgtccccgtaccg

SEQ ID NO: 219378 - DNA, 736 bp, Homo sapiens
  misc_feature: GYAE6OF01B6QD7.24.87.H10.1.454.CMB.1.raw
  modified_base (209)..(209): a, c, t, g, unknown or other
  misc_feature (209)..(209): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctggcctcccagactaccacgtggagaagtagtcatgacgctagtctccagcccacctgtctgtgtcctccgaagggaancgcccaccctctccgtgcgacgggaccagtgaagtagttggttcggcacgtactacgttaccgcgtacgtaaccacgacgtaacgtaaccgcggaccacggtccaccgacggtcctcctaccttctacgtcgtcttccgtcccgtccgaaccgccggtcccgtcggtccgtaccgacgtccgtcgggtttcggtcggggtcggttggtccggtcgggtaactagtaccgtttccaccgtcgtaccacgtacgtacgtaccgtcccgtcctccgtacgttccgtaagttactttcgtttacgtacttttactttattttaccgacgttaaccttaacgttacgttagtacggtccgttacgttacccggttccgttaaccgtttaccgtttaccggttacgggaacccggtaacggaacccgttaacggtacggtaaagtaaccgttaaccgaaacgtttacggacggttacggataccgtacccacgttactcgttacttaccttactcccttcccgtcccgtaacc

SEQ ID NO: 219379 - DNA, 649 bp, Homo sapiens
  misc_feature: GYAE6OF01CFHV4.24.87.H10.1.454.CMB.1.raw
  modified_base (400)..(400): a, c, t, g, unknown or other
  misc_feature (400)..(400): n is a, c, g, or t
  modified_base (619)..(619): a, c, t, g, unknown or other
  misc_feature (619)..(619): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcaatgacgcagtctccagccaccctgtctgtgtctccgaaggggaaagcgccacccgtctcctgcgacgggccaggtgaagtaagtggttggacagacaactttcgcgtacggtaccagacaacgaaaccgtcggccgacggctacccgacgcctcctcctctatcgctacgtccaccgaccgacggtccccgtaggtccgtccacgtccgtagggttcgtggcggtcgggtcgtagggacngtacttcgactctcacatccacggccgtacctccgtagttaccgtagtaagttactttcgacctttaagttttattcgttaacgtacctaaactagttagttcggtacgtaccgttacgtcccggttccgtaacgttccgggtttcgaaccggtaacgggtaaccaaggttaggaacgtacgtaacgaaaacgtagttcggcggtatcggactaccgtnttaccgtcttaccttatctttcccgcctac

SEQ ID NO: 219380 - DNA, 758 bp, Homo sapiens
  misc_feature: GYAE6OF01CASG8.24.87.H10.1.454.CMB.1.raw
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (317)..(317): a, c, t, g, unknown or other
  misc_feature (317)..(317): n is a, c, g, or t
  modified_base (458)..(458): a, c, t, g, unknown or other
  misc_feature (458)..(458): n is a, c, g, or t
  modified_base (653)..(653): a, c, t, g, unknown or other
  misc_feature (653)..(653): n is a, c, g, or t
  modified_base (694)..(694): a, c, t, g, unknown or other
  misc_feature (694)..(694): n is a, c, g, or t
tcagactactatgtcacgaccggtgctcgatttagcagtactgcgttggggtttgggggaggaactgctcagttaggacccagacggaaccatggaacgccccagcgcagcttctcttcctcctgctactcgtggcctccagataccacgtgggagaagtagtcatggacgcagtctccagccacctgtctgtgtcaccggaaggggaacncgccctaccctctccngcggacgggctaggtgaaggtattggttggtacacctaacgttcgaccgttaggacccagcaacgtaaccgtcggaccaggcctacccgngtccctccttcacgtagcgtccgtacgtcctacccgacggtccgggtccctgggtcccgtaccgagtccggttggttcgggtcgggtacgggtggtacggacggactacgttctttaccgactcctcaacttcggtacccncgggtcccgtacttacggtacgttacggtaagttacgtttatttacccggttctttaacctttttcgttaccggtaccgtaactaaccgttacgttaggttcgggtaccgtttaccggtaccggtacccgtttccgttaacgtttacgggtttaccggacccgggtaaccgggtaaccctaaagggtccggtaanaaccggttaacgaaacggttcttacgggtacgtcccgtacncgtaaaccttcggtttatccccgtttatacccgttacccgttccccgttaccaccggtttaacg

SEQ ID NO: 219381 - DNA, 886 bp, Homo sapiens
  misc_feature: GYAE6OF01CJRSV.24.87.H10.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccacctgtctgtcgtcctacgaaggggaacncgccaccctctccgngcgagggccaggtgagtaagttgtcggcagactaacgttcgccgttagggtacccaggaccaacggaaaacccgtcggcccgaacggcccgttacccgacggtcccttcccttcccgttactacgttcgtccttacgtccctaccccgacccggtacccgggtccccgttggtacccggtaccccgtaccggtaccggttacgggtttccgggttcggggtccgggtttacggggttcggtaccggggtaacgtacggtttaaccgtttccgtaacccgttctacccgaaaccgttcggtaccgaaccgggtcccgtaccccttacgtacggttaccgtaacgttaacggttttacgttttacgtaaccgttttaacgttttttaacgtttcccgtaacggtttaacccttaaaccgttaccgtttaacggttcgggttaccggttaccgttacccggttaccccgtttaaccggtttaacccgtttacgggttttacccggaaccgggtaaccggggttaaaccctaacgggtaacgggaacttaaacggtaacccggtaaaacccggttggtaccgggttccggtaccgttaccacccgttaccgtacctttccgttaccgtttacccgttacgttacccctttacccgttccccgtaaacg

SEQ ID NO: 219382 - DNA, 299 bp, Homo sapiens
  misc_feature: GYAE6OF01D6THR.24.87.H10.1.454.CMB.1.raw
  modified_base (278)..(299): a, c, t, g, unknown or other
  misc_feature (278)..(299): n is a, c, g, or t
tcagactactatgtcacgaccggtgctcgatttagcagtactgcgttgggtttgggacagatttcactctcaccatcagcggcctccagtctgaagtattttgctactttatttctgtcaacactatggtgactggcctccgtactacttttcggccgaggggaccaaacgtggagatacaaacgaactgtggctgcaccatctgtcttcatccttcccgcatctagaactagtagtacgtctggaggcgggcgtgggacgaaggcgactaataggcnnnnnnnnnnnnnnnnnnnnnn

SEQ ID NO: 219383 - DNA, 754 bp, Homo sapiens
  misc_feature: GYAE6OF01CQPST.24.87.H10.1.454.CMB.1.raw
  modified_base (141)..(141): a, c, t, g, unknown or other
  misc_feature (141)..(141): n is a, c, g, or t
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
  modified_base (709)..(709): a, c, t, g, unknown or other
  misc_feature (709)..(709): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagntaccacgtggagaagtagtcatgacgcagtctccacgcccacctgtctgtcgtcgtccgagggaagacnccaccctcncctggcgacggcgagtagagtagtgtcggcagactaagtcgcgtacggtaccacgacgaacgtaaaccgcggaccgaacggtccctaccgaccggtcccttacctaccctctacgtcggtctccgttcccgacccgaacccggtccggccccgttacggttccgaccccgtacgtaccgggttaccgggttcgggttcgggtccgggttcggtaccgggttaggggaaacccgttagggttaccttttacccgggaccttaccgtacccgtacgtaaccggttcccgaaccgggtccccgttacccggtccccttaaggtaccgttaacgttaacggtttaccggtttacttaactttacttttaacgttcgtacgtaaccctatacgttagtgtacgtaccgtcgttaccctaccggttacttcggttaccgaccgggtaacgtaaccggaagtcggtaagtaccaacggtaaacgtcgtagtcggtanaccgccgtactacgttctccgttacttactctcccgttccgtacg

SEQ ID NO: 219384 - DNA, 814 bp, Homo sapiens
  misc_feature: GYAE6OF01AV9FT.24.87.H10.1.454.CMB.1.raw
  modified_base (150)..(150): a, c, t, g, unknown or other
  misc_feature (150)..(150): n is a, c, g, or t
  modified_base (182)..(182): a, c, t, g, unknown or other
  misc_feature (182)..(182): n is a, c, g, or t
  modified_base (204)..(204): a, c, t, g, unknown or other
  misc_feature (204)..(204): n is a, c, g, or t
  modified_base (461)..(461): a, c, t, g, unknown or other
  misc_feature (461)..(461): n is a, c, g, or t
tcagactactatgtcacgaccggtgctcgatttagcagtactgcgttgggtttggggagaactgctcagttaggacccagacggaaccatggaagccccagcgcagcttctcttcctcctgctactctggcctcccagataccactgganaagtgtcatgacgcagtctccagcccaccgtntctgtcgtctcgaggggaaacncgccctacctctcctcgcgacgggccaggtcgaagtagtggttcggacaggtacctaaacgtttcggccgtaggtaccagaacgtaacgtaaaccgtcggaccgacggtcctacccgacggtcccttcctccgtactagtcgtccgttccgtcctcccgaaccggcgggtccccttaggttcccaccgacgtacccggttaggttccggttgggtaccggttcggtacgtacgggtactaacgttcgttctaccgtntacctacgtactcggtacgaccggtcctacgtacggtactagttaacgttaacgtttcgtacctttacgttttacgttaccgtacgtttacctaaacgttagtttaccggtacggttaccgttaacgtccggggttacccttaccgggttaacctttaccggttaccggggtaaccccgggttaaacggtaaccgttaaccgggttacggaacggtttaaacccgtaccggaaaaccggttaacggttccgggttacggaacccgtttccggtaaacccgtaccgttacgtttaaacccggttcggtttaaccgttaacccttcccggtttaaccccgttccgttaaaccccg

SEQ ID NO: 219385 - DNA, 823 bp, Homo sapiens
  misc_feature: GYAE6OF01B7UTG.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagactaccatggagaagtagtcatgacgcagtctccagcccaccctgtctgtcgtctccgaggggaacncgcccaccctctcctgcgacgggccaggtgagtaatggtggcagactacgttagccgttcgaccgagacaacgaaccgtggacccacggccctaccccgaggtccccttccctacccttcgtacgtcgtccgttacgtcccctacccgaaccggtcccggggtccccgttcgggtacccggtacccgtaccgggtcccggttaacggggttttccgggttccgggggtacgggttcggggttaccggtacgggggaaccgttaacggtttaacccgtttaccgtaacccgttccctacccgtaacccgtacgttacccggtaccgggtaccccggtacccttacccggttaacggttacgtaacgggttaacgtttaccggtttttaacgtaccgtttttaacctttttacgtttacccgtacgttaaacgtaaacttcgttaacggtcgggtacgttaccggtacccgggttaccttaccggttaacgtttccggttaccggaccggtaaaccgggtaacctaacggagggtaacctaacgtaacgtaaaccgtggtacggtcgtacgccggtaactcgtacttcgtactcccttagtcccttcccgtaccgtccg

SEQ ID NO: 219386 - DNA, 804 bp, Homo sapiens
  misc_feature: GYAE6OF01EKOTT.24.87.H10.1.454.CMB.1.raw
  modified_base (124)..(124): a, c, t, g, unknown or other
  misc_feature (124)..(124): n is a, c, g, or t
  modified_base (218)..(218): a, c, t, g, unknown or other
  misc_feature (218)..(218): n is a, c, g, or t
  modified_base (736)..(736): a, c, t, g, unknown or other
  misc_feature (736)..(736): n is a, c, g, or t
tcagactactatgtcacgaccggtgctcgatttagcagtactgcgttgggtttgggggaggaactgctcagttaggacccagacggaaccatggaacgccccagcgcagcttctcttcctcctnctactctggcctcccagactaccacgtggaagaagttagtcagtcgacgctagtcctccagcccacctgtctgtcgtctaccgaaggggaaacncgccctaccctctccgtgcgacgggccaggtgagtaagtggtcgacagtactaacgttcgcctcggtaaccagaccgtaacgaaccgtcggaccgaacggtcctacccgacggtcccttaccccgttccgtacttaacgtcgtaccgttccgtacccgtaccccggaaccggtacccggggtccccgttaggtacccgtaccccgtaacggtccggttacgggtttcgggttcggggtccgggttagggtccggtacggtaacgtacgtttactttaccacctctacctaacctgtacctacggccgtcccttacgtaacgttcgaagtaacgtttgtttacgtacctttactttacgtttaccgtacgtaacctaaaccgtcgttaaggttcgggttactaccggtttccgtacccgttaaccgttaacggttacggtttacccgggaacgggttaaccgggtaactaacggtacggaaagtaaccgtaaacgaaaacgttacggttcggtaccgtntaaccggtcctaaaccgttgttaccgtttaccgttaaccttaccgtccctttcccggtccccgtaaac

SEQ ID NO: 219387 - DNA, 895 bp, Homo sapiens
  misc_feature: GYAE6OF01E1VQY.24.87.H10.1.454.CMB.1.raw
  modified_base (171)..(171): a, c, t, g, unknown or other
  misc_feature (171)..(171): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctgctcccagataccactggagaagtagtcatgacgcacgtcnccagcccaccctgtctgtgtcctccgaaggggaaacacgcccaccctctcctgccgagggcctagtgaagtagtgttcggcagactaacgttagcctagtaccagacgaacgaaaccgtcggaccgacggtccctacccgacggccttcccctccctcgtatcgtccgtcgtccgtacccgacccgaccgggtccccgttcggtcccgtaccccgtacggtcccggttacgggtttccgggttaccggggtcggggttccggggttacgtcgggggaaccgttacggtttaaccgttttacccgtacctttacccgtacccctaacccgtaaccgttaccggaaaccggtccccggtaaccccgtttacccgtaacggttaccgtttaacggtaaacggttttacgttttaacccgttaccgtttaaaccttttttacgttttacccgtttcgttaacccgtaaactttaccgtttacgtttacgggtaccgttaccggtttacccgggttaccccgtttaaccggtttaacccgtttaccggttttacccggggtaacccgggtaaccggggttaaacccgtaaaccggttacgggtaaacgtaacgtaaaacccgtaaaccggtaaccggtttacgggtacgggtacctccggaaccttaaccgttaccgttaccgtttaccgttcccttaccgttaccgttcccccgttccccgtaacccg

SEQ ID NO: 219388 - DNA, 613 bp, Homo sapiens
  misc_feature: GYAE6OF01C71DR.24.87.H10.1.454.CMB.1.raw
  modified_base (205)..(205): a, c, t, g, unknown or other
  misc_feature (205)..(205): n is a, c, g, or t
  modified_base (342)..(342): a, c, t, g, unknown or other
  misc_feature (342)..(342): n is a, c, g, or t
  modified_base (394)..(394): a, c, t, g, unknown or other
  misc_feature (394)..(394): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaancgcccaccctctcctgcgagggccagtgagaatgttggcagcaacttagcctggtaccagcaagaacctggccaggcctacccgaggcctcctcctctatcgctgtcctccgaccgcgggtcccctggtccgcccgngccgtgggttcgtggcggtgggtctgggactagtactttcacttcctcaccngtcgacggccggtcctcgtacgtctagtaagttagtttcgtacttactttattctagtactaactactagtacgtcgtacgtcgtccgttcgtacgttacgtttcggaccgtacgggtaacctaaggtcggtaacgtaacgtaaccgaaacgtacgttaggtacggtcgtacgccaaccgttgttccgttcgttcttacctacttcccgttcccgtacc

SEQ ID NO: 219389 - DNA, 682 bp, Homo sapiens
  misc_feature: GYAE6OF01BY0DE.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtagtctccgaggggaancgcccaccctctcctgcagggccagtgagaatgtggcagcaacttgcctggtaccagcagaaacctggccaggcctacccgaggcctcctcctctatcgctcgtcctcccaccgacgggcccctgggtcgtccccgagccgtacggttcggtgggcggtggggtctggggactagtactttccacgttcctaccaccctatccgaacggcccggtccctaccgtacggttaccgtaggtaacggttacttttcggtactttaacctttttattttccgttacgttacctaaacctacttacgttggttacgtacgttccgggtacccttcccggtaaccttaccggttttaccgggacccggtaacggggtaaccctaacggtaggaacgtaacgtaacgaaaccggtacgtaggtcggtctacggcccaaccgtagtccgtttcgttaccttactaccttcccttccccggtacccc

SEQ ID NO: 219390 - DNA, 725 bp, Homo sapiens
  misc_feature: GYAE6OF01ANKQQ.24.87.H10.1.454.CMB.1.raw
  modified_base (219)..(219): a, c, t, g, unknown or other
  misc_feature (219)..(219): n is a, c, g, or t
tcagactactatgtcacgaccggtgctcgatttagcagtactgcgttgggtttgggggaggaactgctcagttaggacccatacggaaccatggaagccccagcgcagcttctcttcctcctgctactctggctcccagataccactggagaagtagtcatggacgcagtctccagcccaccctgtcctgtgtctccgaggggaaacagcccaccctcncctgcacgggccagtgagaatgttggcagcaacgtgccttaggtaccagacgacgaaacctgggacctacggcctacccgacggcctcccctacctctagtcgctggccctccaccgcgggtacccctggtccgcctacgccgtgggttcgtgggcggttcgggtcgtacggggactggtactttccgacgttcctccgaacctacgtaccgcggtacccggtcctacgtacgtcgtacggtaagttcgtttttacccgactttattttacctttaccgttagtaccaaacgttacgtacgggttaccgtacgtaccggttaccggtcccgttaaccgttacccttaccgggttttacggaaccccgggtaacggggtaacccttaaacccgggtagggaaccgtaacgttaccggtaaaacgtcgggtacgttcggaccgttacggaccctaccgtattcccgggttacgttaccttacccggtactttccccgtaccccgtaac

SEQ ID NO: 219391 - DNA, 899 bp, Homo sapiens
  misc_feature: GYAE6OF01BDACR.24.87.H10.1.454.CMB.1.raw
  modified_base (217)..(217): a, c, t, g, unknown or other
  misc_feature (217)..(217): n is a, c, g, or t
tcagactactatgtcacgaccggtgctcgatttagcagtactgcgttgggtttgggggagaactgctcagttacggacccagacggaaccatggaagccccagcgcagcttctcttcctcctgctactctggcctcccagactaccagtggaagaagtagtcatcgacgctagtcctaccacgcccacctggtctgtacgtcctacggagggaaacncgccctacctctcctgcgacggcctagtgaagtatggtcgacacgactaacgttcggccgttacggaccacgacaacgaaccgtcggaccacggtcctacccgacggtcctaccctcgtcgtacgtcgtccgttaccgtacccctacccgtaacccggtcccgggtccccgttacggtacccgtaccccgtacggtcccggtttacggggtttccggtaccgggggttaccggttcggggtaaccttacgggggtaactacggttttacccttccgtaacctacccgttaacccgaccgtacgttaaccccggacccgggttacccggtaccttaccggtacgtttacgttaaggttaacgttttaaccgtttcgttaacccttttaacgttttaccgtttacccggtaacttaaaccgtttaaacccgttacgtacgggtttacggtacccggttaaccgttccccggtttaaacccgtttccggtttaaccggttttacccggttacccgggaaaccccgggtaaacggttaaccccgtaagggttacccgtaaacgttaaaaccgggtaacccgtaaaccggttagggttcggtaaccgggttacccaaccggttaccggtaaccctaggttcccgttaacttttcgtaaaccgccccgttttacccaccccgttacgg

SEQ ID NO: 219392 - DNA, 668 bp, Homo sapiens
  misc_feature: GYAE6OF01DPRN9.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanacgccaccctctccgtgcgacgggaccagtgagaatggttggacagcaacttcgcctaggtaccagacaagaaaccgtcggaccaggcctacccgaggtcctccctcctctactcgctgtcctaccaccgcgggtcccctggtctcccgagtcctagggttcgtgggcggtgggtcgtgggactaggtactttccactctccactacgtcgacggtccggccctacgtacgtcgttagtaacgttagtttttcgacctttaacttttagttccttacgttactaacgtaccgttagttggtacgtacgtccgggtacccttccgtttaccttacggtttccggggaccgtaacgggtaacctaaacggtgggaactaacgttacgaaaccggtactgggtacgtactacggccctaaaccttgttacttcggttacccttctaccgttccccttccccggtaac

SEQ ID NO: 219393 - DNA, 804 bp, Homo sapiens
  misc_feature: GYAE6OF01EVQRB.24.87.H10.1.454.CMB.1.raw
  modified_base (208)..(208): a, c, t, g, unknown or other
  misc_feature (208)..(208): n is a, c, g, or t
  modified_base (475)..(475): a, c, t, g, unknown or other
  misc_feature (475)..(475): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccacgtggaagaagtagtcatgacgcagtctccgagccctacctgtctgtgtcgtcgaagggaancgccacctctcctgcgacgggcagtgagagtgtggacagctaacgtacgccgtaggaccagcaagaaccgtcggaccgacggcctacccggaggtcctaccttcctatacgtcgtccgttcgtacctacccgacccggtaccgggtccccgttgggtcccgttacccgacggtaccgggttacgggttttccggttcggggccgggtttacggggttcggacgggtaaccttaggtcctttaccggacctttcctaccgaacccgtntaccggccggtacccgtacccttcgtaaccgttcgttacggttaagtttacgttttacggtacctttttaactttacgttttaccgttacgttaaccgttaaacgttaacgtttaacgttacgggtacgttaccggtcgttacccgttaccggttaaccgttacggtttaccgggaaccgggttaaccgggtaaacccttaagggttacggaaaccgttaacgtaaccggtaaaccggtacgttaccgggtacgtacggtaaccgaccgttaacgttaccgttacgtttacgttaccttacccgttcccgttcccgtcccgttaacccg

SEQ ID NO: 219394 - DNA, 731 bp, Homo sapiens
  misc_feature: GYAE6OF01CGCUD.24.87.H10.1.454.CMB.1.raw
  modified_base (646)..(646): a, c, t, g, unknown or other
  misc_feature (646)..(646): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctgcctccagactaccactggagaagtagtcatgacgcagtctccagccacctgtctgtgtctacgaggggaaacacgccaccctctcctgcgaggcagtagagtaagttggtgctagactacgttacgctacggtaaccagacgaacgaaaccgtcggacctacggccgtacccgaggtcccttcccgttcctacgttacgtcgtccttcggtaccctcccgaaccggtccggtccccgttagggtcccgtaccccgtacggccgtttaacggggttcggtttcggggtcggtttcggggtcggtacggggaacgttcggttaacgttttccaacccgttctaccaccgttaacgacccgtagggccccggttacccttaccgtcgttacgttaacgtacggttactttacgtactttacttttaacgtttcctacttactaacttacgttacgtacgtacgttacgtcgtaccttaccgtagttacgtttaccggacggtaaccggtactaacgnggtaacgtaacgttaacgaacgtacggtagtccggactacggtccacgttcgtccttactacttacctcttcgttcccgtaaccg

SEQ ID NO: 219395 - DNA, 704 bp, Homo sapiens
  misc_feature: GYAE6OF01BFLDF.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaangccaccctctcctgcagggccagtgagatgtggcagcaacttgcctgtaccagcagaactggcaggctccagctccctcctctatgtctgtcctccgaccgacgggtcccctggtccgtcccgacgcccgtaggttcgttcggggtcggtcggggtcgtgggactagtactttccgactcctccacctatccgacggccggtaccctccgacgtcgtagtaagttcttttcgtaccttactttatttccgttcgttacctaactacttagttcggttacgtaccgtcggtaccttcccggttaacctttaccggttttacgggacccggttaacggggtaaaccctaaacgggttacgggtaaacggtaaccgttaaccgaaaaccggttaaccgttacgggttcgggtaacccttacggtacccgtaacccgttaccgtttacccgttacggttttaccctttacgttacccgtttcccccgtttccccgtaaccccg

SEQ ID NO: 219396 - DNA, 794 bp, Homo sapiens
  misc_feature: GYAE6OF01AUWCX.24.87.H10.1.454.CMB.1.raw
  modified_base (208)..(208): a, c, t, g, unknown or other
  misc_feature (208)..(208): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagcctaccctgtctgtcgtctccgaggggaaacncgcccaccctctcctgcgagggccagtgagtatggtgcagactaacgtagcctaggtaccagacaacgaaccgtcggaccacggcctcccgacggtcccttcctacctcgtagtcgtcttccgtccctaccctaacccggccgggtccccgtagggtcccgtaccccgtacggtacccggttacgggtttcggttcgggggtaccgggttcgggtacgtacggggaactaggtttacctttccgacttcctaccgacctacgtccgaccggtccggtcccttaccggtaggttcctaaggtaactttagttttaccggtaccttttaaacgttttccgtttacgtacggttaaccctaaacgttacgtttagggttcggttaccgtaccggttccggtttaccccgtacccgtttacggtttaccggtttaacccggggaccggtaaaaccggggtaaacccttaagggttacgggtaacgtaaaccgttaaaccggtaaaccggtacgttcgggtaccgtaccgtacggtaccctaaccgttatttcccgttagttacccttagtccccttcccgtcccggtaac

SEQ ID NO: 219397 - DNA, 257 bp, Homo sapiens
  misc_feature: GYAE6OF01AXB9M.24.87.H10.1.454.CMB.1.raw
  modified_base (255)..(257): a, c, t, g, unknown or other
  misc_feature (255)..(257): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaacatagtagtctgagcgggctggcaggctcatagnnn

SEQ ID NO: 219398 - DNA, 759 bp, Homo sapiens
  misc_feature: GYAE6OF01E2XFH.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggcctcccagagacccaccggagaaattgtgttgacacagtctccaggccaccctgttctttgtcctccgaggggagagacgcccaccctctccgtgcgacgggccacggccggagttagttagtaagttacgttaggcgtacggtaaccaaacgaacgaaaccgtcggaccgacggcctacccgacggtcctcctactacttctagtcgtacttcgtcctaccgaacgtacgggtccacgtccggcccgtcccgcgtacggttcgaggtcggacgtacgggttcgggtcggtagggaacacgtacttacgacctccgtaccgaccgtacgacgcacggtcctaggacgtccgtaaggtaagtttcgttttacggtaccgttttactacgttcgtacgtacggtcgtccggtaccggtttcccggccgtcgggtaccccgttaacggtttacccggggtttcggggggacccgggggtaccgtagggggtacgggaagggtaacgggtaacgaacggtacggttgggtaccggcgtccggtaccaaccttagttccggtttcgttacccttccgtacccgtttccccgttccccgaccttacttacggtactaaaccgtagttaacggg

SEQ ID NO: 219399 - DNA, 660 bp, Homo sapiens
  misc_feature: GYAE6OF01DYGY3.24.87.H10.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgccaccctntcctgcagggccagtgagtatggttgcagcaacgttgcctggtaccagcaagaaccgtggccaggcctcccgaggcctcctccgtctatgcctcgtcctccaccgacgggtcccctggtccgtcccgagtacccgtggttcggtcgggcggttcgggtcgtgggactggtactttcgctctcacctatcgacgccggcctcgacgtctagtaagtacttttcgactttactttgttcttagtacctaacgtactaggttcggtacgtacgtcgtccgttaccgtaacgttcgtttacgggacccggtaagggttaaccctaacggtcgggaaacgtacgtaaccgtaaaccgtacggtacggtacgggtaccgttcgacccggtaacttccgttacgtttaccggttaccctttaccgtaccctttcccggttccccggttaaccc

SEQ ID NO: 219400 - DNA, 761 bp, Homo sapiens
  misc_feature: GYAE6OF01CCD08.24.87.H10.1.454.CMB.1.raw
  modified_base (466)..(466): a, c, t, g, unknown or other
  misc_feature (466)..(466): n is a, c, g, or t
  modified_base (739)..(739): a, c, t, g, unknown or other
  misc_feature (739)..(739): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccactggagaagtagtcatgacgcagtctccagccaccctgtctgtcgtctccgaaggggaacacgcccaccctctccgtgcgacgggccaggtagagaattggtggacaggacaacgttagccgtaggtaccaggacaacgaaaccgtggcccaacggtcctacccgtacggccttaccgtcccttactagtcgtctcgtccctacccgaaccggaccgggtcccctgggttccgaccccgaggtcccgtagggttcggttcggggtcgggtacgggtccgtaggggtaacctaggttactttaccacttccgtaccaacgtntccggaccggccgtcccttacgacgttaccgtagtaacggtttactttacgtacctttaacgttttactttacgtacggttaacctaacgtactttaggtacggttaccgtacgttaccggtaccgtttaccgtaactttccggtttacggaacccgggttaacggggaaacctaaacgggtacgtaaacgtaacgtaaccgtaaaaccggtacgttagggtaaccggtcgttacgacccgtacctacgtttccgttacgttaccctttaccncctttccccgtcccggtaaccc

SEQ ID NO: 219401 - DNA, 758 bp, Homo sapiens
  misc_feature: GYAE6OF01BORVK.24.87.H10.1.454.CMB.1.raw
  modified_base (225)..(225): a, c, t, g, unknown or other
  misc_feature (225)..(225): n is a, c, g, or t
  modified_base (746)..(746): a, c, t, g, unknown or other
  misc_feature (746)..(746): n is a, c, g, or t
tcagactactatgtcacgaccggtgctcgatttagcagtactgcgttgggtttggggaggaactgctcagttaggacccagacggaaccatggaacgcccagcgcagcttctcttcctctgctctctgcctccagactaccacgtggaagaagtacgtacaagtcgaccgctacgtcctccaccggccctaccgtgtctacggtcgtcccgtacggaagggaacnccgtccctaccctctaccgcggacgacgggaccagtacgaactagttaggttaaggaagttgtacgtcgtagtactacgaacaacaactcgcggaccgaccggtccctaccccggtctacgtaccattaccgtatacggctacgactaacttacgaacggttccgaccctaggtccggaaccctaccgtaaccgaacggttaccgtaacggtcggtaacgggtggacgggttacggtacgggttacggacgtaacctaccggttacttactacccgtacctccgtaaccttacgacgaaggttacggtagtaacggtacgtacgtaaggtacgttaaagtttacgtttacgtcttttaaaggttccttaacgtctaccgacgttacccgtagtaacccgtacgttaccggtacccgttaccccgttccgttaacccgggccgtagtaaccgcgtaccgacgtaccctaacgacctaagggtcccgtagtccggtacacccgtaacgtccctattcccgttntaacccgttccg

SEQ ID NO: 219402 - DNA, 712 bp, Homo sapiens
  misc_feature: GYAE6OF01EDNO9.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanacgccaccctctcctgcgagggccagtgagatgttgcagcaacttgcctggtaccagcaacgaaaccgtggccaggcctcccgaggcctcctcctctactcgctcgtcctcccgaccgacggggtcccctgggtcgtccccgacggtccgtacgggtttccggttggggtccggttaggggtccggttaggggactacggtaactttccgactctaccaccgtatcccgacggcccgtcccgtccgtacgttacgtaggtaacgttacttttcggtactttaacttttactttaccttacgttacctaacctagttacgttcgggttacgtacgttccggtccttacccgttacgttacggttttcgggaccgtaacggggtaacctaaccggtaggtaacgtaacgtaaccgtaaacgtaaccgttacgggtacggtaccgtcgtacccaaccgttacgttacccgttcgttaccgttaccgttaaccttcccgttccccggtaccc

SEQ ID NO: 219403 - DNA, 870 bp, Homo sapiens
  misc_feature: GYAE6OF01BJEOI.24.87.H10.1.454.CMB.1.raw
  modified_base (208)..(208): a, c, t, g, unknown or other
  misc_feature (208)..(208): n is a, c, g, or t
tcagactactatgtcacgaccggtgctcgatttagcagtactgcgttggggtttgggggaggaactgctcagttaggacccagacggaaccatggaacgccccagcgcagcttctcttcctcctgctactctggcctcccagataccactggagaagtagtcatgacgcagtctccacgccacctgtctgtcgtctccgaggggaaanacgcccacccgttctccgtgcacgggccagtgacgtaagtcgttggcagactaacgttacgcccgtggtaaccaggtacaaacgaaacccgtcgggacccaacggtcccgtacccgacggtccccttccgtaccctccgtttagtcgtctaccgtccgtaccgtaccgaccggggtccccttggtacgttaccccgacgtaccggtacgggtttcgggttcgggtccggttaggggttccggtaggggaccggtagttaccgttttaccgaacctttccgtaccgaaccctacgttaccgacggtcccgtccgttacccgacggttaccttagggtaaacttcggttttactacctttaacgtttttacgttttaaccgtaccggttaaccttaaaccgttaacgttacgtttaacgggtttacgtacggtttacccgggtttaaccccttaccggttttaacccgtttacggtttttacccggggaacccgggttaaaccgggggttaaacctaaacgggttacggtaaacgtacgtaaaccgtaaaacccggtaaggttaccgggttaccgtaccggtaccggtacccgtaaacccgttcgttaacccgtttcgtttaaccctttccggtaaccccctttcccgggttcccccttaaccg

SEQ ID NO: 219404 - DNA, 701 bp, Homo sapiens
  misc_feature: GYAE6OF01DMM5X.24.87.H10.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
  modified_base (677)..(677): a, c, t, g, unknown or other
  misc_feature (677)..(677): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccacctgtctgtgtctccgaggggaanacgccaccctctctgcgagggccagtgagatgtggnagnacttgctggtacagcaagaaccgtgaccngcctccaggcctccctctcacgttgcttcgtcctccgaccgtaccggtccctaggtcctaccgacggtccgttaggttcggtcggggtcggttcggtcggtacggactaggttctttaccgaccttccgtacctaacgactcgaccgtacccggtacctcggttaagtcgttaagacttttagtttcgtaacgtttacttttacgtttccgtattaccgtaaactcgttacggttggtacttaccgtccgtaccgtttaccgttacgttaccggtttccgggaaccggttaaccgggaaacttagggaccggttaagtaaacccggtaaacgtaaccgtaaccggtttaggccggttacgtaaccggttccaaaccggtttctacgttttccgttaaccctttacncccgtttccctcccgtaaaccccg

SEQ ID NO: 219405 - DNA, 706 bp, Homo sapiens
  misc_feature: GYAE6OF01D78JK.24.87.H10.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagactaccactggagaagtagtcatcgacgcagtctccagcccaccctgtctgtcgtctcgaggggaaancgccaccctctccgtgcgacggccagtganagttgtggacagactaacgttcgaccgtaggtaacccagtaccgaagtaaacccgtcggaccgacggcctacccgaggtcctcccttccgtacttgcgtcctcgtacctcccgaccgtcgggtccctaggtcgaccgtacggtccggtacggtttcgtcgggtacggtggtccggtagggactagtcctttacgctccgtcacgtacgtacgtccggccgtaccctccggtaacgttcgttaaggtatttacgtttacgttacgtttaacctttgtttaccttacgtaactaaccgtagttagtacggtacgtacgtccgttcccttaccgttacttaccgggtttcggaacccggtacggttaacgtaaccgtggggaaactacgtaaaccgtaaacgtacgtacgggttacgacgtacggccctaacgccttacgttctacgttaccttacgttccccgtcgtaccc

SEQ ID NO: 219406 - DNA, 630 bp, Homo sapiens
  misc_feature: GYAE6OF01DYWGN.24.87.H10.1.454.CMB.1.raw
  modified_base (152)..(152): a, c, t, g, unknown or other
  misc_feature (152)..(152): n is a, c, g, or t
  modified_base (209)..(209): a, c, t, g, unknown or other
  misc_feature (209)..(209): n is a, c, g, or t
tcagactactatgtcacgaccggtgctcgatttagcagtactgcgttgggtttgggggaggaactgctcagttaggacccagacggaaccatggaagccccagctcagcttctcttcctcctgctactctggcctcccagatgccaccgganacatttgtgttgacacagtctccagcccacccttgtcttttgtctccgaggggaaanacgcccaccctctcctgccgacgggtccagtgactaagttgttaaggtaagtttgttagcctggtatacaaacaacaaaacagtcggccacgggcctcccggctcctctatctatgtatgacctatacccgtaagtacggccacgtcggactactcccgaagtacgtaggtcaggtggcgtagggtggtcgtagggaactacgtaccctaccacttcctaccaaccatcgacgtacgagttagagacgtacgtagtagtttatttagacgtttagtttactacgtcgtacagtacctaccgtataacctacgtccgtacccgttcgtttcccgggcccgtagggaccctagtaccgtacggacctaaccgtaccgaacgttagtggtcgtactcgaccacgtattccgtctccttctcccg

SEQ ID NO: 219407 - DNA, 605 bp, Homo sapiens
  misc_feature: GYAE6OF01B6KNV.24.87.H10.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (423)..(423): a, c, t, g, unknown or other
  misc_feature (423)..(423): n is a, c, g, or t
  modified_base (456)..(456): a, c, t, g, unknown or other
  misc_feature (456)..(456): n is a, c, g, or t
tcagactactatgtcacgaccggtgctcgatttagcagtactgcgttgggtttgggggaggaactgctcaggttaggaccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtganatggttggcagcaacttagcctggtaccagcagaaacctggccaggcctcccgaggcctcctcctctatgctgtcctccacccgacgggcccctgggtcgtccccaggtcccagggtttcgttcggggcggttggggtcgttggggacaggtactttcgactctcacctatcacggcgcctcagtctagatntttgcttatttatttctgtacaactatatggtntacgtcgtcctccgtactaccgttttcgggaccgtaacggggtaacctaaacgttcggaaggaacgttaacggaaaacgtaacgtcggtacggctcggccaacctacgttcgttcgttaccttactaccgttcccgttccccgtacccg

SEQ ID NO: 219408 - DNA, 720 bp, Homo sapiens
  misc_feature: GYAE6OF01CWK5V.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccactggagaagtagtcagtgacgcagtctcacgccaccctgtctgtcgtctccgaaggggaancgccaccgtctccgtgcgacgggccagtgagatgtcggcagctaagttcgaccgtacgtaccgagactaaggaacctcggaccgacgcccgtaccgtacggtccctaccgttcctacgtatcgtccgtcgtcccgtaccgaccgaccgggtcccgttcggtccgtacccgacggtccgttagggtttccggtcgggtcggtcgggtacgtagggacgtagttacgttaccgacttacctaccaccgtagtccgacggtaccgtccctacgtacgtaccgtagtacgtttacgttcgttacgtttacgtttcgtttacgttagtaacctaagttacgtagttacggtacgttacgttccggtacccgttacgttaccgttaccggtttaccgggtaaccggtaaccgggtaaccgtaaccgtcggaacgtacgtaacgaacgttacgtaggacgtacgcgtaccgtaccgaagtttccttaccgttacttacccgtacttccccgtaccgtaccg

SEQ ID NO: 219409 - DNA, 792 bp, Homo sapiens
  misc_feature: GYAE6OF01D9UIH.24.87.H10.1.454.CMB.1.raw
  modified_base (213)..(213): a, c, t, g, unknown or other
  misc_feature (213)..(213): n is a, c, g, or t
  modified_base (354)..(354): a, c, t, g, unknown or other
  misc_feature (354)..(354): n is a, c, g, or t
tcagactactatgtcacgaccggtgctcgatttagcagtactgcgttggggttgggggaggaactgctcagttaggacccagacggaaccatggaagccccagcgcagcttctcttcctcctgctactctggcctccagactaccacgtggagtaagtagtcatgacgcagtcctccacgcccacctgtctgtgtcctaccggaaggggaacncgcccaccctcctccgtgcgacgggcctaggtgaagtagttcggtaggacaacggtacctaacgttcggccgttaccggtaaccaggacctaaacggaacccgtcggaccgacggtccctaccgacgtcccttccgtcctntacgtctccgtccgtccgtacccgaccgtcccgggtcccgtaggtccccaccgtacggtccggttagggttccgggtgggtcgggttcggtacggtacggtaacgtacgttcgttacctaccgtactacccgactcgtccggaccgtcccgtacctacggtacgttcctaagggttactttacgttttacgtactttacgttttacgttcctaaggttaaccctaagtttaccgttggtacggttacgtcccggttaccgtacccgttaaccgtttacggtaccggtttaacccggggaaccgggaaaccgggttaaccctaagggttacggaaaccgttaaaccgtaaacggtaaaccgttcggtcggtaaccgtctaccgaacgttccttagggtcctttacccgtacttacctaccccgttcccggttacctacg

SEQ ID NO: 219410 - DNA, 924 bp, Homo sapiens
  misc_feature: GYAE6OF01AVT0F.24.87.H10.1.454.CMB.1.raw
  modified_base (213)..(213): a, c, t, g, unknown or other
  misc_feature (213)..(213): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccacgtggaagaagtgtacagtgacgcagtcctccagccctacctgtctgtcgtactaccggaagggaaancgcccacccttcgtccgtgcgacgggccagtgaagtattgtgcagactaaacgttcgccgttaggaccgtagacgaaaccgtaaaccgtcggaccgaacggtcccgtacccgacggtccccttccccgtaccttacgtacgtcgtccgttccgttaccccgtacccgtaacccgggtacccgggtccccgtttacgggtacccgtaccccggaaccggttcccgggtttaacggggtttcccgggtttcgggggtcccggggtttaacggggttccgggttaaaccggggtaaccgttaacggtttaaccgtttttacccgggaacccttttcccggtaaaacccccttaaccgtaacgtacccgggtaacccgggtacccggtaacccttacccgggtaacggtttaaccgttaaacgggttaacgtttacgtttttaacgtaccgtttttaaaacctttttccgttttacgtaaccgtttaaccctaaacggtttaaccgtttaaggtttcgggtaacgttccggtttaacccgggttccccgttaaccggtttaaccgtttacccgggtttaacgggaacccggttaaacccggggtaaacctaaaccgggtaggtaaccgaaaccgttaaacgaaaacggtaccggttaggtaccgacgttacactaccgattccgtacgttccttaccgtactacccgtccctacg

SEQ ID NO: 219411 - DNA, 805 bp, Homo sapiens
  misc_feature: GYAE6OF01EVRAK.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaancgccaccctctcctgcagggccagtgagaatgttggcagcaacttagcctggtaccagcaagaaaccgtggccaggcctaccgacggtcctaccctcctactagtcgtactcggtcctacccgacccgaccgggtccccttgggtaccgtccccgaacggtcccgttagggtttccggttcggggtaccgggttcggggttcggtcggggactaggttacgtttccaccgttctaccaacctactcgacggcccggtaccttccgacggttacgtaggtaacgtttacgttttacgtactttaactttttacgtttaccgttacgttaaccgttaaaccgtacgtttaacggtttacgggttacgtacccggttccgggtaccccgttacccggtttaaccgttacccggtttttaccggggaacccggttaaaccggggggtaaacccttaaaccgggtacgggtaaccgtaaacgtaacccgtaaaaaccgggttaaaccgttcggggtacggtacccgttacggtaaccctaacccgttactttccgttacggttttacccttaacccgttaccgtttccccgtaccccggttaacccg

SEQ ID NO: 219412 - DNA, 771 bp, Homo sapiens
  misc_feature: GYAE6OF01BGIFW.24.87.H10.1.454.CMB.1.raw
  modified_base (151)..(151): a, c, t, g, unknown or other
  misc_feature (151)..(151): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactgganaagtagtcatgacgcagtctccagcccaccctgtctgtcgtctccgagggggaaagacgccaccctctcctgccagggccagtgagaatgtggcagcacttagcctggaccagacaacgaaacctggaccaggcctccgacggtcctcccctcctactactcgccttcgttacctcccgaacccggtaccggggtcccccttggggttcccgtccccgaacggtcccggttaggggttttccggtttgggggtccgggttggggtcgttacggggactaaggttacttttccacgtttacctacccgaacctacgtcccgacggtccggtcccctaccgacgttccgtaacgtaaggttactttttacggtacctttacgtttttaattttccgtacgttaccgtaaaccttaacgtttagttcgggttacgtaccggttcggttaccccgttacccggtttaaccttaccggtttttacgggacccgggtaacgggggtaaccctaaacggtacgggtaacgtaacttaaccggaaaaccgtacggtacggtcgggtactcggacctaccgtacgttaccgttcgttaccttaccttaccgttcccgttcccgtaaccc

SEQ ID NO: 219413 - DNA, 745 bp, Homo sapiens
  misc_feature: GYAE6OF01A0TGU.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaancgccaccctctcctgcgaggcagtgagatgttggcagactaacgttagcctaggtaccagacgaacgaaccgtggacccaggcctacccgaggcctcccgtcctctacgtcgtctcgtaccctcccgaccgaccgggtccctcggtccgtccccgacgtccgttacggggttccgtttcggggcgggttgggtcgtagggactagtcgtttcgcgtctaccaccgtagtcgaccggcgtccctactacgtacttaaggtaacgtttcgttttgaccgttttacttttacgtttaccttgttaaccctaacgttacttagttcggtcgttaccgtccggttacccttacccggttaacgtttaccgtttaccggggaacccggttaacggggtaaaccccttaagggttaccggtaacgttaaacgtaacccgttaaaacgggtaccgttacggtccggtacgtacccggtaccgtaacccgtttaggtttacccgtttacgttacccccgttattaccccctttccccgttacccggtaaccc

SEQ ID NO: 219414 - DNA, 785 bp, Homo sapiens
  misc_feature: GYAE6OF01CTQAK.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagactaccactggagaagtagtcatgacgcagtctccagccacctgtctgtgtcctccgaggggaagacgccaccctctcctgcgagggccagtgagatgttgcagactacttacgcgtaggtaccagaccgaacggaaaccgtcggaccgacggtccctacccgacggtccctcccttccttacgtacgtcgtcctcggttccctacccgacccggtacgggtccccgttggtcccgttaccccgacggttcccggttagggtttcggttcgggggtcgggttcggggtacggtacggggaacttagggttaaccttttccggaaccctttcctaccggtaaccctacgttccggtaaccggccccggttacccgtaacggtacgttaccgttaaggttaaacgtttcgtttttacggacttttaacggttttaacttacggttccgaacgttacgcctaaggccaaacgttcggtcgtaccggtcgtcccggttcgtttaaccgtccgggtttccggggaacgggtaacgggtaccggttaggggacggaacgtaaacgttaccgaaaacgggttcgtacgggtacggtctaccggtaccctaacggttacttcccgttgtttaaccctcgttcccgttacccccg

SEQ ID NO: 219415 - DNA, 809 bp, Homo sapiens
  misc_feature: GYAE6OF01DDG7S.24.87.H10.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
tcagactactatgtcacgaccggtgctcgatttagcagtactgcgtttgggtttgggggaggaactgctcagttaggacccagacggaaccatggaagccccagcgcagcttctcttcctcctgctactctggctcccagataccactggagaagtagtcatgacgcagtcctcagcccacctgtctgtgtctccgagggaaancgcccacctctcngcgacgggcctagtgagtatgtgcancaacttcgctaggacagacaacgaaccgtggaccacggccctaccgacggtcctacccgttcccttacgttacgtcgacctttcggtaccccgtaccccgtacccggtacccggggtcccccttagggttccccgtacccggtaacggtcccgggtttacgggttttcggggttcgggccggggttttcggggtccgtaacggggtaacttacgggtttaccttttccgaccgttacccgtaccgtacccgtaacttcccggaaccgggcccgttacccgttaccgtacggtttaccgtaacggttaacgtttacggttttacgttaccgttttaacgtttttaactttccgtttaaccgttacctaaacgtttaccgttacggttacggttacgtccggtttaccggttcccgttacccgtttaacgttaccggtttaccggaaccgggtaacggttaaccgtaacggtaggtaacgttaaacgtaccggaaacgtagtcggtcggtacttacgccgtaacgtacctttcggtacttcttaccttaccttcccggttcctacccg

SEQ ID NO: 219416 - DNA, 1078 bp, Homo sapiens
  misc_feature: GYAE6OF01EBU6O.24.87.H10.1.454.CMB.1.raw
tcagactactatgtcacgaccggtgctcgatttagcagtactgcggtttgggtttgggggaggaactgctcagttaggacccagacggaaccagtggaacgccccagcgcagcttctcttcctcctgctactctggcctcccgagactaccacgtaggaagaagttagtcaagtcgacgacacgttcctccgacgccctacccgttgttccgtggttcgtaccgtaccggaaagggggaaacgccgtacccctaccccttccgttaccgtcggaccgacggggacctaggtacgaagtaagttcggttcggacagtaccttaacgttccgtaccggttacggtaacccaggaaccgaaacggtaacccggtcggacccgtaaccggccctaccccggacggttccccttccccgttccttacgtacgtccggtaccgtttccgtcccctaccccggaccggtacccggggtccccttcgggtaacccgtcccgaccggttccgggtttacgggttttccgggtcggggtccggggttcggggttaccgtagggggtaccttaacgggtttacctttcccggaacctttaccgtaccccgaaccttacggttacccgaaccgggtccccggttacccgttaccgttaccgttaaccgggtttacggtttaacgtttacggttttttaccgttaacccgttttttacgtttttaaccgttttcgttaccgtttaccccgttaaaacgttaaccgttttggtttacccgggtttaaccgggtttacccggttacccgggtttaaccccgggtttaccccggtttttaaccccggttttaaccggggttttacccccggggtaaccccggggttaaaccggggttaaaccccggtaaaccgggttaaccgggtttaaaccggtaaaccgtttaaaacccggttaaacccgggtaaccgggttaaccgggtaccggttaccggtacccggtaccccgttaacgtttacccgtttcccgtttacccggttttacctttaccccgggtttaacccttttcccccggttaaccccggtttaacccg

SEQ ID NO: 219417 - DNA, 745 bp, Homo sapiens
  misc_feature: GYAE6OF01CLINY.24.87.H10.1.454.CMB.1.raw
tcagactactatgtcacgaccggtgctcgatttagcagtactgcgttgggtttgggggaggaactgctcagttaggacccagacggaaccatggaagccccagcgcagccttctcttcctcctgctactctggcctcccagataccactggagaagtagtcatgacgcagtctccacgcccacctgtctgtcgtctccgagggaaagcgccacctctcctgcgaggccagtgagtaagtggtgcagactaacgttcgcctaggtacccagcaacgaaaccgtggccgacggcctaccgacgtcctcctcctctactcgtctctcctcccgtaccggaccgggtccccgtcggtccgtccccgacggtccgtacgggtttcggttcgggtcggggtcgggtcggtaggggaacctaagttacgttccaccgttcctaccgtacctacgtacgtaccgaccggttacccgtccgtacgtacgtagtaacgttacgtttacgtacttacgttttacttttacttacgttacgttaactaacttacgttacggtacgtacgttccgttcccgttccgttaaaaaaaaccgttccgtttaccgggtacccggtaaccgggtaacccgtaaccggtacggtaacggtaacgtaaaccgtaaaccggtaacgtacgggttacggtacgtcgacccgtaacctacgttaccgttaccgttaccttaccttacccgttcccgttcccgtacccg

SEQ ID NO: 219418 - DNA, 733 bp, Homo sapiens
  misc_feature: GYAE6OF01B2ZX8.24.87.H10.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (580)..(580): a, c, t, g, unknown or other
  misc_feature (580)..(580): n is a, c, g, or t
  modified_base (588)..(588): a, c, t, g, unknown or other
  misc_feature (588)..(588): n is a, c, g, or t
  modified_base (698)..(698): a, c, t, g, unknown or other
  misc_feature (698)..(698): n is a, c, g, or t
  modified_base (724)..(724): a, c, t, g, unknown or other
  misc_feature (724)..(724): n is a, c, g, or t
tcagactactatgtcacgaccggtgctcgatttagcagtactgcgttggggtttgggggaggaactgctcagttaggacccagacggaaccatggaagcccagcgcagcttctcttcctcctgctactctggcctccagactaccactggaagaaatagtgatgacgcagtctccgacgcccacctgtctgtcgtcgtaccggaaggggaaacncgcccaccctctccgtcgcgacgggcagtacaagacgtaanaaggaagccaaacttacgtttacgccttaggtaactacaaacgtaacggaaaccgtgggacccacggtacctaccccgaggtcccctactacgtactttccgagttacggtactactaccgaggtaccgaacgggcctacggttcgggtaccctaccgaggtaccgttaacggggtactacgggtcggacggtaggttcgggggtacctacgggggtaactacggttacgttcaacctccgtaccaccgtactacggtaacgcgtaagtccacgttacgtacttacggtagtaagtttatttcggactttaacggtttataccgngaccgtancgaacgtcagtacgggtagaccgtcggcccgttactaccggtagggttacccggggaaccggtaagggtaaccgacggggtaggaaactaccgtaaaccggtaaaccggntttcgggaacggtcacggtaaacccncgtttaacg

SEQ ID NO: 219419 - DNA, 1034 bp, Homo sapiens
  misc_feature: GYAE6OF01CES6A.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaagggaaagcgccaccctctcctgcagggccagtgagtaagtgttggcagaccaacttacgccgttacggtaaccagacaacgtaaaaccgtcgggacccagggcccttacccgacggtccctacccctacccttcgttaacgtcggtccttcggttacccttccccgtaaccggacggggtccccttccgttcggggttccggtacccccgtaacggtccccgttaaggggtttttcccggtttcggggtaccgggggttttcgggggttccggttaccgggggggtaacctttaacgggtttaacccgttttccggttaacccgtttaccccgttacccgttaaacccccgtaaccgtttaacccgggaacccgggttccccggggtaccccccgttacccggttaacccggtttaaccccgggtttaacggttaaaaccggggttttaccgtttttttaacgggttaacccgtttttaaaccgttttttttacccggttttttaacccgtttaccggttttaaaccccgtttaaaacccgtttaacctttaaaccgggttttacgggttaaccgggttaacccgggtttaacccgggtttacccccgtttaacccgggtttaaacccgtttacccgggttttttaaccggggaaccccgggttaaacggggggttaaaccccgtaaaccggtttaacggggtaaccgttaaaccggtaaccgtaaaaacccggtaacggttaccgggttacggtaccggtaccgtaacccgtaacccgttaacgttaccgttaccggtttaccctttaccgttacccgtttcccgtttaccccccg

SEQ ID NO: 219420 - DNA, 818 bp, Homo sapiens
  misc_feature: GYAE6OF01DTMAS.24.87.H10.1.454.CMB.1.raw
tcagactactatgtcacgaccggtgctcgatttagcagtactgcgttggggtttgggggaggaactgctcagttaggacccagacggaacatggaagccccagcgcagcttctcttcctcctgctactctggctcccagataccactggagaagtagtcatgacgcagtctccagcccaccctgtctgtcgtctccgaggggaaacgcgcccaccctctcctgcgacgggccaggtacgagaagtcgtggctagactacgttacgcctaggtaccagctaacgaaacctggaccaggcctacccgaggtcctacctccgtactacgtcgtctacgtcctacccgaccgtacgggtcccctggtccgtacccctacggccgtagggtttcggtcgggtcgggtcgggttcgtcgggacgtacgttaacgtttcctaactccgtactaaccctagtccgacggtcccggtcctaccgtacgtacgttaggtaacgtttacgttttcgtacgtttaaactttttctttaccgttacgttaaacctaaccgttaacgtttaggtttaccggttacggtacccgtttaccgggttcccctttaacccgggtttaacccgtttaccgggtttttaacccggggacccgggaaaccgggggtttaaaccctaaaccgggttacggggtaaacgtaaaccgtaaaccggtaaaacccggttaacggttacgggttaacgtcccggtaacggtaaccccgtaacccgtatttacccggttaccgtttacccttaacctttaccgtttccccgttaccccgtaacccg

SEQ ID NO: 219421 - DNA, 844 bp, Homo sapiens
  misc_feature: GYAE6OF01EFJGB.24.87.H10.1.454.CMB.1.raw
  modified_base (761)..(761): a, c, t, g, unknown or other
  misc_feature (761)..(761): n is a, c, g, or t
tcagactactatgtcacgaccggtgctcgatttagcagtactgcggttgggtttgggggagaactgctcagttaggacccagacggaaccatggaacgccccagcgcagcttctcttcctcctgctactctcggcctccagactacccagtggaagaagtcgtcagttgaccgcacgtcctacccgacgccctacccgttgtccgtacgtccgttacgaccgggaaagggaaacgccgtaccccctacccgttcctccggacgaccggacgggtcctaaggtaggtaaggtagtttcgggtcggaacgtaccggtaccttaaaccggttccggacccggtttaacggtaacccacggaaccgaaaccggttaaacccggtcgggaaccccgtacggtccccaaccggtcggtccccttaccctccgttacgtcgtcgtacccgtttcgccccgtacccgaacccggtcccggttccgtacggtcccgtccgaccggttacgtcgggtttccgggcggggttcggtaccggttggacgaccgtttaacgttctttcccgactttaccgaccgtaacccgtgttccccggaccggtcccgttacccgtacgtaacgtttccgaagtttagtttacgtttcgttacctttaacgttttcgtaccgttacgttacaacgttcgtaggttaccgtccgtgtacccgtacgttaccggttacttaccggtaccgaaccgggtaacgtaaccgttacgaacgggtaanacccggtaaacgaggtacgttcgggactccgtagccccgttaatcggttccttactcccttaacgtccgttcccctcgtaacg

SEQ ID NO: 219422 - DNA, 767 bp, Homo sapiens
  misc_feature: GYAE6OF01A0UIR.24.87.H10.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaanagccacctctcctgcaggccagtgagaatgttcggctagctaacgttagctgggtaccagcaacgaaacctgggaccaggcctcccgaggcctacctccnctactgctcgtctccaccgacggccccgtggtcgtccccgagtccgtagggttccgttgggccggttgggtccgtaggggactacggtactttaccgacttcttacacccgtaactcgacggccgtcctaccgaagtccgtagaacggttattttcgtacgtttaacttttcgtttaccgttacgttaactaaaccctagtttaacgttccgggttacgttaaccgtcgggttaaccccttcccggttaaaccgtttaacccgtttttacccggggaacccggttaaaacggggggttaaaccccctaaacggttaacgggaacggttaaaccgttaccggtaaaaaaaccgggttaacccgttaggttacccgggtaccttacggggacccttaacgtaaaccgtttccgttacgtttaccccgtttaacgtaaccgtttccccgttccccgggttaaacccc

SEQ ID NO: 219423 - DNA, 748 bp, Homo sapiens
  misc_feature: GYAE6OF01EYJ2N.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagactaccactggagaagtagtcatgacgcagtctccagcccaccctgtctgtgtctccgaggggaancgcccaccctctcctgcgagggccagtgagtatgtgcagactaactagcctggtaccagacaacgaaacctggaccacggcctacccgacggtcctccccttccgtctacgtcgtcctcgtccctacccgacccggtaccgggtccccctggtcccgtaccccgtacgtccccgtagggtttccggttcggggcgggttcggggtcgtaggggactaggtactttcgaccttcctaccacctacgtacccgacggtcccggtacccttaccgacgttaccgtaagaacgttttacgttttagtacccgttaactttttagtttacccttcgttaacctaaacttacgttaacggttcgggttaccgtaaccgttcgggtacccccttcggtttaaccgttacccggttttacggggaacccggtaaccgggtaaaccctaacggtacgggtaaccgtaactaaccggtaaacgtaccggttcgtacgggacctcggacccaccgttgtaccgttcttaccttctaccttccccgtcccgtac

SEQ ID NO: 219424 - DNA, 648 bp, Homo sapiens
  misc_feature: GYAE6OF01AL30F.24.87.H10.1.454.CMB.1.raw
  modified_base (203)..(203): a, c, t, g, unknown or other
  misc_feature (203)..(203): n is a, c, g, or t
  modified_base (406)..(406): a, c, t, g, unknown or other
  misc_feature (406)..(406): n is a, c, g, or t
  modified_base (552)..(552): a, c, t, g, unknown or other
  misc_feature (552)..(552): n is a, c, g, or t
  modified_base (565)..(565): a, c, t, g, unknown or other
  misc_feature (565)..(565): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagagtagtcatgacgcagtctccagccaccctgtctgtgtctccgaggggaaanacgcccaccctctcctgcgagggccagtgagtatgttggcagcaacgttagcctggtaccagcaacgaactggccagctccaggcctccgtcctctactgactcgtcctaccgaccgtacgggtcccctggtccgtccccgacgtcccgtagggttccggttcggggcggttcgggtcgtgggacgtagtactttcgacttcnccaccgtagtccgacgccggtcctcgtcgtcctagtacttgtttcgtacggtttactacgtgtacgacgtcgacggtcccgtttcggcccttaggccccgttagttaaccgggttccgggggaccgggggacgtagggtgaagggnggacgacggtagngggtccgggctcgggacccacgttacgtccgttacgttactttcccgactcccccggtttaccccactcgttccgttaaccgg

SEQ ID NO: 219425 - DNA, 898 bp, Homo sapiens
  misc_feature: GYAE6OF01DKAIL.24.87.H10.1.454.CMB.1.raw
  modified_base (864)..(864): a, c, t, g, unknown or other
  misc_feature (864)..(864): n is a, c, g, or t
tcagactactatgtcacgaccggtgctcgatttagcagtactgcgtttggggtttgggggaggaactgctcagttaggacccagacggaaccatggaacgccccagcgcagcttctcttcctcctgctactctggctccagactaccacgtggaagaagtagtcagtggaaccgctagtcctccgacgccctacccgtggttcctcggtcgttccgaccggaaagggggaaacgaccgccctaaccccttcgttcccgaggccggaacgggcctaagggtaggaagtaacgttgggttacggaccaacggaccttaaacgttacggtacccggtttacgggaacccgacggtaaccggaaacggtaaacccggtcggacccgtaccgggtcccttacccgacggtccctttaccccttcccttacgtacgttcggtccttcgttaccccgaccccgtaaccgggccccgggttccccgttcgggtacccgtaccccgtaaccggtccggtttacggggttttccgggttacggggggtcgggtttaccggggttacggttaacggggaactttacggttacctttacccgaacctttcccgtaaaccgtaacccgtagttcccggaccggcccggttacccttaaccggtacgttacgttaacgggttaagtttacgttttcgtaaccttttactttactttaccgtactaaccgtaaacttcgttaagttaggtacggtacgttcccggtacctttaccgttaacgtttaccgggtttaccgaccgggttaaccggaaccttaacgggtacgaaagtaaccgtaagtaaaccggtccgttagccgtagaccgtccaaccgttnttaccgtcgtttactcctacgttcccaccgtacg

SEQ ID NO: 219426 - DNA, 831 bp, Homo sapiens
  misc_feature: GYAE6OF01DAMOG.24.87.H10.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctcggcctccagactaccacgtggagaagtagtcagtgacgctagtcctccacgccacctgtctgtcgtcacgaagggaacncgccacctcnccgngcgaggcagngagtagtggtcgacagactaacgttcgccgttacggaaccaggaccaacgaaaccgtcggacccacgggtccctacccgacggtcccttcccgtcctacgtacgcgtccttcgtcccacccgaccggtcccggtcccgttaggtccctacccgtaaggtcccggttacgggtttccgggttcggggtaccgggtttcggtacgggttacggggaacttaccgggtttaaccttttcccgaaccgttttaccgaccccgaaacccgtcggttacccggaaccggtccccgggttacccgttaacccggttacggttaccggttaacggttaacggttttacgttttccgttaaccgttttaacctttttaccggtttaccgttaccgttaaccgttaactttaaccgtttacgggttcggttaccgtacggtttcccggtacccgtttacccgttaccgtttaccggttaccgggtaccggtaaccgggtaacgtaacggtacggaacgttaaccgacgtaaaaccggtcgtacggtacgtacgtacgacccgtacgttctcgttcttaccgttacctaccttcccgtcccgtaaccg

SEQ ID NO: 219427 - DNA, 767 bp, Homo sapiens
  misc_feature: GYAE6OF01D2FMW.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagatgttggcagcaacttagcctggtaccagcaagaaacctggccaggcctcccgaggcctccctccctctactcgtcttcgtccttcccgaccgtacggggtccccctgggttccgtccccgacggtcccggttacggggtttccggttcggggtcgggttcggggttccgtacggggacctaggttacttttaccgaccttcccgttacccacctaacgtccgaaccggtcccggtcccgttacccgtaacggttccgttaacggtaagtttacgtttttacggtcctttaactttttacgtttaccttcgttaacctaaccctagtttacgttacgggttacgtaccgttccggtacccttcccgggtttaaccttaccggttttaccgggtaccggtaacccggggtaacctaaaccgggtacggaacggtaactaaccggtaaaaccgtacgttcggtccggacgttccgaccctaacgtaccgttccgttacggtttccttaaccgttaccttccccgttcccgtaaccccg

SEQ ID NO: 219428 - DNA, 886 bp, Homo sapiens
  misc_feature: GYAE6OF01B9WW5.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgagggaaancgcccaccctctcctgcgacgggccagtgaagtaagtggttggacagactaacgttacgccgtaggtaaccagaccgaaacgaaacccgtcggaccgacggccctaccccgacggtccccttacccgtcccttacttaacttccggtccttaccgttcccgtaccccgaacccggtaccgggtcccccgttgggtcccgtaccccgtacggtccggttacggggtttccgggttcgggggtcggggttacgggttcggtacggggtaacgtaacggtttacgtttacccgtaccttacccgtacccgaacccgtaacgtacccgtaccgggcccggttacccgtacccgttaacggtttaccggttaaggttaaaccggttttacgtttttaccgtaaccgtttttaacctttttacggttttacccgtaacgtttaacctaaacccgtttacgtttacgggttagggttaacccggtaaccgtttcccgggttaccccgtttaacccggtttaacccgttttaccgggtttaccgggacccgggtaaaacgggttacccgtaaacggtgggtaaaccgtacgtaaaccgtaaaacggtacgttacggtacgtaccgtacgtaccgtaaccgttaccgtcgttaccgtttaccgtacccttcccgttaccccgttccgtaaccc

SEQ ID NO: 219429 - DNA, 788 bp, Homo sapiens
  misc_feature: GYAE6OF01EBQAQ.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctcgagggaagcgcccaccctctcctgcacggccagtgagagtggtggcagactaacgttacgccgttggaccagacgtaacgaaccgtcggaccacggcctacccgaggtcctccctcctgtactcgtcgttcgtcctacccgaccggtaccggtccccgttggtcccgtccgacggtaccgttaggtttccggtacggggtccggtcgggtcgtagggactacgtacgtttccacgttcctaccgaccgtacgtaccgaccggtcccgtacccgtaccgtaacggttcgtaaggttaacgtttacgttttagtacctttaacttttacgtttaccctagttaccctaaacgttacggttacgttacggttacgtacccgttccgggtaccctttaccggtttaaccgttaacccggttttcgggggaaccccggtaaacgggggttaaaccctaaccgggttacggggtaaactaaacccgtaaaccggtaaaacgggtaacgtttcgggtaccgtaccgtaccggtaccttaaccgtacgttacccgtttcttaacccgttcccttaacccggtttccccgtccccgtaaacgg

SEQ ID NO: 219430 - DNA, 721 bp, Homo sapiens
  misc_feature: GYAE6OF01BY10U.24.87.H10.1.454.CMB.1.raw
  modified_base (204)..(204): a, c, t, g, unknown or other
  misc_feature (204)..(204): n is a, c, g, or t
  modified_base (680)..(680): a, c, t, g, unknown or other
  misc_feature (680)..(680): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaancgccacctctctgcagggccagtgagtatgtggcagctaacgttgcctggtaccagcaacgaaaccgtggaccaggcctccgacggtcctcctcctctatcgtcctgtccctaccgaccgtacgggtcccctagggtccttacccgacgtccccggtaggttttccggtcggggtccggtagggttcggtacggggtaactaacggttacgtttcctaccgttcctacgaacccgtgttacccgacgtcccgggtacctaccgtaagttgtaaccggtaaggtttacttttcggaccttttaacgttttactttacgttacgttaactaaaccgttacgttacgtttggtacgtaccgttccgggtacccttaccggtttaaaccgtccgttttacgggaacccgtaacggggttaaaccctaaacgggtcggtaacgaaaccgttacgaaaaccggtcgttggtacggcgtaacnccgaaccttcacggtttctcgttacacttcccgtcccgtac

SEQ ID NO: 219431 - DNA, 755 bp, Homo sapiens
  misc_feature: GYAE6OF01B5AHU.24.87.H10.1.454.CMB.1.raw
  modified_base (205)..(205): a, c, t, g, unknown or other
  misc_feature (205)..(205): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccactggagaagtagtcatgacgcagtctccagcccacctgtctgtgtctccgaaggggaaancgcccaccctctccgtgcgagggccagtgagatggtggcagctaacttcgcctaggtaccagccgaagtaaccgtggccaggccctacccgaggtccctcctcctntagtcgtctcgtccncccgacgtccgggtccctggtctccccgagtcccgtaggttccggtgggtccggtagggtcgtgggaactaggttactttccgacgttcctaccgacctatccggacggtccgtacccgttccgtacgttacgtaggtaacggttacgtttttacgtacgtttaactttttacgtttacgttaccgttaacctaaacgttaaccgtttaacgtttcgggttaccgtaacggtttcccgggttacccgttacccggtttaacgtttacccggttttacgggacccggtaaccggggtaaaccgtaacggtacggaaacgtaacgttaacgtaaaaccggtacggttcggttacggtacgttaccgacccgtaaccgttacgttaccgttaccgttaccgttaccttacctttccccgttacccgtacccg

SEQ ID NO: 219432 - DNA, 904 bp, Homo sapiens
  misc_feature: GYAE6OF01CIBOQ.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccacctgtctgtgtctccgaggggaaancgcccaccctctcctgcgacgggccagtcgagtaatggttcggcagactaacgttacgcctaggtaaccagaccaacgtaaaccgtcggaccgacggtcctcccgacggtcctaccctcctacgtagtcgtccttccgtccctacccgaccggtaccggggtcccttcgggtacccgtacccgtacggtcccggttacggggtttccgggttcggggacgggtttcggggtacggtacggggactaacggtttactttaccgactaccgtacccaaccgtacgtccggtaaccgggtccccggtacccttaccggtacgttccggtaaggttaaccgtttacgttttaccgttaaccgttttaaccgtttttaacgtttaccgtttacgggttaaacccttaaaccggtttaaccgtttaggttaccgggtttaaccgttaccggttaccgggttaaccccgttttaccggtttaaccggtttaacccggggtttttacccggggaaacccgggtaaacccgggggttaaaacccttaaaccggggttacgggtaaacttaacccgggtaaaccgtaaaaccggggttaccgtacggggttaccggttaccgttaccgggtaaccccttaaccgttaactttccggtttaaccgtttcctttaacccgtacccggttttcccccgtaccccgttaaacccgg

SEQ ID NO: 219433 - DNA, 695 bp, Homo sapiens
  misc_feature: GYAE6OF01C7DXW.24.87.H10.1.454.CMB.1.raw
  modified_base (175)..(175): a, c, t, g, unknown or other
  misc_feature (175)..(175): n is a, c, g, or t
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (487)..(487): a, c, t, g, unknown or other
  misc_feature (487)..(487): n is a, c, g, or t
tcagactactatgtcacgaccggtgctcgatttagcagtactgcggttgggtttggggagaactgctcagttaggaccagacggaccatggaacgcccagcgcagcttctcttcctcctgcttacgtctggcctccagactacccgatggagtaagtgtcagtcgacgcagtccnccagccacctgtactgtcgtcnccgaagggaacnccacctacctctaccgnggcgaggtccagtgaagtattggtacgacagccttaacgttcgaccgtacggtacagtaccgaacgtaaccgtcggaccgacgccctaccgtacggtccttcccgttaccggtacttgtccggtcttcgaacccttccggaaccggtccgggtcctcgggttccgaccgacgttccggtcgggtttcgttcgggccggttgggtaccgtagggactacggttcttccgacttacgtacaccgtagccgacgccgtactcgntacgtagtacgttgtttcgtacttacgtcgtagtctacgccgtacgtccgtccggtacgtcggtaccgtacggtttaccgggtcggggccggggtaacgtgggacggaggacggcgtaacggtacgcggtacggtacgttccgaaccgtcgttacgtcgttcgtacccgttacgtacctttcccggaccttccgtaacgtcgtaaacg

SEQ ID NO: 219434 - DNA, 741 bp, Homo sapiens
  misc_feature: GYAE6OF01D2QG6.24.87.H10.1.454.CMB.1.raw
  modified_base (215)..(215): a, c, t, g, unknown or other
  misc_feature (215)..(215): n is a, c, g, or t
  modified_base (309)..(309): a, c, t, g, unknown or other
  misc_feature (309)..(309): n is a, c, g, or t
  modified_base (328)..(328): a, c, t, g, unknown or other
  misc_feature (328)..(328): n is a, c, g, or t
tcagactactatgtcacgaccggtgctcgatttagcagtactgcgttgggttggggaggaactgctcagttaggacccagacggaaccatggaagcccagcgcagcttctcttcctcctgctactctggctccagataccagtaggaagtaagtagtcagtcgacgctagtcctccacgcccacccgtgtctggtcgtccgtacggaagggaacncgaccctaccctcgtcctgaccgcggaccagtcgaagtagtgtcgcgagactaacgttacgcgtacgtaccagacgaacgacgcgacgacgccnccgagtcctccgtctcgtncgtctcgtaccgccgacgtccggaccgttgtcctaccgcgtcggtacggtcggtggcggttcggtcgtacggatacgtacgttccaccttcgacctacgtcgaccgtccggacctccgttaccgtacgtcgttaagttacttacgtttcgtactttacgttttacgttacgtacttaactaacgttagttagttcggtaccgttacgttcccgtacgtttaacccggttaaccgttaccggttaccgggtaacccgggtaaaccggttaacgtaacgggtacgtaacggttaaaccgtaacccgtaaaaccggttggtaaccggtacgttacccgacgtaaacccgtacccggtttaattcccggtttacgtttacccgttacccgttaccgttccccgtacccgttaaccgg

SEQ ID NO: 219435 - DNA, 909 bp, Homo sapiens
  misc_feature: GYAE6OF01CX5BJ.24.87.H10.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccatggagaagtagtcatgacgcacgtctccagcccaccgtgtctgtcgtctaccgaagggaancgccaccctctcngcgacgggcctaggtgacgtaattggtacggacagaccgtaacgttacgccgttacggtaaccagaaccgtaaacggaaaacccggttcgggaacccgtaaccgggtccccgtaccccgaggttccccttaccccttacccgttacgttaacgtccgtacccgtttccgtaccccgtacccgtacccgggtaccggggttcccccgttacgggttccccgtaacccccgtacggttacccgggttacgggggtttttccgggttcgggggttacccggggtttggggttacccgggttaacgggggaactttaacgggtttaccgttttacccgaccggttttaacccacccgttaaacccgtaccgttaccgggtacccgggtcccccggttacccgttaccggttacggtttacccgttaagtttaaacggtttctttttaccggtacctttttaacggttttctttacgttacgttaaccgttaacgtacgtttaggttcggtacgttacggtcccggttaccgtttacccgttaaccgtttacgggtttccggaccggtaacgggtaacctaacgggtacgaacgtaacgtaacgtaaaccggttagacggttccgacgttaccgtaccgtaaccgtccgttagttacccgtttactaccgttcccgttcccgtttaccccgtacg

SEQ ID NO: 219436 - DNA, 710 bp, Homo sapiens
  misc_feature: GYAE6OF01D3X14.24.87.H10.1.454.CMB.1.raw
  modified_base (431)..(431): a, c, t, g, unknown or other
  misc_feature (431)..(431): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccacgtggagaagtagtcatgacgcagtctccacgcccacctgtctgtgtctaccggaaggggaagacgccctaccctctccgtgcgacggccagtgaagagtggtagcagactaacgtacgcgttacggaccgagacgaacgtaaccgtggtcgacggtcctaccgacggtcctcccttctctagtcgtctcgtcctaccgaccggccggtacccgtcggtccgacccgacggtccggtacgggttcggtcgggcgggttcgggtacggtacggacgtagtcttaccncgtcctacgaccgtagacgaccgtccgtaccctacgtacgttacgtaggtaacgttacgtttacgtactttaacgtttcttacgtacgttaactaactacgttagtcggtagtaccgtcgtaccgttaccgtacgttacgtttacggaaccggtaacggtaactaacggtacggtaacgtaacgtaacgtaaccgtacggttacggtaccggtataccgaaccgttacgtacgttccgttaccgttaccgttaccttacccttcccgttacccgtaccg

SEQ ID NO: 219437 - DNA, 869 bp, Homo sapiens
  misc_feature: GYAE6OF01B85MR.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgtttgggtttgggggaggaactgctcagttaggacccagacggaaccatggaagccccagcgcagcttctcttcctcctgctactctggctccagataccactggagaagtagtcatgacgcagtctcagccaccctgtctgtgtctaccgaaggggaaancgccaccctcgtcctggaccgacgggcctaggtgaagtaaagttggttgggactaacgactaaacgtttacgccgttacgggaacccagaccaaacggtaaaaccctgggaaccccgtagggaccctccccgaagggtccctacctacccgttatactccgggtactcggttccctaacccgacccgacggggtcccctagggtcccgttcccaacggtccttaacggggttcggttacgggtcgggttacggggtacgtacggggtaactagggtttaacttacggtaacttaccctacgtaaccgtattcgaacggtccggtacctaccgtaggtacttacgtaaacggtttcttttacggacctttaaacgttttacgtttaccgttagttaaccgtaaacgttaaacccgtttaagtccgggttaacgtaacccggtttacggtacccctttacccgttttaacccggtttacgtttttaacccggggggacccggaaaccggggtaaacccgtttaaaacgacgggtaaacggttaaactaaccgggaaaaaccggtttaaaaccgtcggggtttaacgtaccgtaaccgttccccgaaaacgttcccgttagttacccggtttattaacccccgagttttcccccgtaccccgtaaac

SEQ ID NO: 219438 - DNA, 776 bp, Homo sapiens
  misc_feature: GYAE6OF01BWWNV.24.87.H10.1.454.CMB.1.raw
tcagactactatgtcacgaccggtgctcgatttagcagtactgcgtttgggtttgggggaggaactgctcagttaggacccagacggaaccatggaagccccagcgcagcttctcttcctcctgctactctggcctcccagagaccgccggagaaggtgtgttgtcgcacgtcccaggcaccctgttcgttgtctccgagggacacacgccatcctctccgtgcgacggccagtccacgcccttctccgtaccctaaccccgttagtcctacggttaccaaacgaaaacgccgtacggcccacggccctaccaccgtactccgtcacgtctactgaactactacgtaacccgaaaacgggtcccgacgtcgggcccgttacccgaacggcccgtaggttcccgtacgtcggtaccggtaggtcgggggtcgtacgggactacggtacctttaccgaccgttcctacccgaccgttaccgacggtaccgtaaccgtaccgtaacggacgtacccgttagggtaacgttttacggttttcgttaaccgggtttacccttaacgttcggtaccgtacggaccgttaccggtacccgtttccggaccgttcccgggtacccggttacccgtttaaaccggggttccgggggaaccggggtaaccggtacggggtagggtaacggaggtaccggaacggtacgtcgggtacgtccgtacgacctacgtcgttcgttactccttcgtacctcccggttacccacttacgtctgtaacctaag

SEQ ID NO: 219439 - DNA, 798 bp, Homo sapiens
  misc_feature: GYAE6OF01ELC0H.24.87.H10.1.454.CMB.1.raw
  modified_base (221)..(221): a, c, t, g, unknown or other
  misc_feature (221)..(221): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagactaccacgtggagaagtagtcatgacgcagtcctccacgccaccctgtctgtgtctccgaagggaagcgcccacctctccngcgacggccagtgagagtgtggcagactaacgttacgccgtacggtaaccacgaccgaaacgaaaacccgtcggacccgacggtcccttaccccggacggtcccctcccctttcccgttacgtacgttcgtccgtttaccgttccccgttaccccgacccggtacccggggtcccccgtttagggtccccgtacccgaccggtcccggttacgggttttccggtcgggggtcgggttcgggttcggtacggggacgtacggtttaccgtttacgtaccgttactacccgacctacgtacgaccggcccgtcccgtaccgtacggttacgttaaggtacgtttacgtttctacgtttacctttttacgttcgttacggttaacctaaaccgttacgttacgttcggtacgttacccggtccgtacccgttaccggttaacgtttaccgttacgggtacccggtaacgggtaaccctaacggacggtaacgtacgtaaaccgtaacgtaacgtcggtacgtacgttcgaccgtaccgtagtccgtttacgttcttacctaccttcccgtcccgtaaccg

SEQ ID NO: 219440 - DNA, 833 bp, Homo sapiens
  misc_feature: GYAE6OF01CS3H1.24.87.H10.1.454.CMB.1.raw
  modified_base (214)..(214): a, c, t, g, unknown or other
  misc_feature (214)..(214): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggcctccaagtactaccactaggagaagtagccatcgacgcagttcctccacgcccacctgtctgtcgtcgtcgaagggaacncgcccaccctctcgtgacacgggcctaggtgacggtaagtcggttacggactacgacctaacgttacgccgttacggacctaacggacgaacggtaaccgtcggacccgtacggtccctacccgtaacggtcccttccgtactacgtaccgtagtacgttacgttaccgtaccgtaaccgaacggtaccgggtacctaaccgggtccgggtaccccgtccccggtaaccgttacgggtacccgtgggtaccggacggtttaacgggggtccggttaaccggtaacgggtaaaccgttcggtaacccgtttaccaaccgttcccgtaaccgtacccgtacggtcgaccgaccggtaccgtaagaccggttaaccgttaagtaacggttttacgtttacggggtacctttaacggacgtttccgaaccggtattcccgggtacttcccggtaccggtcccggttcggaccccggtttaacgggttacccggggttccggggaccggggtaccgttaggggacggtaacgggacggtacgaacggttacggacgggttcgtacgccgggtaactaccgtggtttctaccgttaccttaccgttcctcccggtaccgttaccg

SEQ ID NO: 219441 - DNA, 793 bp, Homo sapiens
  misc_feature: GYAE6OF01B0TLE.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagactaccacgtggagaacgtagtcatgacgcagtctccagcccacctgtctgtgtctcgaagggaancgccacctctccgtgcgaggccagtgaagtatggttcggacagactaacgttcgccgtacggtaaccagtacgaaacgtaaaccgtcggaccgaacggtccctacccgacggtcccttccgtccctacgtacgtcgtacgttcgtaccctacccgaccggtaccggggtcccttgggtcccgtacccgacggtccggttacgggtttcggtacggggtcggttacggggtcgtacggggtactacggtttactttaccgtacttccctacgtaccgtacgtccgaaccggtccggtccctacgtcgttaccgtaaggttaacgtttacgtttacgttaaccgtttaacgtttttacgttcgttaacttaaccgttaaactacgtttacggtacggttaccgtaccggttacccggttccccttacgggtttaaccgttaccgggtttcccggaaccggtaaaccgggtaaccctaaggtacggtaacgtaactaaccggaaacggttacggtcggtacgtaccgtacgaaccgtcgttaccgtacgttcgttaccgtttacctacccggttacccttcccgtaaccg

SEQ ID NO: 219442 - DNA, 755 bp, Homo sapiens
  misc_feature: GYAE6OF01ALE98.24.87.H10.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (322)..(322): a, c, t, g, unknown or other
  misc_feature (322)..(322): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtcctccagccaccctgtctgtgtctccgagggaancgccaccctctcctgcagggccagtgagagtggttgcagcaacttgccgtggtaccngacaacgaaccgtggccaggccctaccgacggtccttcctcccgtctagtcgtctcgttccnccaccgaccgggccctggtccgtcccgagtccgtacgggttcggttcggggcgggttagggtcgtagggacgtagttctttaccgacttcctaccactacgtccgacggcccgtccttccgagttaccgtaggttaacggtttcttttacggtactttaactttttacgttttaccgtacgtaactaaccttacgttaggttccggtttacggtaccgttccgggttaccctttccgggtttaacccttaccgggttttcggggaaaccccggtaacgggggtaaccctaaacgggttacggaaaccggttaacgtaaccggtaaaccggtaaccgttggggtaccggtacccggttaaccggccttaacccgttacgttccgtttaccggttactttacccgtaccccggtttcccgttcccccgttaaccg

SEQ ID NO: 219443 - DNA, 693 bp, Homo sapiens
  misc_feature: GYAE6OF01CJ5FF.24.87.H10.1.454.CMB.1.raw
  modified_base (206)..(206): a, c, t, g, unknown or other
  misc_feature (206)..(206): n is a, c, g, or t
  modified_base (331)..(331): a, c, t, g, unknown or other
  misc_feature (331)..(331): n is a, c, g, or t
  modified_base (357)..(357): a, c, t, g, unknown or other
  misc_feature (357)..(357): n is a, c, g, or t
tcagactactatgtcacgaccggtgctcgatttagcagtactgcgttggggtttgggggaggaactgctcagttaggacccagacggaaccatggaagccccagcgcagcttcttttcctcctgctactctggctcccagataccactggagaagtagtcatgacgcagtctccagcccaccctgtctgtgtctccgaggggaaanacgcccaccctctcctgcgacgggccagtgagtatgttggcagactaacttcgcctaggtaccagacaacggaaaccgtggaccgacggcctacccgaggtcctcctcctctagtcgctcgtccncccgaccgaccgggtccctaggtccncccgaggtccgtagggttccgtgggccgggttggtcgtagggtaactagttactttcacctctaccaccgtatcgaccgccggtcctactacgttacgtagtaagttacgttttacgacctttaacgttttactttccgtacttacctaactacgttagttcggtacgttcgtaccggtcccttaccgttaccttacggtttcggaacccgggtacggtaaccgtaagtacgggactaacgtaacgaaacggtaactggtacggtaccgtacgaccgtaaccgtacgttccgttacgttccttacttacctttaccccgttccccgtccgttaacg

SEQ ID NO: 219444 - DNA, 690 bp, Homo sapiens
  misc_feature: GYAE6OF01E4MFU.24.87.H10.1.454.CMB.1.raw
  modified_base (209)..(209): a, c, t, g, unknown or other
  misc_feature (209)..(209): n is a, c, g, or t
  modified_base (315)..(315): a, c, t, g, unknown or other
  misc_feature (315)..(315): n is a, c, g, or t
  modified_base (445)..(445): a, c, t, g, unknown or other
  misc_feature (445)..(445): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccacgtggagaagtagtcatggacgcagtctccagccctacctgtctgtgtacctcgaaggggaacncgcccacctctcctgcagggcaggtgagatgtggcagactaacgttcgcctaggaccagactaacgaaccgtcggaccacggccctaccgacggtcctcccttctntacgtcgtcctacgtccctacccgacggtcccggtcccgttagggtccctaccgacggtccggtacgggttttcgggtcgggcgggttcggtacgacggtaactgttaccttcaccttctacctaaccgngtccggacggtcccgtacctcgtacggttacgtaagttacgttttacgtttcgtacttttaacgtttgttaccaacgttacaacgttcgttaacggtcggtactaccggtccggtaacttccgttaacgttacggtacgggaaaccggacggtaacccgtaaggtcgtaacgtacgtaacgaaacgtcggtgtacgtcactaccgtctacgttccgtacgtttcctaagtccgttcccgcggtac

SEQ ID NO: 219445 - DNA, 857 bp, Homo sapiens
  misc_feature: GYAE6OF01DDZ5N.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaagggaancgcccaccctctccgtgacgacgggccagtgagtaagtggttggactagactaacgttcgaccgttacggtaccaagaccgaaacggtaaacccgtcgggacccgtacggtaccctaccccgacggtccccttaccccttccttaccgtagtcgtccttccggtccctacccgacccggtaccgggtccccgttggtacccgtacccgtacggaccccgttcggggtttccggttcgggggaccgggtttcggggtacggttacggggaaccgttacggtttacttttaccgaacccgtttcctacccgtaacccgtacgttacccgtaaccgggtccccggttaccccgtacccgtacggttaccgttaacggtttaacggtttacggtttttaccgttaccttttaacgttttttaacgtttccgtttaaccgttaacctaaaccggttacttacggtttcgggttacgtacccgttccggtaccccgtttaccggttaccgtttaccggttttccgggaaccggtaacgggtaaccttaacggtaggtaacgtaacctaaccggaaaaccgttacggtacggtacgtacgtaccgtacctacgttacgttaccgttccgttaccttactacctttccccgtacccgttaccg

SEQ ID NO: 219446 - DNA, 828 bp, Homo sapiens
  misc_feature: GYAE6OF01C6ICB.24.87.H10.1.454.CMB.1.raw
  modified_base (218)..(218): a, c, t, g, unknown or other
  misc_feature (218)..(218): n is a, c, g, or t
  modified_base (359)..(359): a, c, t, g, unknown or other
  misc_feature (359)..(359): n is a, c, g, or t
tcagactactatgtcacgaccggtgctcgatttagcagtactgcggttggggtttgggggaggaactgctcagttaggacccagacggaaccatggaacgccccagcgcagcttctccttcctcctgctactctcggcctccagactaccacgtggagaagtagtcagtcgacgcacgtcctccacgccaccgtgtctgtcgtcgacggaagggaacncgcctacctctccgtggacgacgggaccaggtacgaagtaggttcggtcgacacgtacgttaacgtccgtcgtacggtaaccaaggacgaaaccgaaccgtcggccgacggtacccgccgaccggtcctaccttccgtacngtctccggtactacccgccgtaaccggcccggtccgttcgaccgaccgtacggtcggttacggtttcggggtcggggccgggtttcggtacgggtacggacgttacgttactttccgacgttaccgtaccctaacgacggtccgtccgggtccctccgttaaccggtcgttacgggtaacgttaacggttttcttccgtttaaccttttaacgttttaccggtttcttaacccgttaaacctaacgttaaccgttggttaaccggttcggtaccgtttacccgtacccgtttaacggttaaccggttcgggttaccgggtaaaccgggaaccggttaaaccgtaacggtacgggtaaacacccgggttaaacggtaaacccgtaggttcgggtaacgtctacccggtcttaaccgttacgttcggttaccctttacgggtaccccttaccgtttcccgccggttaaacc

SEQ ID NO: 219447 - DNA, 801 bp, Homo sapiens
  misc_feature: GYAE6OF01BAHLF.24.87.H10.1.454.CMB.1.raw
  modified_base (218)..(218): a, c, t, g, unknown or other
  misc_feature (218)..(218): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggcctcccagactaccacgtagggagaagtagtcatgacgcagtcctccacgcccaccttgtctggtcgtacgtccggaaggggaanccgcccaccctcgtcctgcgacgggacaggtgaagtagtcgtggcagctaacgtacgtccgtacggtaccacgacgtaacgaaccgtcggaccgacggtcccgtacccgaccggtccctcccgttacctcgtacgtcgtccttccggtccctacccggacccggtacccgggtcccgttcgggtcccgtacccgtaccggtaccgggtttccgggttaccgggttcgggggtccgggttacgggggtcgttaacggggtactacggtttctttacctaccctcgtacccgactaccgtcgaccgggtcccgtacccttaggtacgttacggtagtatttacgttcgtaagtttactttaccgtacgtccgtaccgacgacgtacggtcctaaggttacgtcggaccggtcccggtacctacgttacccggggttcgggttaaccgggggacccgggaacggggtaaccggttacgggacgggttaaaccgaacgtaaaacccggttaaacggggtacgggtgttccggaacgttcccaacgttaacctttacgtcgtttcgtacccgtttccaccgttccccg

SEQ ID NO: 219448 - DNA, 804 bp, Homo sapiens
  misc_feature: GYAE6OF01BHKC7.24.87.H10.1.454.CMB.1.raw
  modified_base (589)..(589): a, c, t, g, unknown or other
  misc_feature (589)..(589): n is a, c, g, or t
  modified_base (635)..(635): a, c, t, g, unknown or other
  misc_feature (635)..(635): n is a, c, g, or t
  modified_base (639)..(639): a, c, t, g, unknown or other
  misc_feature (639)..(639): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagcccaccctgtctgtgtctccgaaggggaaacacgccaccctctccgtgccgagggccaggtgagtaagttggttggcaacgactaacgtcgccggtacgaaccgacgtacgaaccgtaaccgcggaccgtacggtacccgtaccggtacggtccctacctacgtacgtttaccgtaaggtttacgtaaccttaaccgtaccgaacgggaccgggtaaccggggtacccgtacgggttccgggtacccgtaccccggtaacggtacccgggtttaagggtccggtttacgggcgggtaccgggttaagggggttccggggttaaccgggtacgggtaacggttaaccggtttacgttaccccgtacttacccggtaacccaaccgtaacggttccgacgtacgttccgttaacncggtacgtacgtacggtagttactttgttacgtaatttagtttacnccgngacgatacgcgtacctaggtcgtaccgtcgggtcgtccccttcggtacgtttccgggggtaccgggaacggggtaaccgtaaccggggtggttaaacgaccgttaaaccgaacgggttaaaccttgggggtaccacggttaccacgggtaaccctagtttccggg

SEQ ID NO: 219449 - DNA, 836 bp, Homo sapiens
  misc_feature: GYAE6OF01AZAWE.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccaggtgagaatgttggcagcaacttgcctggtaccagcacgaaacctggccaggcctcccgaggccttcctccctctatcgctcgtcccgtcctacccgacgggtccccctagggttccgtacccccgaggccccgtacggggttttcccggtttcgggggccggggtttcggggggtccgtttcggggggaaccgttaacggggttacctttttaccgaacccggtttccgtcccttaaaccccgttaacgttcccgaaacgggtcccccggggtcccgtttaccccctaagggtttcccgttaaggtaaacgtttacgtttttaccgtaccggtttaactttttaacgttttttaccgtacggtttaccctaaaccgtactttaacggttcgggtttacggtaaccttccggggtaccccttttccccggtaaccctttaccggtttttaccggggaacccggttaaccgggggaaacccgttaaaccgtacgggtaaacgtacgttaaccgaaaacccggttaacgttacggtgggtaaccctttggaccacccgttacttaccggtcggtttaccttacccgttaacttccccgtttaccccgtaccc

SEQ ID NO: 219450 - DNA, 527 bp, Homo sapiens
  misc_feature: GYAE6OF01D00AQ.24.87.H10.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (514)..(514): a, c, t, g, unknown or other
  misc_feature (514)..(514): n is a, c, g, or t
tcagactactatgtcacgaccggtgctcgatttagcagtactgcgttgggttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaaangccaccctntcctgcagggccagtnagaatgttggcagcaattagcctggtaccagcaagaaacctggccaggctccaggctccctctctatgctgtctccaccgagggcccctggtcgtcccagccgtaggttcgtggcggtgggtctggggacngatttcactcncaccatcagcggcctccagtctgaagatttgctactttatttctgtacaacactatggtgactgtcctacgtactacgttttggccaaggggtaccaaagtggaatactacgaaacgtaactgtggctcgcacatctgtacttntactctccgtacc

SEQ ID NO: 219451 - DNA, 760 bp, Homo sapiens
  misc_feature: GYAE6OF01ATEFG.24.87.H10.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagactaccactggagaagtagtcatgacgcagtctccagccaccctgtctgtcgtcncgaagggaancgccacctctccgtgcgacggccagtgagtagtggttcggacacgctaacgttagccgtaggtaccagacgaacgaaaccgtcggccacggccctaccggacggtccctcccgttacctacgttacgtcgtccgttcgtacccgtacccgaaccggtaccgggtcccccgtgggtccccgtacccgtacggtacccggttaggggtttccgggtttacggggcgggtttcggggtaccgtacgggggtaaccttaggtttaaccgtttcctaccgttccgtaccaacctacgtaccgaccggtccgtcctccgtacgttcgttaacgtacgtttacgttttcgacgttttactttacgtttcttacgtaacctaacgtagttacggttcggtacgttacgttccggttaccttaccgtttacgttaccgggttcggtaaccggtaaccggaaccgtaacgtaggaaaccgtaacgtaacgtaaacggtaccgtgggttaccgacttacgctaaccgtcgtttcgttaccgttcttaccgtacctttccgtccgtac

SEQ ID NO: 219452 - DNA, 742 bp, Homo sapiens
  misc_feature: GYAE6OF01CQ1SV.24.87.H10.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
tcagactactatgtcacgaccggtgctcgatttagcagtactgcgttgggtttggggaggaactgctcagttaggacccagacggaaccatggaagccccagcgcagcttctcttcctcctgctactctggcctccagactaccactggagaagtagtcagtgacgcagtcctccagcccaccctgtctgtcgtcctaccgaagggaaacnccgcccacccttcgtccgnggcagggccaggtagagaagttggtgcagactaacgttgccgtacggtacagcaacgaaaccgtggccaggtcctacccgacggttccctccttccctacttacgtctccgttcgtacccctcccgaaccggtccggccccgttggtccgtcccaacggcccgttagggttccggttcgggccgggttggtaccgttcggggactcggtaacttccgactctaccgacttcgcgacgtccgtaccctcgtaacgtcgtagtaacgttgtttcgacctttaagtttttactcgtactaaccttaacgtaacgttcgggttacgttagtacccgttaccggttacccttacccggttaacgttttaccggttaccgggaacccggtaaccggggtaaaccctaacggttcggggaaaacttacgtaaaaccggaaaccgttagttacgggaccgtactacggccctaaacgctttaccgtcgttaccctagtaacccccttgtaccccgtaacg

SEQ ID NO: 219453 - DNA, 767 bp, Homo sapiens
  misc_feature: GYAE6OF01ELZBG.24.87.H10.1.454.CMB.1.raw
  modified_base (210)..(210): a, c, t, g, unknown or other
  misc_feature (210)..(210): n is a, c, g, or t
  modified_base (274)..(274): a, c, t, g, unknown or other
  misc_feature (274)..(274): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactcgtcggcctcccagactaccacgtggagaagtagtcaatgacgcagtctccagccacctgtctgtcgtctccgaggggaacncgccctaccctctccgtgcgacggccagtgaagagtgtggcagcaacgttagccttaggtaccngacctaagaaaccgtggccaaggcctacccgacggtccttacccttccgtactacgtcgtaccgttgtaccctacccgaaccgtccggggccccttgggtaccgtaccccaacggtccccggtaagggttttccggtcgggtcggtcggggtccgttaggggaacctgggttacctttcgaacctcgtacctacccgattccgacggtcccggtccttaccgtacgtcgtagtaacgttacgtttcgtaccgttacttttaacgtttccgttacgttacctaactaccgttacgtcggtacgttaccgtccggtacccttaccgttaccgttaccgtttaccgggaccggtaaccggggtaacctaaacggtaggtaacgtaactaaaccggtaaacggtaacgttcggtccggttaccgtcggacccgtaacccgtacgttaccgttccgttaccctttaccgttacccgttacccgttccccggttaaccc

SEQ ID NO: 219454 - DNA, 674 bp, Homo sapiens
  misc_feature: GYAE6OF01BR5BL.24.87.H10.1.454.CMB.1.raw
  modified_base (241)..(241): a, c, t, g, unknown or other
  misc_feature (241)..(241): n is a, c, g, or t
  modified_base (629)..(629): a, c, t, g, unknown or other
  misc_feature (629)..(629): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagcgcccacccgtctcctgcagggccagtgagatgtgcngcactgctggacagcagaaccgtgccgagcctccgagcctccgtcctctgtctctcgtcctccgaccgcgggtcccctggtccgcccgagtcccgtagggttccgtggggcggttggtcgtgggactagttacgttccactctccgaactcgtcgtacggcccgtcctccgtacgtttccgaagttacgttcgttttcgacctttacgttttacttttcgtaccgttaaccgttaactacgtttacggtacggttaccgtaccggttcgtacccgtttacccgtcgtttacccggttacgggtacccggtaacgggtaaccctaaggtaggtaactacgtaacggaaaaccttcggttaggtaccggtcgtacgtaccttaacccgtnttaaccggttcttaaccgttccctacgttccccgttcccggtacc

SEQ ID NO: 219455 - DNA, 758 bp, Homo sapiens
  misc_feature: GYAE6OF01AQR32.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaaagagccacctctcctgcagggccagtgagatgtgcagcaacttagctagtaccagcaacgaacctggaccacggcctccccgacggtccctcccttcccgtacttagtcgtctcgtacctcccacccgacgggtcccccgttggtcgtccccacgccgtaggttccggttgggccggttggtccgtcggggacttagtactttccacgttctaccctaccgacgtcgacgtccggtccctaccgtagtcgtagtaagttcgttttacgtaccttaacgttttactttacgttacgtacccttaaacgtacttaacggttacggttaccgtaacgttccgggttaccccgtttaccccgtttaacccgtttaccggtttttacccggggaacccggttaaacccgggggaaacccttaaacgggttacggtaacgtaaccgttaaccgaaaaaccgggtccgtttacgggtaccgttccgtacggacccttaaccggtaacgtttccgttacccggtttcccttaccgttacccgtttccccgttcccccgtaacccg

SEQ ID NO: 219456 - DNA, 644 bp, Homo sapiens
  misc_feature: GYAE6OF01CFCPB.24.87.H10.1.454.CMB.1.raw
  modified_base (207)..(207): a, c, t, g, unknown or other
  misc_feature (207)..(207): n is a, c, g, or t
  modified_base (590)..(590): a, c, t, g, unknown or other
  misc_feature (590)..(590): n is a, c, g, or t
  modified_base (609)..(609): a, c, t, g, unknown or other
  misc_feature (609)..(609): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagcccaccctgtctgtgtctccgaaggggaaancgcccaccctctcctgcgagggccagtgagtaatggttggcagacagttgcctggtacagcaagaaacctggaccaggcctcccgaggcctcctcctctatcgctcgtcctcccgaaccgaccgggtcccctggttccgccccgaggccgtacggtttcggttcggggtcggttggggtcgtggggaactagtactttcaccttctacgacctatccgacggtcccggtaccctaccgtacgttactaggtaacgtttagttttacggtactttaactttttacgtttcctacgtactaactacgttagtcggtactcgtcggtacccttcgtacttcggtttacgacggaacgggtacctaacgtggatactacgaaacgtntcggtgctacgcaaccgtnttccgtacttcttacgtaccttcccgtcctaaccg

SEQ ID NO: 219457 - DNA, 751 bp, Homo sapiens
  misc_feature: GYAE6OF01B9QDH.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaagacgcccaccctctcctgcgagggccagtgagaatgttggcagacaactagcctggtaccagcaacgaaacctggccaggcctccgaggcctccctcctctacgtcgtcctcgtccctacccgacccgaccgggccccgttggtccgtaccccgcggaccgttacggggtttccggttcggggtcgggttacggggtccggttacgggaacgtacggttactttccgaccgttacgccctaaaccgtagtccgtaacggtcccggtcccgtaccgtacgttccgtagtaagtttacttttcgactttaccttttagttccgttagtacctaaacgttaccgttagtcggttactaccggttcggtaccccgtttaaccgttacgtttaccggtttccggggaaccggtaacgggtaacccgtaaacggtggaaaccgtacgttaaacccgaaacggtaaccgttagggttccggtaccgtacggtaccctaacggttccttacggttacgtttcccttacctaccgttttccccgttccccgttaaccc

SEQ ID NO: 219458 - DNA, 728 bp, Homo sapiens
  misc_feature: GYAE6OF01E5JH2.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtcctaccgaaggggaaacgcgcccaccctctcctgcgagggccagtgagtaagttggttaggcagacctaaacgttcgccgtaggtacccagacaacggaacctggcccaggcctccgacggtcctccctcctctagtcgtctacgtcccgtacccgaccggtacccgggtccccgtggtccgtaccccgacggtccgtacggggttttccgggtccgggtcgggttcggggttcgtacgggggtacctaggtttacctttccgacctcgtaccacctaacgtcggaccggtcccggtcccgtccgtaggttaccgtagttaacgtttctttcgtactttaacgtttctttcgtaccgtactaacgttcttagtcggtcgtaccggtccgtacccttaccgttaccgttacgtttaccggggaccggtaacgggtaacctaaggtacggaacgtacgtaaccgaaacgtacgtcgggtccgactacggccttactcgttccgttacgttccttacccgtaccttccctacccgtaccg

SEQ ID NO: 219459 - DNA, 255 bp, Homo sapiens
  misc_feature: GYAE6OF01DUIT2.24.87.H10.1.454.CMB.1.raw
  modified_base (254)..(255): a, c, t, g, unknown or other
  misc_feature (254)..(255): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatctcccgcatctgaacatagtagtctgagcgggctggcaaggcgcatagnn

SEQ ID NO: 219460 - DNA, 639 bp, Homo sapiens
  misc_feature: GYAE6OF01DS6VO.24.87.H10.1.454.CMB.1.raw
  modified_base (209)..(209): a, c, t, g, unknown or other
  misc_feature (209)..(209): n is a, c, g, or t
tcagactactatgtcacgaccggtgctcgatttagcagtactgcgttgggtttgggggggaggaactgctcagttaggacccagacggaaccatggaagccccagcgcagcttctcttcctcctgcttacgtctggctcccagataccactggagaagtagtcatgacgcacgtctccagcccaccctgtcctgtgtctccgagggaanagccaccctctcctgcagggccagtgagaatgtggcagcaattgcctggtaccagcagaaacctggaccaggcctcccaggcctcctcctctatcgctgtcctcccaccgacgggtcccctggtcgtcccaggccgtaggttcggttggcgggttgggtcgtggggacagtattcactctcaccatcacgccggtcctccgtacgtccgtagaagttattttcgcttaacttttacttcttgtactaactacgttagttcggtgtacgtcgtaccctccggttaaccttaccggttttccgggacccggttaaggggaccccttaaacggtggaacgtaccgttaacgaaaaccgtacgttacggtcgtaccgttacgcctacccgaatttccgtacgttccttacctacttccccttaccccgtacccg

SEQ ID NO: 219461 - DNA, 728 bp, Homo sapiens
  misc_feature: GYAE6OF01BEQP4.24.87.H10.1.454.CMB.1.raw
  modified_base (203)..(203): a, c, t, g, unknown or other
  misc_feature (203)..(203): n is a, c, g, or t
  modified_base (448)..(448): a, c, t, g, unknown or other
  misc_feature (448)..(448): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccacctgtctgtgtctcgagggaaagngcccaccctctcctgcgagggccagtgagatgttggcagctaactgcctaggtaccagacaacgaaaccgtcggaccacggcctacccgacggtcctccgttcctctacgtcggtccttcgtcctcccgaccggccgggtccccttcgggtaccgtccccgacggtccgttacgggttccggttggggtccgggttggggtccgtaggggactacggttacgtttacaccttcgtaccaaccgtntaccgacggtcccggtcctaccgtacgttacgtaggtaacgtttcgttttacgtactttaccgttttactttcgttacgtacctaacgttaccgttaggttcggttacgttcgtaccgggtaccctttacccggttaacgtttaccggtttcggggaacccgggtaacgggtaaccaaacggttgggaaacttaactaaccggtaaaacggtccggttaggccggtactcggacccttacgtacttcgttcgttccttacgtcccttccgttcccgtacc

SEQ ID NO: 219462 - DNA, 762 bp, Homo sapiens
  misc_feature: GYAE6OF01ARJGZ.24.87.H10.1.454.CMB.1.raw
  modified_base (328)..(328): a, c, t, g, unknown or other
  misc_feature (328)..(328): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtcctccgaggggaagcgcccaccctctccgtgcagggccaggccggtagtgttaagtaagtacttaggctaggtaaccaacgacgaaacctggccaggccgtcccgggctcctcatctatgactcgtcctaccgaacgnggtcacgtcggcccgtccccgcgtaggttcaggtggccgtaggtcgggtcgtacggggacctacggtacctttaccgaccgttccgttacccgacccgttaccgacggacctaacggtacccgttagggaaccgtacccggttaggttaaacgtttacgtttttaccggtccggttttaaacctacgttcgtacgacgtccggtacggttcccgttcccggtccgttcgggtaccccggttacggtttaaccgggtttccgggggaccggggggtaaccgtagggggtacgggaacgggtacgggaacgtacggtacggtcgggtggtaccgtcggtaacccgtaccgttacgttcccgttcggttacccgtttccgtaccgtttccccgttaccccggacttaaccgttccgttaaacgtaaaccgttaacgg

SEQ ID NO: 219463 - DNA, 918 bp, Homo sapiens
  misc_feature: GYAE6OF01BTAXR.24.87.H10.1.454.CMB.1.raw
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
  modified_base (366)..(366): a, c, t, g, unknown or other
  misc_feature (366)..(366): n is a, c, g, or t
tcagactactatgtcacgaccggtgctcgatttagcagtactgcgttgggtttgggggaggaactgctcagttaggacccagacggaaccatggaagccccagcgcagcttctccttcctcctgctactctggctcccagtactaccacgtggagtaagtagtcatggaccgcagtcctcagtccctaccgtgtctgtgtctccggaagggaacncgccctaccctcgtcgtgaccgagggaccnggtaggagtaagttggttacggacgacgtacctaacgtttaccggcccgttacggtaaccgaacgacaaccggtaaacccgtcggtccgacggtccctccggaacgttcccctacctcctntagtccggtcttacgtcccgtccgaaccggtccgggtcccctgggtcccgtaccccgtacggttaccccggtgggtttacccggttgggggtccgggttcggggttaccgtcggggaacgttacttacccgttttaccgcctaacccgtttaccgacccgttacgtaccgaacccggggtcctaccccttaggttaccggttacgtaaggttaccgttttacgtttcgttaaccgtttaactttttacgttaccggttaacctacctttaaacgggtttcctacggggtttacgttaaccggttacccgtttaccggtaccccgggtttacccgttttaacgttaacccgggttttccgggtaaacccccggggaaccgggtttaaacccgaacgggttaagggttaaccctaaaccgttaaaccgttaaacccggggtagtttaccgggtaccgggtcccttaaacccggtcctaaaccggggttcctttacggttaaacccgtttccccgttaaacccttccccgtttaccccccggttacgtaaccccc

SEQ ID NO: 219464 - DNA, 678 bp, Homo sapiens
  misc_feature: GYAE6OF01CJ7L2.24.87.H10.1.454.CMB.1.raw
  modified_base (209)..(209): a, c, t, g, unknown or other
  misc_feature (209)..(209): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagactaccactggagaagtagtcatgacgcagtctccagcccacctgtctgtcgtctaccgaggggaaaacncgccaccctctcctgcgagggccaggtgagtaatggtggcaggacctaacttacgccgtaggtaccagacgaacggaaacctcgggaccacggtcctaccgacggtccctcctacctctactcggtcctcgttccctcccgaccgtaccgggtcccctgggtaccgtcccacggtccgtacgggttcggttcgggacggttcggggtcgtagggtacgacgttacgtttccacgttcctcgactagtcgaccgtccgtccacgtagtctaagtacgttntttcgtacttntttacttcgtatactaacgtacgttagtacggtcgtacgttcgtcccgttacttacgttcggttaccggacgtaacggtaaccctaaggtcggaagttaactaccgtaaaacggtacgttggtacgtactcggaccctactctacgttctaccttacgacctttcccgtccgttaaccg

SEQ ID NO: 219465 - DNA, 850 bp, Homo sapiens
  misc_feature: GYAE6OF01EHW1N.24.87.H10.1.454.CMB.1.raw
  modified_base (841)..(841): a, c, t, g, unknown or other
  misc_feature (841)..(841): n is a, c, g, or t
tcagactactatgtcacgaccggtgctcgatttagcagtactgcgttgggtttgggggaggaactgctcagttaggacccagacggaaccatggaacgccccagcgcagcttcctcttcctcctgctactctggcctcccagactaccacgtggagtaagtagtgagtgacgcagtcctccgacgcccacccttgtctcgttcgtccgtaccggaagggaaacgccgaccctaccccgtcctccgtcggaccgacggggaccctagtaccgaaggtaacgttaaagtaacgaaacgtacctaaaccgttacgttaacggccgtttacggtaacttaaccgaaacgtaaccgtaaaacccgtccggtacccggtaaccggtaccctccccgaacggtcccttacccttacgtaccgttacgttaacgttacggttaacttaccgtaccgaacggtacccggacgggtacccctaacgggttcggttacccgtacccccgacggtacccggttacggttacgtaacgggtcgggtacgggttacgggttcggggtacggtaacgggttaccgaacgtttccgtacccgtaccgttacctacctaacgttacgacgtacgtacttaccgttccgagtaccgttaacgttcgttaaggttactttacgttttagtaccttttaaacgttttctaaccgtcaaccgtgaaccgtacgtacctacggtacgtccggtacgttccgtaaccgtccgtttaacggtccgggtaccggggtacggaaccgggtaacggtaggttaaccggagttaaccggtaaaccgtagtacggtcggacgcgtaaccncgttactcg

SEQ ID NO: 219466 - DNA, 717 bp, Homo sapiens
  misc_feature: GYAE6OF01B5UKT.24.87.H10.1.454.CMB.1.raw
  modified_base (207)..(207): a, c, t, g, unknown or other
  misc_feature (207)..(207): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctggcctcccagactaccacgtggagaagtagtcatgacgcagtctccagcccacctgtctgtgtctccgaagggaanacgcccaccctctccgtgcacgggccagtgagaattggtcgcagcaacgttcgcctaggtaccagcaacgaaaccgtggccaggcctccgaggtcctccgtcctatacgtcgcttcgtcctccgaccgacgggtcccctggtccgtcccagtcccgtagggttcgtgggtcggtcggggtctgggacctagtactttcgacgtcacacctacgtcgacggccgtcctaccgtacgttcgtacgtaacgttacttttcgtacctttacttttacgtttacttacgttacctaacgttacgttagttcggttacgtaccgttccgggtaccctttccggttacctttacggtttttccgggaaccggtaaccggggtaacccttaaacggtacgggtaacgtaaaccggttaaccgtaaaaccggtaacgttcgggtaccggtacgtccgggtaacctaccgttaacgttccgttacggttccttaccgtcgttaccccttcccggtacccg

SEQ ID NO: 219467 - DNA, 589 bp, Homo sapiens
  misc_feature: GYAE6OF01EC40J.24.87.H10.1.454.CMB.1.raw
  modified_base (207)..(207): a, c, t, g, unknown or other
  misc_feature (207)..(207): n is a, c, g, or t
  modified_base (288)..(288): a, c, t, g, unknown or other
  misc_feature (288)..(288): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (440)..(440): a, c, t, g, unknown or other
  misc_feature (440)..(440): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggcctcccagataccactggagaagtagtcatgacgcagtctccagccaccctgtctgtgtctccgaaggggaaanacgccaccctctcctgcagggccagtgagatgttggacagcaacttgcctttggtacccagacagaaacctggccaggccnccacggcctccttcgtctatcgtcctgtcctccaccgacgggccctggcctcccagccgtaggttcgtgggtcggtgggtctgggactggtnttacnctcnccacntcgagccgcctcagtctagtacgtatttcgcttactttactttctntctaacgtactagtcgtctcgtcgtcctccgttactcgtttcggacgtacgggtaacctaaggtcggaagtactacgaaaccgtacgtgtcggtactggccacccgtatcccgttagttaccctttccctacttcccgtccccgtaccg

SEQ ID NO: 219468 - DNA, 847 bp, Homo sapiens
  misc_feature: GYAE6OF01C51FN.24.87.H10.1.454.CMB.1.raw
  modified_base (211)..(211): a, c, t, g, unknown or other
  misc_feature (211)..(211): n is a, c, g, or t
tcagactactatgtcacgaccggtgctcgatttagcagtactgcgtttgggtttgggggaggaactgctcagttaggacccagacggaaccatggaagccccagcgcagcttctcttcctcctgctactctggctcccagactaccacgtggagaagtagtcagtgacgcacgtctccagcccaccctgtctgtgtctaccgagggaaacncgcccacctctctgcgaggccagtgagtatggttagacagactaacttacggccgtacggtaccagaccgaacgtaaaccgtcggaccacggcccgtacccgacggtccttccccttccgtacttactccggtaccttcgtccctacccccgaccggtaccgggtcccccgttaggttccgtaccccgtaacggtccccggttagggtttcgggtcggggtcggggttccggggtcgtacgggggaacttacgtacgttttacccgaacctttaccctccctaccgtacgtcccggtaccggtcccgggtacccgttaccgtaccggtaccgttaaggtttaaaccgtttctttttaccggttaacttttacggttttacctttccgttaaccgttaaccgttaaaccgttacgttacggtttacgggttctacccgggtttccgtaccccggtttacgtttaaccggttaccgggttttaccgggtaccgggaacgggttaaacccctaagggtacgacgtaaaccgtaacccggtaaaccggtacgttacgggtcgtacttaccgacccgttaaccttctttacggttaccttttaccgttaccccttaacccggttccccgtccccgttaacg

SEQ ID NO: 219469 - DNA, 789 bp, Homo sapiens
  misc_feature: GYAE6OF01AKJQU.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagatgttggcagctaacttagcctggtaccagcaagaaacctggccacggcctcccgaggcctcctcctctatcgctcgtcctcccgaccgaccgggtccccgtgggtccgtccccgacggtcccgtacgggttttccggttcggggtccgggttcgggggttcgtgggggacctaggttacttttccgaccgtttcctacccgtaccctagttccgacggtcccgggtaccctcccgtacgttccgtaggtaacgtttactttttacgacctttaaccgtttttacttttaccttacgttaaccctaaaccttaaccggtttagtttccggggtttacgtacccgtttccgggttaccccgtttaccccggtttaacctttacccggtttttaccggggaacccgggtaaccgggggtaaccctaaacggttcgggaaacggtaaccgttaaccgtaaaacccgggtaacgttcgggtccgggtcttacggacccttacccgttacgttaccgtttccgtttaccttacccttaccgtttcccgttcccccgtacccg

SEQ ID NO: 219470 - DNA, 803 bp, Homo sapiens
  misc_feature: GYAE6OF01EG2HD.24.87.H10.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccacgtggagaagtagtcatgacgcagtctccagccaccctgtctgtgtcncgagggaancgccaccctctcctgcgacgggccaggtgagtaagttggttacgcagacctaaacgttcgcccgtaggtacccagaccaaacggaaacccgtggcccgaacggccctaccccgacggtcccctccccttcctcgtagtccggtccttaccggtcccttaccccgaaccggtacccgggtcccccgttgggtccctacccgacggtccgtacgggtttcgtcggggtcggttgggtcgtacgggacgtagttactttacgaccttccgtacctaccgtactacggccgtcccggtaccctaccgtacgttcgtaacgttaagttcttttacggtacttttactttttacgtttaccgtacgtttaacctaaacttacgttacgggttaggttaccgtacggttcccggttcccgttaacccgtttaaccgtttaccggtttaccgggaccggtaaaccgggtaaaccgttaacggtacgggtaacgtaaaccgtaaaccgtaaaccggtaacgttcggtaccggtaccgacggtcccttaacccgtatttcccgttaacgtttccccttaacctttaccgtttcccccgttccccgtaaccg

SEQ ID NO: 219471 - DNA, 822 bp, Homo sapiens
  misc_feature: GYAE6OF01BMRGJ.24.87.H10.1.454.CMB.1.raw
  modified_base (187)..(187): a, c, t, g, unknown or other
  misc_feature (187)..(187): n is a, c, g, or t
  modified_base (228)..(228): a, c, t, g, unknown or other
  misc_feature (228)..(228): n is a, c, g, or t
tcagactactatgtcacgaccggtgctcgatttagcagtactgcgttgggttgggggaggaactgctcagttaggacccagacggaaccatggaacgccccagcgcagtcttctccttcctcctgctactcgtggcctacccaagactaccacgtaggaagtaagtagtcagtcgacgctagttccncacgccctaccgtgtcgtgtacgttccgacggaagggaacnccgcccctacctcctccgtcggaccggacggaccgtaggtacgtaagtagttggtcgacgtacgtactaacggtcgaccgtacggtaccgacgacgaacgtaacgtcgacgtacgccgtaccgcgtacctccgtcctctacgtcgtcgtccgtcctaccgtaccggccggtcccgtccggtccgaccgtcgtacgtacgggttcggtcgggtcggtacggtcggtacggtacgttacgtacgttacctacgtaacgtactaacccgtagtacccccccggtagtcccgtaccttaccgtacgttacgtaacgtaagtttcgttacgttactttacgtttacttaccgtaagtaccttacgttacgttacgtacggttaccgtacgttccggtacccgtttaaccgttaccggtttacggtacccgggttaaccggacggtaaaccgttacggtaacgtaaccggtaaacccgttaaacggtaccgttaaccggttaccgggtaaccgtaccgtaccggttaaccccttagttaaccgttcccggttacctttaccccggtaagtttcccccttacccgggtccctttaacccgg

SEQ ID NO: 219472 - DNA, 642 bp, Homo sapiens
  misc_feature: GYAE6OF01ELVC3.24.87.H10.1.454.CMB.1.raw
  modified_base (205)..(205): a, c, t, g, unknown or other
  misc_feature (205)..(205): n is a, c, g, or t
  modified_base (301)..(301): a, c, t, g, unknown or other
  misc_feature (301)..(301): n is a, c, g, or t
tcagactactatgtcacgaccggtgctcgatttagcagtactgcgttgggtttggggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaactagccgtggtaccagcaacgaaacctggaccaggcctcccgaggcctcctcctntatcgctcgtcctccaccgacgggtcccctggtcgtcccgacgtccgtagggttcgtgggtcgggtggtcgtgggactagtactttcactctcacgatcacgccgtcctcgacgtcgtagtaagtattttcgactttacttttacgtttacttacgtacctaacgtaacttagttggtacgtacgtcggtccctcgttaacccttcggtttacggtaccgtaacggggtaaccctaacggttagggaataaccgttaaacgaaaccggtaaagttcggtacggacgttcggactacccgtatcccgttagttaccttactaccgttcccgtcccgtacccg

SEQ ID NO: 219473 - DNA, 693 bp, Homo sapiens
  misc_feature: GYAE6OF01A78RI.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctcgaggggaaancgccaccctctcctgcagggccagtgagatgttggcagctaacgttagccgtgtaccagcacgaacctggccaggcctacccgaggtcctccctcctctatcgtctcgtcctcccgacccgaccgggcccctgggtccgtccccgacggccgtagggttccggtgggtcggtagggtccgtaggggactaggtactttccgactcctccgactcgtacgacggccgtaccttcccgagttacgtacggtaacgttacgttttcgtaccgtttactttttactttccgttacgtacccttaaaccgtaacgtttacggttacggttacggtaccgttccgggtaccctttacccggttacctttacccggttttaccgggaccggtaaccggggtaacccaacggtacggtaactactaacgtaaaccttacgttggtacggtactcgacctacctacttctaccttcttactccttcccgtacccgtacc

SEQ ID NO: 219474 - DNA, 909 bp, Homo sapiens
  misc_feature: GYAE6OF01CHUKH.24.87.H10.1.454.CMB.1.raw
  modified_base (549)..(549): a, c, t, g, unknown or other
  misc_feature (549)..(549): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactcgtggcctcccagactaccacgtaggaagaagttagtcagtcggacgcgtagtcctccgacgccctaccgtgtcgttgtcgtcgtaccggaaggggaaacgcgaccctacctccgaccgtggacggacgggcctaggtacggaagtagtcggttacggacgtacggtactaaccgttcggaccgttacggaacccgaggtaccgaaacgaaacccggtcggaccgaccggtccgttaccgaccggtcctttcctaccgttcgtaacgtcgtaccgttccgtacccgtacccgaccgggttacccggtcccggttacgggttcccgtacccgtaacggttcccgggtttaacgggtttcgggtaccggggtttccggggttacggtccggtaaggggtacttacgggtttaaccgtttaccncgttaaccccgttacgaaaccgttctacccgggtaccggtccccgttacgttaaccggtacgtcggtaacgttacgtttacgtttacgtaccttttacgtttactttaccgtctaaccgtaatttaccggttaagtcggtaccgtacggtaccgtacgttccgttaacggttaccggtaacgggtaccggtaacgggtacccttaaggccggttaaacgaccggttaaacccggtaaaagtcccgggtttaaagggtcccggtaacccgttaccggtaaaccctagggtttaacccgttacccgtttaaccgtttaccgttaacccgttacccgtttaccccggtccctttaaacccggg

SEQ ID NO: 219475 - DNA, 684 bp, Homo sapiens
  misc_feature: GYAE6OF01AYBI9.24.87.H10.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaancgcccacctcncctgcagggccagtgagatgtgcagctaacgttgccgtaggtaccagacaacgaaccgtggacccaggccctcccgacggtcctccctcctactagcgtctcgtcctcccgaccggccggtcccctggtcctcccgacgccgttagggttcggtggggtcggtgggtcgtaggggactaggtacttccacgttcctaccacctatccgacggcccgtccctccgtacggttacgtacggtaacgtttacgttttacgtacctttacgttttactttccgttacgttaacctaaacttacgttaggttacggtacgtaaccggttccgtcccgttaccgttaccgttacgttttccgggaaccgtaacgggtaacctaacggtacgaacgtacgtacgtaaacgtacgtacgtcggtacgtacgtccacgtacgttcgtacgttcctacttccgttcccgtcccgtacg

SEQ ID NO: 219476 - DNA, 788 bp, Homo sapiens
  misc_feature: GYAE6OF01ES552.24.87.H10.1.454.CMB.1.raw
  modified_base (220)..(220): a, c, t, g, unknown or other
  misc_feature (220)..(220): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctcggcctcccagactaccacgtggagaagtagtcatcggacgcagtcctccacgccctaccctgtctgtcgtcctaccggaaggggaacncgcccacccttccgtccgtgcgacggaccagtagaagtagtggtacgcgagtactaacgtacgccgtacgaccagacaacgaaccgtcggaccgacgcctacccgacggtcccttacctcccgtacgtacgtcgtccgttccgtaccctacccgacccggtcccgggtcccgttacggtccgtacccgacggttccggtacgggttcggtcgggtcggttcgggtacggtcggacgtacgttcttaccgacctactaccgactacgtcgacggtccgtacccgtcgtagtacgtaagtacgtttatttccgtacgtttactttacgttccgttaacgtacctaacgttagttacgtacgggtacgttaccgtccgttccgttaccgttaccgtttaccggttaccgggtaccggtaaacggggtaacctaacggggtaaccggtaactaaaccggtaaccgtaaacgggtaccgttcgggtaacgtaccgtacccgtaccgtaacccgttcgttaccggtttccgtttacccgttaccgttccccgtttacccccgaccgttaaaccg

SEQ ID NO: 219477 - DNA, 860 bp, Homo sapiens
  misc_feature: GYAE6OF01EGB4V.24.87.H10.1.454.CMB.1.raw
tcagactactatgtcacgaccggtgctcgatttagcagtactgcgttgggtttgggggaggaactgctcagttaggacccagacggaaccatggaacgccccagcgcagcttctcttcctcctgctactctcggcctaccagactaccacgtggaagtaagtagtcatcgaccgctacgtcctccacgccctacccgttgtcgttggtcgtccgtaccggaaggggaaacaccgtacccctaccctctccgtacgcgacgggcctaggtacgaagtagtcggttcgactagtactaactcgccgtacggaccagacgaaccgaaccgtcggaccgacggccctacccgacgtcccttacccgtcctacgtacgtccgtaccgttccgtcccgtacccggacccggtacccgggtcccgttaccggtcccgtaccgaccggttccggttcgggttccgggtcgggtacgggttcgggtacggtacggtactacgttaccttacctacgtccgtaccacgtactaccggccggtacccgttcctacgttacgtacgttaacgttagtttacgtttaccgtacctttacttttcgttaccgtaccttaacgtaaccgttacgttaggttccggtccgttaacccggtcgttaccccgttaccggtttaaccgttcccgggttaaccggaacccgggtaacggtaaccgttaacggacggggtaaacctaaacggttaaacccggaaaggttaccggttacgggtccgttaacccggtacgtaccccgttaaccgtttccgttacccgggtttccctttaaaccgttaccctttccccggttaccccgttaccccgttaaaccg

SEQ ID NO: 219478 - DNA, 713 bp, Homo sapiens
  misc_feature: GYAE6OF01CCQZZ.24.87.H10.1.454.CMB.1.raw
  modified_base (506)..(506): a, c, t, g, unknown or other
  misc_feature (506)..(506): n is a, c, g, or t
  modified_base (540)..(540): a, c, t, g, unknown or other
  misc_feature (540)..(540): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtcgtcgtaccgaggggaaaacgacgacctaccctctccgtgccgacgggcctaaggtgaagtaagtggtttacggacacgtactaacgttacggccgtacggtaaccacggactaacggaaaaccgtcgggacccgtaacggccctacccgtaacggtccccttccttacccgttactactcggtaccgttccgtccttacccgacccggtaccgggtccccctgggtccgtaccccgacggtccggtacgggtttcgggttacgggcgggttcgggtcggttacgggacgtacgttactttaccgactccgtaccactntccgacgtccgccctcgacgttgtacgtaagttntttacgtactttacgtttatttcgtacgtacctaaactgttagttgcgtacgtccgtaccgttcgtactttcggttcggaaccggacggaaacgtaccgtaggactaacgactaaaacggtcgtaggtcgtacgtcgtaccgatccttagtcttcactaccttccgccctacg

SEQ ID NO: 219479 - DNA, 597 bp, Homo sapiens
  misc_feature: GYAE6OF01CS13F.24.87.H10.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (565)..(565): a, c, t, g, unknown or other
  misc_feature (565)..(565): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctccgaggggaaangccaccctctcctgcagggccagtgagaatgtggcagcaacttagcctaggtaccagcaacgaaacctggccaggcctcccgaggcctcctctctactgctcgtccnccaccgacgggtccctggtccgtccgacgtccgtaggttcggtggtcggtgggtcgtacgggactagtcttcactctacactctcgacgccgtacctcgtacgtctacgtaagtgttttacgtcttacttttacttctcgtaactaactacctatcggtacgcgtcgtccgttctacgttacgtttccgggaccgacgggtaacaacggtcggaacgtactaacgaaacggtatacgggtcgagacctcgacctnttctcgttacttactacttcccgttcccgtac

SEQ ID NO: 219480 - DNA, 749 bp, Homo sapiens
  misc_feature: GYAE6OF01B9PCM.24.87.H10.1.454.CMB.1.raw
  modified_base (228)..(228): a, c, t, g, unknown or other
  misc_feature (228)..(228): n is a, c, g, or t
  modified_base (440)..(440): a, c, t, g, unknown or other
  misc_feature (440)..(440): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatcgacgcactctccagcccacctgtctgtgtctaccggaaggggaaacgacgccaccctctcgtgcgngggccagtgagaatgtcgacagacacttacgcgttacggaccagactaacgaaaccgtcggaccaacggtccctacccgacggtcccttccccgtacctacttacgttcgtccgttcgtaccctacccaccggtaccgggtccccgttggtccgtacccacggtccgttacgggttcggtcggggtcgggtcgggttcgacgggtacagttnttaccgaccttctaccgaccagtcggacgtccggtacctacgtacgtacgttagtaagttcgttttacgtactttacgtttactttctacgttactaaactacgttacgttacggtacgttacgttccgggtacccttacgtttaccgttaccggtttacgggaaccggttaacgggaaaccgttaacgggtacggtaacgtaaacgtaaaccgtaacggtaacggttccggacgggttacctacggtaccgtaaccgttacgtttaccgttcgttacccttacgtacctttcccgtacccccggttac

SEQ ID NO: 219481 - DNA, 744 bp, Homo sapiens
  misc_feature: GYAE6OF01EOV1T.24.87.H10.1.454.CMB.1.raw
  modified_base (324)..(324): a, c, t, g, unknown or other
  misc_feature (324)..(324): n is a, c, g, or t
tcagactactatgtcacgaccggtgctcgatttagcagtactgcgtttggggtttggggggaggaactgctcagttaggacccagacggaaccatggaagccccagcgcagcttctcttcctcctgctactctggctccagataccactggagaagtagtcatgacgcagtctccagccaccctgtctgtgtctaccgaggggaaagacgcccaccctctcctggacgagggccaggtgaagaagttggttaggcagactaacttacgcctaggtaccagacaacgaaaccgtcggccacggcctcccgaggccttccctcctntactcgtcttccgtcctacccaccggaccgggtcccctgggtccgtacccgcgtccggtaggtttcggtgggtcgggttcgggtcgtgggatcgttactttcgacctcgtacacgtactcgacggtccgccttaccgcgttacgtagtaacgtttctttacgacttttacttttctttacgtgttaacctaacgttactagtcgggtacgtacgtccggtacccgttaccgttaccgttaccggtttacggacccgggtaacggggttaaaccctaaacgggtacgggtaactaacgttaaaccggtaaaccgggttaacgttacgggtaccgggtaacttaccggtaccctaacgggttactttaccccggttacgtttacccgtttacttacccgtttccccggttaccccctaaccg

SEQ ID NO: 219482 - DNA, 940 bp, Homo sapiens
  misc_feature: GYAE6OF01BHYE6.24.87.H10.1.454.CMB.1.raw
tcagactactatgtcacgaccggtgctcgatttagcagtactgcgttgggtttgggggagaactgctcagttaggacccagacggaaccatggaagccccagcgcagcttctcttcctcctgctactctggcctcccaagactaccacgtgggagaagtagtcatgaccgcagtctccgacgccctaccttgtctgtcgtcctaccggaagggaaacgcgaccctacccgtctccgtgccggacggccgtaaggtggaagtaaggttcggtttacggaccgtaaggtaaccttaaaccgtttacgggacccgtttaacgggtaaacccgaacggaaccgtaaacccggaaaacccggttcgggcccgaaaccggggtaccccttaccggacccggttacccttccccgtttactaccggtttacgttcggttcccttccgttccccgtaccgaacccggtccgggtccccgttaggttcccgaaccgtcggtaccgtttacggggtttcccggtcggggttccggggttacggtcgtaacggggtacgtaacgtttcccgttacgtaccgttccaacgtaaccctcggttaaccgaccgggtcccgtccgttaaccgtacggttaccttagtaacgtttcttttacgtaccgttttacgttttacttcgttaactaccgtaacgtacgttacggtacggttaccgttacgttcccggttaccgttacccgtttacggttaccgggtttaccggaacccgggttaaccgggttaaacccgtaacggttacgggtaaacctaaaccgttaaaccggtaaaacggttccggttcgggttaaccgtacccgggttaacgacccggttaacccgtaccgtttcccgtttaaacggtttacccgtttaacctaaccccgggtttccctccccggtttaaaccccgg

SEQ ID NO: 219483 - DNA, 758 bp, Homo sapiens
  misc_feature: GYAE6OF01B9DR5.24.87.H10.1.454.CMB.1.raw
  modified_base (149)..(149): a, c, t, g, unknown or other
  misc_feature (149)..(149): n is a, c, g, or t
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
tcagactactatgtcacgaccggtgctcgatttagcagtactgcgttgggtttggggaggaactgctcagttaggacccagacggaaccatggaagccccagcgcagcttctcttcctctgctactctgcctccagataccacgtgganaagtagtcagtgacgcagtctccagccacctgtctgtctctaccgaggggaaangtcccacctctccgtgcgacgggcctagtagaagtatggtacggnagtacaagttcgctcggtacagaccgaagaaacccgtggaccgcggtacccgtacccgacggtcccttcccctccgttctagtccgtcgtcgtcccgtacccgtcccgaacgggtcccccgttggtccgtcccggtacgtccgtacggttcggtcggggtccgtggggtaccgtaggggacctagttactttacggaacctcgtaccgaccgttaactcggtaaccgtccgggttacctaccggttacgttaccggtaacgttaagtttacgtttacggtacctttaacgttttcgtttaacctcgttaaccaaacgtttacgttacgttacggtaaccgtcggtcccggtttacccgtacctttaacggttccgtttacgggaccggtaacggtaacccctaaggtcggaaactacggttaaaccgaaacggttaacgtcggttcgtccgtacgttcccgacttacttcggttacttccgttacctacccggttcctcccggttaaccc

SEQ ID NO: 219484 - DNA, 607 bp, Homo sapiens
  misc_feature: GYAE6OF01BH79I.24.87.H10.1.454.CMB.1.raw
  modified_base (443)..(443): a, c, t, g, unknown or other
  misc_feature (443)..(443): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggtagaagtagtcatgacgcagtctccagccacctgtctgtgtctccgagggaagagccacccgtctcctgcgagggccagtgagatgttggcagcaacgttagcctaggtaccagcaacgaaacctggaccaggcctacccaggccttcctcccgtctacgtcgccttcgtccgtccgaccgtacgggccccgttggtccgtcccgagtccgtaggtttccgttggcggtcgggtctagggactaggtactttcactctacactatcgacgccgacctccagtctagtaacgtntttcgacttacgttttattccgtagtactaactacttgtcgtgtactcggaccttcgtaactcgtttcggaccgtagggtaacccaaacgtcggaacgtactaacgtaaacgtacgttgtcgtactcgacaccgtatcgtagttcttagcttccgtccgtaccg

SEQ ID NO: 219485 - DNA, 830 bp, Homo sapiens
  misc_feature: GYAE6OF01C35UM.24.87.H10.1.454.CMB.1.raw
  modified_base (156)..(156): a, c, t, g, unknown or other
  misc_feature (156)..(156): n is a, c, g, or t
  modified_base (194)..(194): a, c, t, g, unknown or other
  misc_feature (194)..(194): n is a, c, g, or t
  modified_base (313)..(313): a, c, t, g, unknown or other
  misc_feature (313)..(313): n is a, c, g, or t
  modified_base (419)..(419): a, c, t, g, unknown or other
  misc_feature (419)..(419): n is a, c, g, or t
  modified_base (531)..(531): a, c, t, g, unknown or other
  misc_feature (531)..(531): n is a, c, g, or t
tcagactactatgtcacgaccggtgctcgatttagcagtactgcgttggggtttgggggaggaactgctcagttaggacccagacggaaccatggaacgccccagcggcagcttccgtcttcctcctgccttactctggcctcccaagtactaccncgtaggaagtaagtagctaagtgacgctagtccaccgngcctaccctgtacgtggtcgtaccggtacccgggggaaaatccggtccccacccgtctaccgtcgacgacgggtcaggtgaacgtaatcggtcgcgagactaacttgcctggtaaccgngtaaccaacggtaaacctccggacctaacggcctcccgacgttcctccctaccgtgtaaccgtcgtccgtacctacccgtccggaaccccgtacgggggttccccncgggttaccgtacccgtcggttaccccgggtaaggggtttttcccgggtagggtccggggtttcgggaccggttacgggtaaccggttacgtttagtttaccccggtaaccnccggttaaccaccggtaacgtcggaccgtaccccggtaccttaccgacgttacgtaacggttacgttcgtttacgtactttcgtttaacgttccgttacgtaacgtaccgttacgtacgtcgggtacctacggtaccgttcctaccgttcgtaaccgttaccggacggtaaaccggtaccgtaaggtaccgtactaaccggttaacgtaaaccggtccgtagggtaccgtacgtaccgtaccttacgtaccgtttgactttacccggctttacccgtccccgttacgtcccctaaaccg

SEQ ID NO: 219486 - DNA, 822 bp, Homo sapiens
  misc_feature: GYAE6OF01CXRTT.24.87.H10.1.454.CMB.1.raw
tcagactactatgtcacgaccggtgctcgatttagcagtactgcgttggggtttgggggaggaactgctcagttaggacccagacggaaccatggaagccccagcgcagcttctcttcctcctgctactctcggcctccagactacccagtgggaagaagtagtctaatgaccgctagttcctccgacgcccaccctggtctggtcgtccgtccggaaaggggaaactccgccctaccctctccgcgccggaacgggcctaaggtcggaacggtatcggttggacaacggtactaacgttaccgccgttacggtaaccgaggaacctaaccgtaaccgtcgggaacccaccgggtccctaccccggacggtcccttaccccgtccttacgtcgttcgtaccgttccgtacccgtaacccggtacccggtacccgggtccccgtttgggccccgtaccccgacggtaccggtttcgggggtttccggtcggggttcgggttaccggggtacgtcgggaaaccttaggtttaccctttcgacccttacgactacccgtacgtaccggaccggtacccgtcccgttacgaccgttagtaacgttacggtttacgtttacctaacgttttaacttttctacgttactaaacctacgttagtacgttggtacgtcctaccggtccgttaccgtacgtttccggtaacggcggaacgggttacctaacggcgtaacgtaaccgtaacctaaaggtcggtagtccgggtactacgaaccgttacgacctttccggtacttaccgttcgtacccttccgttcccgtaacg

SEQ ID NO: 219487 - DNA, 919 bp, Homo sapiens
  misc_feature: GYAE6OF01CSVVG.24.87.H10.1.454.CMB.1.raw
  modified_base (213)..(213): a, c, t, g, unknown or other
  misc_feature (213)..(213): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctcggctccagataccactggaagaagtagtacatcgacgcacgtctccacgcccaccctgtcctgtcgtctaccgaagggaacncgcccacccgtctccgtcggcgacgggcctagtacgagtaagttcggttacggactaacggtactaacgtttacgccggtacgggtaaccgtagaccgtaacggtaaacccgtcgggacccgacggcccgtaccgaacggtccttcccctaccttactacgtcgtccttacggtcccctacccggaccggtacccgggtcccgttcggggttacccgtaccccgtacgggtacccggtttacggggtttccggttcggggtccgggtttacgggtccgtacgggtaacttacggttaacgttttccgaccgttaccgaccgtaaacctccggtcggaaccggtcccggtacccgttaccggtaacgtttccggttaacggttaagtttaccgttttaccgttacgttttaaccctttttaaacgttcccggtttaacgttaaccgttaaaccggttaccgtttaacgggttcttaccgggaaccggtttacccggtacccgttttaaccgttacggtttacccggttttaacccgggaccgggttaaacccgggtaaaccttaaacgggtacgggtaaaaccgttaccgtaaaacccgggaaaacgttcgggtaccgtaacgggttaccctaacggtacccgttaaccttcccgtttaacgttccgttaacccgtttcgtacccctttcccggtacccttaaacgg

SEQ ID NO: 219488 - DNA, 857 bp, Homo sapiens
  misc_feature: GYAE6OF01AN3WI.24.87.H10.1.454.CMB.1.raw
  modified_base (157)..(157): a, c, t, g, unknown or other
  misc_feature (157)..(157): n is a, c, g, or t
  modified_base (178)..(178): a, c, t, g, unknown or other
  misc_feature (178)..(178): n is a, c, g, or t
  modified_base (821)..(821): a, c, t, g, unknown or other
  misc_feature (821)..(821): n is a, c, g, or t
  modified_base (848)..(848): a, c, t, g, unknown or other
  misc_feature (848)..(848): n is a, c, g, or t
tcagactactatgtcacgaccggtgctcgatttagcagtactgcgttggggtttgggggaggaactgctcagttaggacccagacggaaccatggaacgccccagcgcagcttctccttcctcctgctactctggcctaccagactaccacgtgganaagtgcagtcgacgcagttcnccacgccctacctgtctcggtcgttaccgaccgggaaagggggaaacgccgaccccgtaccccttcgtccgtcggaccggacgggggacctaaggttcggaaaacggttagtttcggggttacgggaacctaacggtaccgtaaaccggtttacggcccggttacgggtaaacccgaccggtaaccggtaaacggaaaccccggttcgggaacccgacgggtcccctacccggacggtcccttaccccttcggttacctcggtccgttaccgtcccggttacccgtaaccccgacccgggaccgggtttccccgtgggtacccgtacccgtaccggtcccggttagggtcccggttacggggggtcgggtttacgggcgttaacggggtactacgggtttacctttaccggacttaccgaccgtacgtacgttacgacggtccccggtcctacggtacgttcgtaagtttacgttacttacgttacgttttacttacgtttcgtaacgtactaacgtcgtaggtccggactacggttaccgtccctaacgtttacgttacccgggttaccgtaccgggtaaacggtaaccgtaaccgtaggtaaacgttacgaacgtaaggtaccgttacgcgtacggtaccncgtaactcgtacgtctacgtacttccnccgttcgac

SEQ ID NO: 219489 - DNA, 817 bp, Homo sapiens
  misc_feature: GYAE6OF01C057J.24.87.H10.1.454.CMB.1.raw
  modified_base (209)..(209): a, c, t, g, unknown or other
  misc_feature (209)..(209): n is a, c, g, or t
  modified_base (493)..(493): a, c, t, g, unknown or other
  misc_feature (493)..(493): n is a, c, g, or t
tcagactactatgtcacgaccggtgctcgatttagcagtactgcgttgggtttggggaggaactgctcagttaggacccagacggaacatggaagcccagcgcagcttctcttcctcctgcctactctggcctcccagactaccacgtggagaagtagtcagtgacgcagtctccagccacctgtctgtgtacgtaccgaagggaaacncgacccaccctctccgtgccgacgggcctaggtacgaagtaacgttggttcggacacggactaacgttcgccgtacggtaccacgacgaacggaaaccgtggaccgacggccctaccgacggtccctccgtccttacgtacgtcgtccgttcgtaccccgtacccgtaaccggtccggggtccccgtggttacccgtcccgaaccgtccgttacgggttcgttacggggcgggtttcggtcggtacgggactaggtacgttaccactaccgttaccacgtaacngtaccggaccgtccttaccgtacgttacgtaacgttagtttacgtttcgtaaccttttaacgttttacgtttccggttacttaaccaacgttaccggttagttcggttaaccgttcgttacccggttacccgtttaccgttaacccggtttcccggttttacgggacccggttaaacgggtaacccttaacgggtacggtaaacgtaacggttaaacccgaaacggttccggtttaggaacccgtcgttaaccgtacccgtaccgttaccgttcgtttacccgtccgtttaaaccgttcctaccccggtttaccccgttaaccg

SEQ ID NO: 219490 - DNA, 788 bp, Homo sapiens
  misc_feature: GYAE6OF01D4MEZ.24.87.H10.1.454.CMB.1.raw
  modified_base (158)..(158): a, c, t, g, unknown or other
  misc_feature (158)..(158): n is a, c, g, or t
  modified_base (665)..(665): a, c, t, g, unknown or other
  misc_feature (665)..(665): n is a, c, g, or t
  modified_base (747)..(747): a, c, t, g, unknown or other
  misc_feature (747)..(747): n is a, c, g, or t
  modified_base (767)..(767): a, c, t, g, unknown or other
  misc_feature (767)..(767): n is a, c, g, or t
  modified_base (774)..(774): a, c, t, g, unknown or other
  misc_feature (774)..(774): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagactaccacgtggagaagtntcagtcgacgctaagtctccacgcccacccgttgtcttgttcgtaccgtaccgggaaggggaaaacgaccgcccctaaccccttcctccgtcgaccgacggggcctaggtacgtaagtaggttggttcggaccgtacgtaccgtaaacgttaccggtcccgtacggtaaccacgaacccgaaacggtaaacccgtccgggacccgtaaccggtcccgtacccgtaccggtacccctcccctttacccgtccgttactccggtccgttacggtaccccgtacccggaacccggtcccgggttcccgttcgggttaccccgtaccgaccggttaccgggtttacggggtttcgggttaccgggggtcgggtttccggggtcggtaaccggggactcggtttactttacccgacttccgtacctaccgtactccggccgtacccggtcctacgtacgtcgtacgtagtttcttacgtctttacgtttcttacgtactaatacctagttcncggtactacgtcctacgttaccgtcgtttcggtaccggcgacggtaaccgtagacgtacaacgtaacgaacggtcgtcgcgntacccactctcgtacgttcnccgttcncccgtcctcgtacg

SEQ ID NO: 219491 - DNA, 703 bp, Homo sapiens
  misc_feature: GYAE6OF01AQE6F.24.87.H10.1.454.CMB.1.raw
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (286)..(286): a, c, t, g, unknown or other
  misc_feature (286)..(286): n is a, c, g, or t
  modified_base (334)..(334): a, c, t, g, unknown or other
  misc_feature (334)..(334): n is a, c, g, or t
  modified_base (403)..(403): a, c, t, g, unknown or other
  misc_feature (403)..(403): n is a, c, g, or t
tcagactactatgtcacgaccggtgctcgatttagcagtactgcgttgggtttgggggaggaactgctcagttaggacccagagggaaccatggaagccccagctcagcttctcttcctcctgctactctggctcccagagaccaccggagaaattggtgttgacacagtctccaggcaccctgtctttgtctccgaggggnagacgcccacccctntcccgtgcgacgggccgacggccgggaagttgttaaggtaacgtacgttaggcctacggtaacccaaanaacggaaaccgtggcccgaaggcctcccgaggtcctcctacattctangatcgtacctaccgaacgtcggtcacgtcggcccgtcccgcgtagttcaggtcggacgtggtacgggtntagggaactcgtacttcgaccttacctcgtacgtcgacgcaacggtcctagacgtccgttagaagtttacgttttcggtacgtttactacgttagtaccgaagtctaccggtaccgttccggtcccgtcgggtaccgtaccggtttaacgggttcccggggggacggggggtaaccctaggggggtcggaacggggtacgggaacggtaacgtaacggtggacggtccgtcgaccgtacctacggtcttagttcccgtcttaccgtcccgttacccgcctagtacctagaagtcgtaacg

SEQ ID NO: 219492 - DNA, 704 bp, Homo sapiens
  misc_feature: GYAE6OF01BKD56.24.87.H10.1.454.CMB.1.raw
  modified_base (204)..(204): a, c, t, g, unknown or other
  misc_feature (204)..(204): n is a, c, g, or t
  modified_base (420)..(420): a, c, t, g, unknown or other
  misc_feature (420)..(420): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagactaccactggagaagtagtcatggacgcagtctccagcccacctgtctgtgtctcgagggaancgccaccctctcctgcacgggaccagtgagtaagtgtggacagctaacttcgccgtacggtaccagacgaacgtaaccgtggaccaggtccctaccgacggtcctcccctccttatacgtcgtctccgccttaccgacccgtccgggtccctggtcctcccgacgtccgtacgggttcggtggggtcggttggtcgacggtactagttcctttacncctctacctaccgtagtccgtaccggccgtacccgtcctagtcgtaaggtaccgtttacgtttcactttactttttcttacgtcgtaaacctacgtaactttgtcgggaccgttacgtcccgtacctttaccgttaccgtttacggttacccgggtaccggtaaacggggtaaccaacgggttacgtaacgaaacccttaacgtaaccggttaacggtggtacctcggtacaccccgtacgttatcggttacttaccttaccgtccttacccggtccttacccg

SEQ ID NO: 219493 - DNA, 900 bp, Homo sapiens
  misc_feature: GYAE6OF01ET2CX.24.87.H10.1.454.CMB.1.raw
  modified_base (200)..(200): a, c, t, g, unknown or other
  misc_feature (200)..(200): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctcgagggaancgccaccctctcctgcgacgggccaggtgaagtaagtggttcggcaggactaacgttacgccgtacggtaccagaccgaacgaaaccgtggaccgacggcctacccgacggtccctcccgttcctcgtacgtcggtccttcgtcccttcccaacccggtccgggtccccgttggtccgtccccgagtcccgttacggggtttccggttcggggtccggttacggggtcgtacggggtaacctaggttacttttccgaccgttacctacccgaaccgtacgttccggacggtcccggttaccccttacgtaaccggtttaccggtaacggttaaacggttttacgtttttacggtaaccgttttaacttttttacgtttccgtttacgtttaaacccgtaaacgttaccgttaacgttttacgggttacgttaccgggttacccggttaccctttaaccggtttaaccgtttaacccgggtttaccggggtaacccgggttaaacggggttaaccccgtaaacggttacggtaaacgggtaacctttaaacccgggaaaaaccggtttaccggttaacggggttaccggttaaccggttacgggtaaccccttaaccccgtttaacggttacccgttttccggttttaacccgtttaaccgttaccccggtttttccccccgttaaccccggttaacccgg

SEQ ID NO: 219494 - DNA, 885 bp, Homo sapiens
  misc_feature: GYAE6OF01B9JSF.24.87.H10.1.454.CMB.1.raw
  modified_base (230)..(230): a, c, t, g, unknown or other
  misc_feature (230)..(230): n is a, c, g, or t
  modified_base (628)..(628): a, c, t, g, unknown or other
  misc_feature (628)..(628): n is a, c, g, or t
tcagactactatgtcacgaccggtgctcgatttagcagtactgcgttggggtttgggggaggaactgctcagttacggacccaggacggaaccatggaagccccagcgcagccttctcttcctcctgctactctggcctcccagatacccacgtaggaagaaagtagtcgaatcgacgctagttcctccacgcccacccttgttctttcggtccgtccggaagggggtanacggaccgccccgtaccccttctcccgtgggaccgtaccggggcctaggtccgaaggtaggttacggttacgaccgtaggcgtacggttaccttacgttaccggcccgttacggaaccgtaacggaccgtaaaccgaaacccggtcggtacccggtccgggtaccccgttaccccggtacggtccccttacccgttacgtaacctttaccggtttcggtacggggttaccgtacccggttaccccgaccgggtaccgggtacccggtaccggttcgggtcccggttaccgggaccgggtaaccggttacggtttccggtaacggggtggtaccggtagggtttacgggttccgggtttacgggaacgttacccgtacctttaaccgtacctccgttanacggtacctacgtacgacgtagtacgccggacgtacgtaagttcgttcgacgttgtgttactcggtcgacttggttaccgtttggttacccgttccctttccgttacccgtttaccgttagtttacccggtttacggtttaccgttccgggtaccggtttaccgggttccggtaagggttccggttaacggggtacttaccgggtacgttacggtaaccggtacggttcggtacccgtccgggtacttccgggtacc

SEQ ID NO: 219495 - DNA, 791 bp, Homo sapiens
  misc_feature: GYAE6OF01DZHV6.24.87.H10.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (475)..(475): a, c, t, g, unknown or other
  misc_feature (475)..(475): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctggcctcccagactaccagtggagaagtagtcatgacgcagtctccagcccaccttgtctgtgtctccgagggaancgcccacctctcngcgaggccagtgagtagtggttacgcacgactaacgttacgccgtaggtaaccagaccgtaaagaaacccgtcgggaccacgggtcctaccccgaggtcccctccttcctcgtacttcggtccttacgtccctacccgaaccggtaccggtcccgtcgggtccgtaccccgacggtcccggttacgggtttcggtcgggggtcggttcggggtcgacgggtaactaggttacctttccacttccgacctaccgtanccggtaaccgggtcccgtacccgtaccgtacgttacgttaaggtaacgttttacgtttacgttacgtttaactttttacgtttaccttacgttaacccgttaacgtaacgtttacggttacggtaccggttaaccgtccggttacccgtttaccgttaccggtttaccggtttacgggaacccgggttaaccggggaaacccttaacgggtacggtaaaccggtaacgttaaaccggaaaccgttacggtaggttcggacttacggaccctacgttacgttcgttaccttcttacctaccttcccgtacccgtacg

SEQ ID NO: 219496 - DNA, 834 bp, Homo sapiens
  misc_feature: GYAE6OF01BF9NL.24.87.H10.1.454.CMB.1.raw
  modified_base (210)..(210): a, c, t, g, unknown or other
  misc_feature (210)..(210): n is a, c, g, or t
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtcctccagcccaccctgtctgtcgtctacggaaggggaaancgcccacccgtctccgtgcgagggccagtgactagttggttaggaagtttgtacgcctaggtatacaaacaacaaacgngtcggaccgacggtcccgtaccccggntaccctcactcttaagcgtatcgacctaactacccgaaacgttaccggggaaccctaaccggttcgggtaacccctaaccgttacccccgaaagggtaaacccgttcggggtttacccaaggggttccggggacgttaacgggggttcggggtttaccggtaacgggaaccgttaagttaccctttacgacccgtttccaaccgactacgtactaacggccgtaaggttacgtaacggtaacggttacctaagggttaacgtttacggttttacgtaccgtttttaaagttttacgtttacggttactaccggtaacggtccccgtaacgtaccgaaccgttaacccggttcccggttacccccgttacgggtttaccccggaccgggtttaccggaacccgttacggtaacccgttacgggaaacccttacggtaaccccgaaaggtaaccggttggtcccggtactacccggtaaccctacgttacctttaccggttaccttaccggtttaacccc

SEQ ID NO: 219497 - DNA, 769 bp, Homo sapiens
  misc_feature: GYAE6OF01AP7S4.24.87.H10.1.454.CMB.1.raw
  modified_base (231)..(231): a, c, t, g, unknown or other
  misc_feature (231)..(231): n is a, c, g, or t
  modified_base (739)..(739): a, c, t, g, unknown or other
  misc_feature (739)..(739): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccacgtggaagaagtagtcatgacgcagtctccacgcccaccctgtctgtcgtccgtaccggaaggggaacgccgccaccctctccgngacgacggcaggtagagtaatggttcgacagacaacgttacgccgtacggtaaccagacgaaacgtaaaccgtcggaccgacggcctacccggcggtcccttacccgtcctactacgtcgtcctccgtcccgtacccgaccggtaccgggtcccctcgggttcccggtaccccgtacggtacccggtttcgggttccgggttcgggggtaccggttggggttaccggtacgggttaaccgtaacgttaccgttaccgtaccgttaccgtacccgacctacgttacccgggaccggtccccggtaccgttaccgtcgttaacgtacgtaaaggtttccgtttacgttaaccttttacgtttttaagtttccggtactaaccttacgttaaccgttaggtcgggtcgtttaccggccgttacccgtcgtttacgttccggttaccgaccgggtaacggtaccgtaagtacggaacgttacgaacgtaaaccgtgtaggtccgatccgacncgttctcgtactcctagtcctccgtcctac

SEQ ID NO: 219498 - DNA, 842 bp, Homo sapiens
  misc_feature: GYAE6OF01A9FZH.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagatgccaccggagacattgtgttgacacagtctccagcctacctgtctttgtctccgaggggaaacacgccaccctctcctcgcgacgggccagtgacaatggttaggtagttgttagcctaggtatacaacaacaaactagtcggccgacggccctcccggcctcctctacgttctactgacgtcgactaacgtaccaaacggtacgggaccctacgtacgggacctaccgtaccccgaaggtaccgtaacgggttcgaggttcggacgtaggggttcgggtcggtacggggtaacctacgtaccgtttaccgaccgttaccgtacccgacccgttacgacggtactaccggtaccgttaacggaaccgttcccggtaaaggttaacggttttacggtttttacggtaccgggtttttaacccgttaacggttccggttaaccgtaccggtaccgtcggggtttaccccggtttcccggccccgggtttaccgggtaccccggttaaccgggttttaaccccgggggttttaccgggggggaccgggggggttaaaccccgtagggggggttaaccggaaggggtaaacgggtaaccgggtaaccggtacgggtacgggtacgggtacccgtacggccgtaaacggtcgttacccggttacttttcccgtaccttaaccgtttccccggttccccgtaaccgg

SEQ ID NO: 219499 - DNA, 877 bp, Homo sapiens
  misc_feature: GYAE6OF01AI6EL.24.87.H10.1.454.CMB.1.raw
tcagactactatgtcacgaccggtgctcgatttagcagtactgcgtttgggtttgggggaggaactgctcagttaggacccagacggaaccatggaacgccccagcgcagtccttctcttccctcctgtccttacgtctcggtcctcccgagacttaccacgttgggaacgtaagtacgtcaagtcgacgctacgtcctaccgacgcccacccttgtctcggtcgtaccgtaccggaagggggaaactccgaccctaacccgttcgtccgtacggaccggtaacggggccgtaaggtagggaagtaacggtttcggtacggacaaccgtaccgttaaacgtttaccgtaccgttacggaaaccctaacgaacgtaaccggtccgacgccggtacctaccggcgcccttccgtatacgtttacgtacgtagtacctcgtacccgacgtaacggtaggtccctacggtaccgtccccgtacccgtacggtttaacggtcgtaggggttcccgaacgttggggttaccgggtaacggtacggaaacgttccgttactccccgttagtccggtttacccaggttaaccgcgtaacgtccgtaccgacgtaccggtaccttaaggttcgttaaaccggtttcggtaaccgtttcgtaacggtcctaacggtactccgtccggttccgtaccgtaccgggtccgttaaccgttcggttaacccgggtccgggggtaccgggttacggggtacgggaggtaacggacgggtaaccggttacgggtacgtccggggtacgtacgggaccgttaccgggttaccgtacgtttaccggtttaccgttaccggttacttccccggtacccgtttcccgttactaccgg

SEQ ID NO: 219500 - DNA, 766 bp, Homo sapiens
  misc_feature: GYAE6OF01A0D97.24.87.H10.1.454.CMB.1.raw
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
  modified_base (721)..(721): a, c, t, g, unknown or other
  misc_feature (721)..(721): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctggcctcccagactaccactgggagaagtgtcatgacgcagtccnccacgcccaccctgtctgtgtctccggaagggaacncgcccacctctccgtgccgaggccagtgagagtggtcgnagtactaacgtcgccgtacggtaaccagaccgaacggtaaccgtcggaccgacgccgtaccgcggtcctccctcccgttatcgtcgtcctcgtcccacccgaccggtacccggtcccgttggtacccgtcccgacggtccggtttacgggttcgggttccgggcggggtttcgggtaccggtcggggtaacctaggtttaccctttaccgaccttacccggtaccctaaccaacggttaccggaccggtaccccgttaccgttacccgtacgttacgttaacggttaacgtttacgtttacgttaacctttacttttacgtttaccgttaccgtaactaacctagttacgtgtacgtcgtaccggttacctccgttacctacggttaccgaccggttaaccggaacgtaacggtaacgtacgtaacgtaacgaacggtacggttcgccggtatacggtccctaaccggttntaccgtttacccgtccttacgtacctttccccggtaccgttaccc

SEQ ID NO: 219501 - DNA, 805 bp, Homo sapiens
  misc_feature: GYAE6OF01AOAR1.24.87.H10.1.454.CMB.1.raw
  modified_base (150)..(150): a, c, t, g, unknown or other
  misc_feature (150)..(150): n is a, c, g, or t
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaacgccccagcgcagcttctcttctcctgctactctggctccagataccactgganagtacgtcatgacgnagtctcagccacctgtctgtcgtctaccgagggaacncgccaccctctccgtgcgacgggccagtgacgtaatcggttgacgacggactaaacgttacggaccgttaggtaacccgaggtacgaaccggtaaaaccggttcggcccgaagggtaccccttaccccgaacgggtcccctttcccgttacccttcgtttaagtcggtccttacgtcccttacccggaaccggtccccgggtcccgttacgggtccctaacccggtccggtaccgggttacgggttttccgggttccgggggttcggggtcggttacggtagggtacttacgggtactttccggaccttcgacccacttacgtccggacggtaccggtccttaccgacggttacgtggtaaacgtttacgttttcactttaacgttttacgtttacgtacgttaacgtaaccgtttagtacggtcggttaacggtccttccgggtaccttaccggttaacctttacggggtttaccggaaccgggtaaccgggtaactaacggtggggtaaccttaccgaaccgtaaacgtccggtaggttccggctaacggtcctacttacgtacctttacgtccttaacccgtcttacccgtcccgtaacg

SEQ ID NO: 219502 - DNA, 913 bp, Homo sapiens
  misc_feature: GYAE6OF01CVHUL.24.87.H10.1.454.CMB.1.raw
  modified_base (222)..(222): a, c, t, g, unknown or other
  misc_feature (222)..(222): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagactaccacgtggaacgtaagtagtcaagtgaccgcagtctccgagccctacccgtgtctcgtcgtcctaccggaaggggaaanacgccccaccctctccgtgaccggaacgggccaaggttagaagtaagttcggttacggactacggtaacctaacgtttaccggaccgttacggttaacccgaacgaccgaaaaccggtaaaccggttcggacccgtaaccgggtccctacccccgacggtaccccttaccccgttaccgttacggttaacctaccggttccgttcggtaccccgttaccccgtaacccgggtaaccccggggtccccgtttacgggtcccggttacccccgaaccgggtacccgggtttaaccggggtttccgggtttccgggggttcgggggtttaccgggggttacccggtacggggggtaaaccttaacgggtttacctttaccggtaccttaccccgtacgtaaccgtaccgtaccgtaaccgggtcccggacccttaccggtaacgttccgtaacggtttaacgtttacgtttaacgttaccgtttaactttttacgttaccgtttaccgtaacgtaaccgttaccgttaaggtccgtacggttaccgttaccggtaccccgttaaccgtaaccggtttccgtttacgggaccggtaaccgggtaacctaaggtcgaaacgtacgtacggaaacgtgtaccggtacgactactaacgccgtactgtaccgttacgtacctcgtccgtacccgtacg

SEQ ID NO: 219503 - DNA, 781 bp, Homo sapiens
  misc_feature: GYAE6OF01EK0KJ.24.87.H10.1.454.CMB.1.raw
  modified_base (264)..(264): a, c, t, g, unknown or other
  misc_feature (264)..(264): n is a, c, g, or t
tcagactactatgtcacgaccggtgctcgatttagcagtactgcgttgggtttgggggaggaactgctcagttagacccagacggaaccagtggaagccccagcgcagcttctcttcctcctgctactctcggcctcccagactacctacgtggaacgtaaggttacgtcgaatcgaccgcacgtcctccacgcccaccgtgtctgtcgtctaccgaaggggaacacgccctaccctctcctgcgacggcagtgaagagtgtgnacgactactacgcctaggaaccaggtaccaaacgtaaccgcggaccacggtccctcccgaggtcccctccccgttctacgttacgtcgtccgtcgttacccgtcccgaaccgtcccgggcccgttccgggttaccgtccccggaaccggtccgttaggggtttccgggtccgggtacggggttccgggttaacggacggggtacttacggttcctttaacgtacccttcttaccaaccgtacgtcgacccgggtacctcctacggtactacgtaacgttactttagtttcgtactttacgttttcttacgtcctaaccgtattacgtagttccgggtaacttccgttaccggtccttacccgtttacgttaccgtttaccgggaccggtaaaccggtaacctaaccgtaaggtaccgtaacgtaaacctaaacggaccgttggtaccgaggtttaaccccccggttaactttaacggtcctttaccgtaacttccccgttcttccccctccgtaaac

SEQ ID NO: 219504 - DNA, 653 bp, Homo sapiens
  misc_feature: GYAE6OF01EK7US.24.87.H10.1.454.CMB.1.raw
  modified_base (190)..(190): a, c, t, g, unknown or other
  misc_feature (190)..(190): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (285)..(285): a, c, t, g, unknown or other
  misc_feature (285)..(285): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtatcatgacgcagtctccagcccaccctgtctgtntctccgaggggaancgccaccctctcctgcgnggccagtganatgtgcngcatgctggtacagacagaacctggcaggctccgagtcctcctctntgtcgtctcgtctcccgacgaccggtcccgtggtacgcccacgtccgtaggttcgtcggcggttggtcgtggactagtcttacgctctacgactcgcgacggtccacctccgtattcggtaagtactttaggtttctaacctttacgttttactttacggtacttaacgtaacccgtagttacggttcgtaccgtaccgtttccgggtcccttacccgggttctttacccgggtttaggacccgggtaacgggtaaaccctacggtagtaacgtaacgtaaccaaacggttacgtcggtaacggtactctaacccgtacctcgtttccgtactttaccctccgttaacgttcccctaccccggttaac

SEQ ID NO: 219505 - DNA, 759 bp, Homo sapiens
  misc_feature: GYAE6OF01A5AVR.24.87.H10.1.454.CMB.1.raw
  modified_base (161)..(161): a, c, t, g, unknown or other
  misc_feature (161)..(161): n is a, c, g, or t
  modified_base (169)..(169): a, c, t, g, unknown or other
  misc_feature (169)..(169): n is a, c, g, or t
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (399)..(399): a, c, t, g, unknown or other
  misc_feature (399)..(399): n is a, c, g, or t
tcagactactatgtcacgaccggtgctcgatttagcagtactgcgttgggtttgggggaggaactgctcagttaggacccagacggaaccatggaacgccccagcgcagcttcctcttcctcctgctactctggctccagactaccagtggagaagtagtnagtgacgnagtcctcacgccctacctgtctgtcgtcgccggagggaacncgcctaccgtctccgngcgacggcagngagtagtcgngcagactacgtcncgtcgacagacgaacgaccgcgacgacgcctacgacgtccttccgtctactacgcgtccgtacttcccgaccgaccggtaccggtccgtgtcccggtaccgcggtaccggttgggtcggtcggggtcggtcggtacggnggtaactacgtttcgttaccgcctcacccgtacgtacgtcccgtcggacccggttcctacgtacggtacgttaaccgtacggtttttaacttccgtttaacctttacgtttttaccgttacgtaacgtttaaccgaacgtttacgttcggttaccggtacggtttacctaaccgggtttccccgttaacggttaacctttacccggggaaccgttaaccgggggaccgtaaacgtacggtaacggtaaccttaacgtaaacccgggtattaacgggttcccgtgggtacccgaacgttccgtaaccgtggttaccctttaacggtccctaaacgggtttccccaccccgtttcgtaaccg

SEQ ID NO: 219506 - DNA, 861 bp, Homo sapiens
  misc_feature: GYAE6OF01CFRF6.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggaaagaagtagtcatgacgcagtctccagccaccctgtctgtgtctccgaggggaaancgccaccctctcctgcgacgggccagtgagtaagttggttaggcagactaacttacgccgtggtaaccaggtacaaacgtaaccgtcggaccgacggtccctacccggacggtccccttcccctccttaccgttagttccgcctttccggtacccgttacccgaacccggtcccgggtccccgttacgggttccccgaccccgtaccggtacccggttacgggtttccgggttacggggtccgggttcgggttcgtacggggtaacctacgttaccctttcgaccttcccgtccgtaacccgttcgaccgaccgtaccggtaccgtaacgtacccggtaaccttaagggttaacgttttacggttttaccggtttacccggttttaacgaacggttccgtaaccgtacgggtccgttaaccgggttcccccggttcccggttccggtacccgggttaaccccgtttacccgggttttaaccccgggggtttccgggggggggaacccgggggtaaccgggttaggggggttaaccgggaaggggtaaaccgggtcgtaaaaccggggtcgtacgggtccggtaccgtacgtcccgtaactttccggtcctttcgtcctttcgtaccttccccgtacccgtactacggtctaaacgg

SEQ ID NO: 219507 - DNA, 842 bp, Homo sapiens
  misc_feature: GYAE6OF01DFK3S.24.87.H10.1.454.CMB.1.raw
  modified_base (228)..(228): a, c, t, g, unknown or other
  misc_feature (228)..(228): n is a, c, g, or t
tcagactactatgtcacgaccggtgctcgatttagcagtactgcgttgggttgggggagaactgctcagttaggacccagacggaaccatggaacgccccagcgccagcttctcttcctcctgcttactctggcctcccagataccacgtggagtaagtagtcatgacgcagtctccagcccacccgtgtctgtgtaccgtccgagggggaaatacgccctacccttntccgtgccgtacggcctagtgacgattcggttggcgagtactacttaggccgttacggtaccagtacgacgtaaaacccgtggaccaacggtcctaccgagtcctcctcctacgtagcgtctacgtacctcccgacccgaccgggtcccgttggtcccgtacccgacgtcccggtaaggggtttcccgtaggggttcgggttcggggtaccgtaggggtaacctgggttactttaccggacttaccgtaccaaccgtacgttccacgggtccgtaacccgttaccgtaccgtacgtacggttaacgttaacgtttggttaacctttaacgttttacgtttaccgttcgttaaccgtaaccgttaccgttaagggtttaccgggttacggttacgggttcccggttaccgtttaccccggttaacggttaaccgtttttaccgggggacccggtaaccgggggtaaacctaaccgggttacggtaaacggtaaccgttaacgaaaacccgggttacgtacggttaccgggtaaccgttacggtaacccgtacccgttaacgtttccgttacggttacccttacttaacccgtttcccgtaccccccgggtttaac

SEQ ID NO: 219508 - DNA, 773 bp, Homo sapiens
  misc_feature: GYAE6OF01C52HY.24.87.H10.1.454.CMB.1.raw
  modified_base (174)..(174): a, c, t, g, unknown or other
  misc_feature (174)..(174): n is a, c, g, or t
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
tcagactactatgtcacgaccggtgctcgatttagcagtactgcggttggggtttgggggaggaactgctcagttaggacccagacggaaccatggaagccccagcgcagcttctcttcctcctgctactctggcctccagataccactgggagaagtagtcatgacgcagtcnccagccacccgtgtctggtcgtactacggaagggggaaancgacctacctctcctgaccggacgggacctaggngaaggtaatcgggttagacgtaacgaccgtaaacgtacggtaccgtacgggtaacccgaaggacgaaacggaaacccgtggggacccgaacggggtccctacccgtacggccccttccccttacctacgtactcgtcgttccgtaacctccccggaacggtacccggcccttacgggtcggaacccctggtccgttacgggttacggtcgggtcggggtacggtcggtagggacgttaagtcgttacacgtctactaccgagtccgacgttccggaccttcggacgttagaacggtaacgttagttacgtacttttacttaacgttcgttaactaaccgtacgtacttaggtacggtacgtagtacccgtccgttaaccggtaccttaccggtttaccggaagggtaaccggtaaactaacggacgtacgtaccgtaacgaaaccggttagccggtcgtaaccgtacggaccttaaccgttacggtcgtttaaccgtacttaaccgttcccttaccgttaccgac

SEQ ID NO: 219509 - DNA, 1032 bp, Homo sapiens
  misc_feature: GYAE6OF01CR771.24.87.H10.1.454.CMB.1.raw
tcagactactatgtcacgaccggtgctcgatttagcagtactgcgttgggtttgggggaggaactgctcagttaggacccagacggaaccatggaacgccccagcgcagccttctcttccctcctgccttactcgtcggcctcccaagtactacccacgtagggaacgtaaggtagtaccagtcggaaccgcaacgttcctacccaacgcccctacccttgttcctggttcgtacccgtaccggaaagggggaaaacaacgccccctaaccccttccgtacccgacggccggaacggggtccctaaggtacggaagttaacgttcgggtttagggaccctaacgacccttaaaccggtttacgtacccgttaacgggttaacccaaacgggtacctaaaccggtaaaaccccggttccgggaaccccgaagggtaccccttacccccggaaacggtcccccttaccccgttacccttccgttaacgttccggtacccgttaccggttaccccgtaccccggtaaccccgggtaccgggtttccccccgttaacggggtttcccccggtaaccccgtaccggtaacccccgggtttaacggggttttcccggggttaccgggggggtacccggtttacgggggggtacccggtaaccggggggtaacccttaaacggggttttaccctttacccggacccgttttacccaacccgttaacccgaagttaccccggaccgggtacccgtacccttaacccgtacgggttacctaacgggtttaacttacgtttacgttaaccgttacttttaccgtttcgttacgttaacctaactacgttcgttacggtacgttaccgtaccgttcccgttacccgttacgttaacccgggtttccgggaacggtaacggtaaccgtaacgttcggaaactaccgtaaacggtaaccgtcggttaacgcgggttacctacgggaaccctaacggttccgttacttacctaccgttacccttccgtccccgttcccttaacccg

SEQ ID NO: 219510 - DNA, 820 bp, Homo sapiens
  misc_feature: GYAE6OF01BHXZ2.24.87.H10.1.454.CMB.1.raw
  modified_base (424)..(424): a, c, t, g, unknown or other
  misc_feature (424)..(424): n is a, c, g, or t
  modified_base (552)..(552): a, c, t, g, unknown or other
  misc_feature (552)..(552): n is a, c, g, or t
  modified_base (563)..(563): a, c, t, g, unknown or other
  misc_feature (563)..(563): n is a, c, g, or t
  modified_base (588)..(588): a, c, t, g, unknown or other
  misc_feature (588)..(588): n is a, c, g, or t
  modified_base (660)..(660): a, c, t, g, unknown or other
  misc_feature (660)..(660): n is a, c, g, or t
tcagactactatgtcacgaccggtgctcgatttagcagtactgcgttgggtttgggggaggaactgctcagttaggacccagacggaaccagtggaagccccagcgcagcttctcttcctcctgctactcgtcggcctcccagactacccgactagggaagaaaggttacgttacgaacgttcggaacccggctaacggttccctacccgaaccggtcccctaaccccgttggttccttacggttcggtacccgtaacggggaaacgggggtaaaaccacccggtacccctaacccctttccgtaccccggttggaccggaacgggggtccctaaagggtacggtaaacggtagttacggttcgggaccaacgttaccgtaacgttacgaccccggtaggtacccaaggtaacaacggtaaccncgggtaccacgcctaccggtcgcctacccgttccttagtacgtcgtcctaccgtaccctccgaccggccggttccgtacgtcccgtccgtaccggtcggttacgggtcggttacgggcgggtttacgnggttaaccggntacgtcttacgctacctcacgtacnccggtacctccgactcgagttaccgagttaagtcttttacgactttagtttacttctacgtactatcggtanccgggtatccgtacgttaccgttaccgtacgtttaacccggcggtaaccggaccggtaaagaccggttaggaaaccttacgaacccgtaaggtacgtccgccggttacgacgacccgttaccgtacttcgttccgtacgttccctcttcccgtcgtaccg

SEQ ID NO: 219511 - DNA, 825 bp, Homo sapiens
  misc_feature: GYAE6OF01B9P34.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggcctcccagataccacgtggagaagtagtcatgacgcagtctccacgcccaccctgtctgtcgtctaccggaaggggaaacgcgccctaccctcctccgtcgcgacgggccgaggtaggaagtaacgtggttcggacacggacctaacttacggtccgtacggttaacccagacgaaacgaaacccgtcggacccgacggcctacccgacggtcctcctcctctagtcgtcctgtcccctccaccggaccgggtccccgttgggtaccgtccccgacggtccgtacgggtttccggtcggggtacggttcggggttacgtacggggtactacggttactttcgtaccttaccgtaccctaaccgtactacccggaacggtccccgtcccgttaccgaggtttacccgtagtaaacgtttacgttttcgtaacgttttacttttaacgtttccgttaccgttaactaacctaacgtttagtacggttctacggttccggtacccctttaccggttacgttacccggtttaccgggacccggtaaccgggttaaacccgtaacggtacgtaaacggtaaccgttaaaccgtaaacgggtaccgttaggggttaccgaccgggttaaccacccgtaaaccgtttcgttacccttcgggttacccttcttacccggttcccctttaccccgtaacccg

SEQ ID NO: 219512 - DNA, 828 bp, Homo sapiens
  misc_feature: GYAE6OF01AZCXA.24.87.H10.1.454.CMB.1.raw
  modified_base (244)..(244): a, c, t, g, unknown or other
  misc_feature (244)..(244): n is a, c, g, or t
  modified_base (794)..(794): a, c, t, g, unknown or other
  misc_feature (794)..(794): n is a, c, g, or t
  modified_base (800)..(800): a, c, t, g, unknown or other
  misc_feature (800)..(800): n is a, c, g, or t
  modified_base (805)..(805): a, c, t, g, unknown or other
  misc_feature (805)..(805): n is a, c, g, or t
tcagactactatgtcacgaccggtgctcgatttagcagtactgcgttgggtttgggggaggaacgtgctcagttaggacccagacggaaccatggaagccccagcgcagcttctcttcctcctgctactcgtggcctcccgagactaccactgggaagtaagtacgtcaagtggaccgcgtagttcctaccacgcccctacccgtggttcctacggttcgtaccgtaccgggaaggggaaaacnccggtacccctaccccgttccgtacccgtggaccgtacggggacctaggtaggtaagtaaacggtttcgggttacggacctacggtacgttaaaaccgttacggtacccgttagggtaaccctaaggaacctaaaccggtaaacccggttcggacccgacggtaccccaccccggaacggttcccttcccccgtacgttacgtcgttccgtcccgttacgtacccccgtaaccgtacccgggtacccgggtccctttagggtaccccgttaccccgaaggtaccgttccgggttcgggttccgggggacgttcgggttaccgaggtaactggttaccttcgtaccgtccaccgtacctagacccggtaccggtaccgtccgtaccgtacgttacggtaagttaacgttagtttaccgtaactttaccgtttagttactaccggtactaaccgttgtacgtcgtacgtacgttccgttacctacgttacggttacgttcgggaacgtaacggactacgtaggaactgaaacctagtacgtggccgtagacnctacgntttcncgttactctactccgtcctaacg

SEQ ID NO: 219513 - DNA, 1005 bp, Homo sapiens
  misc_feature: GYAE6OF01BHWVJ.24.87.H10.1.454.CMB.1.raw
  modified_base (97)..(97): a, c, t, g, unknown or other
  misc_feature (97)..(97): n is a, c, g, or t
tcagactactatgtcacgaccggtgctcgatttagcagtactgcgttgggtttgggggaggaactgctcagttaggacccagacggaaccatggaanccccagcgcagcttcgtcttcctcctgcctactctcggcctcccagacttacccacgtggaacgtaaggtagtactaacgtttacggacaggttcctcccgaacgtcccctaacccgttggtcctggttcggtacccgtaccggaaagggggaaacgaccgtcccctaaccccgttcgtcccgtaggaccgtaacggggtaccctagggttacgaaacggttaagtttcggggttaccggaccgtaacggtaacccttaaaacccggtttcggtacccggttaacgggtaaccccgaacggtaaccggtaaaccggtaaaaccccggtcgggaaccccgtaaccggggtacccttacccccgggaggttccccgttacccccgttccgttaagtccggttacgtcccttaccggttacccccgtaacccggtaacccggttaccccggggttcccttaacgggtaccccgacccccggttaagggttaccccgggttttaacgggttttcccggggtacgggggtccggggtttccgggttaccgggtaacggggtaacccgttacgtttacccgtttcctaacccgttccgttaaaccccgacgttaccgtaaccggtaccggtcccccggttacttaacccggttagtaacccggtttaaggtttaaaccgtttacgttttaacgtaccgttttaaacggtttttcctacgtacgtttaacccagttaaccgttcgggttcgaccgttacccggttccgttacccgttaacggtttcgtttaccgggttaccgacgggtaaaccgtaccgtaagtcggaactaacgtaacgaacgtacgttcggactccgaaccttactacgttaccgtagtacccgttatcccgttacctaccggctacgtaccg

SEQ ID NO: 219514 - DNA, 838 bp, Homo sapiens
  misc_feature: GYAE6OF01B2LU7.24.87.H10.1.454.CMB.1.raw
  modified_base (125)..(125): a, c, t, g, unknown or other
  misc_feature (125)..(125): n is a, c, g, or t
  modified_base (179)..(179): a, c, t, g, unknown or other
  misc_feature (179)..(179): n is a, c, g, or t
  modified_base (802)..(802): a, c, t, g, unknown or other
  misc_feature (802)..(802): n is a, c, g, or t
  modified_base (813)..(813): a, c, t, g, unknown or other
  misc_feature (813)..(813): n is a, c, g, or t
tcagactactatgtcacgaccggtgctcgatttagcagtactgcgtttggggtttgggggaggaactgctcagttaggacccagacggaaccatggaagccccagcgcagcttctcttcctcctnccttactctgcctacccagatacccactgggaagaagtagtcagtgaccgacgngttacctcccacgcccctaccccgttgttccgtttcggttcgtacccgtaacccgggaaaggggggtaaaaccgacccgtaccccctaaccccgttcccttcccggtggaccggaccggggaccctaaggtaggtaaacggtaaggttcgggttacggaccaacggtacctaaggtttccgaccggtaacggtaccgacgaccgaaaccgtaaccggccggaccgaccgcccgtaccccggagtcccctcccttccgtactcgtcgtccgtccgtccaccccgaccggtcccgggtcccgtcggtacccgtcccggtacgtccggttcgggtttccggtcggggtcgggttacggggtcggaacggtaccgtacggtttcctttaccgtaccgttctaccccgtataccgtaccgtaccggcccgtacccgtaccggtcgttacgttacggtaagttttcgttaccgtttactttacgttttaccttaccgttactaaccttaccgtagtacgtttcggtaccgtacggttccgtacccttcggttaaccgtttcggtaaccggccggtaacgaacgtacgtagacgtaaactaccgaacgtacgtcggtcctacggactccncgttcgccttntaccttccctcttccccgtcgtacc

SEQ ID NO: 219515 - DNA, 688 bp, Homo sapiens
  misc_feature: GYAE6OF01B9YBM.24.87.H10.1.454.CMB.1.raw
  modified_base (216)..(216): a, c, t, g, unknown or other
  misc_feature (216)..(216): n is a, c, g, or t
  modified_base (415)..(415): a, c, t, g, unknown or other
  misc_feature (415)..(415): n is a, c, g, or t
  modified_base (469)..(469): a, c, t, g, unknown or other
  misc_feature (469)..(469): n is a, c, g, or t
tcagactactatgtcacgaccggtgctcgatttagcagtactgcggttgggtttgggggaggaactgctcagttaggacccagacggaaccatggaagccccagcgcagcttctcttcctctgctctctggctccagactaccagtggaagagtagtcatgacgctacgtctaccgacgccctacctgtctgttacgtccgacggaaggggaaacnccgccctaccctcgtcgtcgacgtacggctaggtacgagtaagtggtacgatacgtactaacgttcgacgtacggtaccgagtacggaacgtaaccgtcggaccgacggtccctccgagtccctcctactgtactcgtccttccggccctaccgaccggtacggccctaggtcctccgacggttccgtagggttccggnggggtccgggttagccggtaacggcttaggtaactttccgaactccgtaacccntacgcgtaccgtctacctacgtacgtctagttacgttgttacgtactttacgtttacttgtaccgtataacgttacgtagtgtctacgtccgttacgttactacgttccgtacggtaccggaacggtacgtaggacgtaacggactaacggtaaacgtggtaccgtcggtacacgtctacctacgttctccgttattaccgtaccttccgtcccgtacg

SEQ ID NO: 219516 - DNA, 703 bp, Homo sapiens
  misc_feature: GYAE6OF01C0UEU.24.87.H10.1.454.CMB.1.raw
  modified_base (195)..(195): a, c, t, g, unknown or other
  misc_feature (195)..(195): n is a, c, g, or t
  modified_base (463)..(463): a, c, t, g, unknown or other
  misc_feature (463)..(463): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctggcctcccagatacccactggagaagtagtcatgacgcagtctccagcccacctgtctgtgtcncgagggaaaccgccaccctctccgtgcgacgggtccaggccggtagttgttaagtaacttacgttaggctacggtaaccaaagaacgtaaacccgtggacccgaggtaccctcccgaggtcctcctacattctaatgacttcgtcctaccgaacgcgggttaccacgtcgggtcccgtccccgacgttaacgggttcacggttcggcgtacgggttgggaccgttacgggaaccgtagttaccttacgtaccgtcctaccgaaccgtnaacgtccgacgtcccgtagaacgtcctaggtaagtttagtttcggtaccgttttaacgctcgtaccaggtactcggtccctccggccgttaggtcccgtacgtttacgggttcccggggacgggggtacctagggggtgaacggacggaacgtacgtacgttggtcgcttacggaccctacgtacgttcgttcgtccttaccgtacttcccggtacccacgttactcggttagtaaaccg

SEQ ID NO: 219517 - DNA, 799 bp, Homo sapiens
  misc_feature: GYAE6OF01CK18A.24.87.H10.1.454.CMB.1.raw
tcagactactatgtcacgaccggtgctcgatttagcagtactgcgttgggtttgggggaggaactgctcagttaggacccagacggaaccatggaagtcccagcgcagcttctcttcctcctgctactctcggcctccagactaccactggaagaagtagtcagtgacgcagtctccacgtcccacctgtcgtgtcgtccgtaccggaggggaaacgcgaccctacccttctccgtgccgaacggggccaaggtacggaagtaagtggttacggacagacctaacgttacgccgttaacggtaaccacgaccgaagtaaacccggtcggaccgacggtcctcccggacggtcctaccctccgttaactgtcgtccttccggttaccaccccgacggtacccggtcccgtcggtacccgtccgacggtcgttacgggttcggtcggggtacgggttcggtacggacggggtaacctaaggtttccttaccaaccgttcctaccgtaacgtaagttccggaaccggtccgtaacccgtcgtaacgttcgtaacgtaagttcgtttacgtactttacttttacttcgtaaccttaagaaacctcgtacgttaacgggtcgttacgaccggttcccgttaaccgtaaccggttttaccggttacccgggaccgggttaaacggaaacccgtttaacgggtctaaacgggtccttaaccggaaaacgtcgggttaacggtcggtcctacgtacccgaactggttttacgccgtttaactcccttaccggtcccgttccgtaacc

SEQ ID NO: 219518 - DNA, 874 bp, Homo sapiens
  misc_feature: GYAE6OF01APUYN.24.87.H10.1.454.CMB.1.raw
tcagactactatgtcacgaccggtgctcgatttagcagtactgcgttggggtttgggggaggaactgctcagttaggacccagacggaaccatggaacgccccagcgcagcttctcttcctcctgctactctggcctcccagactaccacgtggagtaagtagtcagtgacgctagtcctccacgtccctacctgttccgtgtcgtccgtacggaaggggaacgccgccctacccttccgtccgtcgaccggacgggcctaggtacggaagtagttcgggttacggacgtacggtaccttaaccgttacggtccggttaacggtaccgaacggtaccgaaaccggaaccgtcggaccgacggcccgtaccggaccgttcctcccgtccttctacggtctccgtccgttacccgacccgtaccggcccgggttacccgtcggtccgaccgtacggtccggttacggggttcgtcgggggtacggtcgggttacggtacggacttacgttacgttcctaccgttccgtacctacgtacgttcccgacggttcccgaccgtttcgtacgttacgtacgttacgtttcgtttaccgtacgttttaccttacgtttacggtacctttaccgttaacgttacgtttcggttacggttaaccttaccggtcccggtttaccctttaccggttaacccgtttcgggtaacccgggttacccggtaaacgggtaccccgtaagggtaccggttaaagaacccgggtttaaacgaacccggttacgtacgggttaccgtaccgtacccggtaacctttacccgttccgttacccgttaccggtttacccttaccgttccccgtttacccgtcccccgttaacgg

SEQ ID NO: 219519 - DNA, 876 bp, Homo sapiens
  misc_feature: GYAE6OF01D32OV.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggaccagacggaaccatggaagccccagcgcagcttctcttcctcctgctactctggctccagactaccactggagaagtagtcatgacgcagtctcagccacctgtctgtgtctaccgaaggggaacncgccctacctctccgtggcgacgggccaggtgaagtaagttcggttacggacaacgtactaaacgttacggtccgttacggtaaccgaacgacgtaaacgtaaaacccggtcggaccgacggtccctacccgacggtccttccccgttcctccttagtcgtccgttcgtccctacccgaaccggaccggggtccccttagggttcccgtaccccgtacggtacccgttacggggttttccggttcgggggtcgggtttcggggtcggtacggggtaaccgtacggtttacctttaccgaccgttaccgtacccaaccgtacgttacccggaccggtcccggtacccgttaccgtacggttaccgtttaagggtaacggtttacgttttaaccgttacctttaacgtttttacttttacggttacgttaaccttaaaccgttacgtttacgttacggtccggttacgttccggttaccgttaaccgttaccgtttaacgggttttaccgggtaacccgggtaacggggaacccttaaacgggttcgggaacgttaaacccgtaacggttaaaaacccggtacgtttaacgggtcggttaccggtaccgtaccgtaacgtaccgtttccgtacggtttaccccttacgtttacccgttccccgtttcccgaaccg

SEQ ID NO: 219520 - DNA, 1035 bp, Homo sapiens
  misc_feature: GYAE6OF01A9LXH.24.87.H10.1.454.CMB.1.raw
  modified_base (213)..(213): a, c, t, g, unknown or other
  misc_feature (213)..(213): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagactaccactggagaagtagtcatgacgcagtctccagccctaccgtgtcgtgtcgtccgtacgaaggggaacncgacccacccttcgtccgtgaccgtacggggcctaggtggtaaacgtaagttggttcggaaccgtacgtaccgttaaaccgttacggacccgttacggaacccctaaggaacctaaaccggtaaaacccggtccggaacccgtaaccgggtcccctaccccggaaccggttccccttccccgttaccctacgtttaaccgtcggtaccttccggtaccctacccccggtaacccggcccgggttccccgttccgggtaccgtacccccgtaggtacccgggtttcgggtttcgggttccggggtacggggttcggggttaccggtacgggggaaccgtttaggttacctttaccgggtaaccttccgtaacccgaccgtacgtacccgggtcggtaccccggtacccgttacccgttagggtttaaccgtaacggttaacgtttttacgttttacgttaacccgttttaacgttttttaaccgttccggtttaacctttaaccgtaaacccgttttaacgtttacgggtttacggtcccgttttaacccgggtccccggtttaaccccggttttacccggtttaaaccccggtttttaccggggtttaacccgggggtaaacccgggtttaaaacccggggttaaaacccggtaagggttaacccgggggttaaacctttaaaaccggtaaacccgggtaaaacccgggtttacggttaacggggccgttaacccggttaccgaaccggtttaacctttcccggtaccgttttacctaccccggtttaacttaccccggttttcccgtcccgggtttaaacc

SEQ ID NO: 219521 - DNA, 939 bp, Homo sapiens
  misc_feature: GYAE6OF01DR5MF.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctccttcctcctgctactctggctcccagataccactggagaagtagtcatgacgcagtctccacgcccacctgtctgtcgtctccgaagggaaagcgcccaccctctccgtgcgacggccaggtgaagtagtggttgcgtagacctaaacgttgaccgttacggtaccagaccgaaccgtaaacccgtcggacccgtaccggacccttaccccggacggtccccttccccttcccgtcgttaacgtccgtccttccggttccctaccccgaacccggtacccggggtccccgtttacgggttcccgtaaccccggaccggtacccggttacggggttttcgggtttccgggggcggggtttaccggggtcggtaacggggtaaccttagggtttaccctttaccgtccttacccgtaccgtaacccgtacttacccgggtaccggtaccccgttaccccgtaccttaccgggtttaccgtaaagttaaccgtttaggtttttaccgttaaaccgttttaccgtttttaaacgtttcccgttaacggtaaacctaaccgtttaccgttagggttaccgggtttccggtaaaccgtttcccgggttaaccccgtttacccgggttttaaccgtttaccgggttttacccgggaacccggtaaaccggggtaaacccttaaagggtaccggtaaacgttaaaccgtaaacggtaaaacccgtacgggtttaggtaccggttacgtacccgtaacccgtaacccggttcctttaaccgtttccggttaacccgtttaccctttaccccttccccgttacccgttaaacccc

SEQ ID NO: 219522 - DNA, 730 bp, Homo sapiens
  misc_feature: GYAE6OF01A43SM.24.87.H10.1.454.CMB.1.raw
  modified_base (172)..(172): a, c, t, g, unknown or other
  misc_feature (172)..(172): n is a, c, g, or t
  modified_base (204)..(204): a, c, t, g, unknown or other
  misc_feature (204)..(204): n is a, c, g, or t
  modified_base (348)..(348): a, c, t, g, unknown or other
  misc_feature (348)..(348): n is a, c, g, or t
  modified_base (401)..(401): a, c, t, g, unknown or other
  misc_feature (401)..(401): n is a, c, g, or t
  modified_base (665)..(665): a, c, t, g, unknown or other
  misc_feature (665)..(665): n is a, c, g, or t
  modified_base (711)..(711): a, c, t, g, unknown or other
  misc_feature (711)..(711): n is a, c, g, or t
  modified_base (722)..(722): a, c, t, g, unknown or other
  misc_feature (722)..(722): n is a, c, g, or t
tcagactactatgtcacgaccggtgctcgatttagcagtactgcgttgggtttggggagagctgctcagttaggacccagagggaaccatcggaaaccccagcgcagcttctcttcctcctgctactctggcctccagccatccgaccggagtaattgtgttgacgcagtcnccgaggcacctgttactttcgctacgaggganacgacgccctacctcgtccgtgaccgacgggcctagtcgagtagtcgtacgcagcacgtcttagtacgcgtacgtaccaggcaacggtaactcggtccgtcggcctaccggtacggcctcctactacgttagtacgtcggtacncccgtaccgaccgtagggacctcggtcggaccgtcggacggtcgtagttacgnggtccgtggtacggtcgttacggttacggactaacggtccttaccgacttacgtacctagtaccgtacggccggtaaactacgggttaccgaaggtacccgggtaccgtttaagttcgtttgaacgttacgtagtttaaccgtgaaccgttcggacgttttccgtttcggtttcccgaacccttccgtttcgttaaccgttagtactttacccgggtttcgtaacccggtcggttaaccgggtctacgggttacgtacgggtanaaccgtttacgggactaccgggttacgtaccggggtcttaacccgnttacccggttnttaaccgg

SEQ ID NO: 219523 - DNA, 752 bp, Homo sapiens
  misc_feature: GYAE6OF01COJ09.24.87.H10.1.454.CMB.1.raw
  modified_base (212)..(212): a, c, t, g, unknown or other
  misc_feature (212)..(212): n is a, c, g, or t
  modified_base (357)..(357): a, c, t, g, unknown or other
  misc_feature (357)..(357): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggcctccagccatcaccggaggtaattgtagttgacgctagtcctccaggccacccgttgttctttcgtctccgagggganacgacgcccacctcgtccgtagcgacggggtccaggtcagtacgtgttagcaggtaccagtcctagttcgccgttcggtacagactaacgaaccgtggcctacggcctacccgaggtcctcctacgtacttcgttaggcggttcncccgtaccgtaccggaccggtacccgtaggttccggccggttacggaccggtaacggttacggttccgaggttccggaggttaccggttcgggtcgtttacgggacttacggtacctacgcgttctacgtacttacgacgttccgaacggtacgtacggcgggtaaccgtaaccggagtttaacgttccgaacggttgtttaacgttacgttacggtgtacgtacttccggttttacgttcccgttacccttcccgtttcctaacgttaccttacggtttaacccttcggtttacccgggaccggttacgggttaccgtagggttacgggtacgttaacgtacggtaccggtactaccgggttactacgggacttaccacggttccacgtttccg

SEQ ID NO: 219524 - DNA, 898 bp, Homo sapiens
  misc_feature: GYAE6OF01BVK9D.24.87.H10.1.454.CMB.1.raw
  modified_base (210)..(210): a, c, t, g, unknown or other
  misc_feature (210)..(210): n is a, c, g, or t
tcagactactatgtcacgaccggtgctcgatttagcagtactgcgttgggtttgggggaggaactgctcagttagggacccagacggaaccatggaacgccccagcgcagcttctcttcctcctgcctactctggctcccagactaccactggacgaagtggtcatgacgcagtctccagcccacctgtctgtgtctccgaaggggaaangcccacctctcctgcagggccagtgagtaatggttggcagactaacgttcgcctcggtaccagaccgaacgaaacccgtggacccgacggtcctacccgacggtccttccctacctcgtaacgtcgtccttcggtcccttccgaccgtaccgggtcccccgttagggtcccgtcccaacggtccgttaacgggttccggttcggggtccgggttcggggttccgtagggggtaacctacggttacgttttacccaaccgttcccgttacctaaccccgtaagtttccccgaacggtcccggtaccccttaccgtaaccgttaccgttaggttaaacggttacggtttttacggaaccctttaacgttttttacgtttaccgtttacgggttaaccttaaacccgttaccgtttaaggttacgggttaccgttaaccggttcccgggttacccctttacccgggttaaaccgttttcccgggttttaaccgggaaccccgggttaacggggtaaacccgtaacgggttacgggtaaccgttaaacgtaaacccgggtaaaaccgttaccgggtttacgggtccgggttaacccttacgggacccgttaaccccgggttatttaaccccgtttccggttttaaccgtttaccccgtacccgttttccccggttacccccggtttaacccg

SEQ ID NO: 219525 - DNA, 655 bp, Homo sapiens
  misc_feature: GYAE6OF01AE8W8.24.87.H10.1.454.CMB.1.raw
  modified_base (206)..(206): a, c, t, g, unknown or other
  misc_feature (206)..(206): n is a, c, g, or t
  modified_base (620)..(620): a, c, t, g, unknown or other
  misc_feature (620)..(620): n is a, c, g, or t
  modified_base (632)..(632): a, c, t, g, unknown or other
  misc_feature (632)..(632): n is a, c, g, or t
  modified_base (641)..(641): a, c, t, g, unknown or other
  misc_feature (641)..(641): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccacgccaccctgtctgtgtctccgaaggggaaanacgccaccctctccgtgccgagggccaggtgagaatggttggcagcctaacttacgccgttggtacccagtccaagaaaccgtggccgaggcctccaggcctcctccgtctatcgctacgtcctccaccgacgggcccctgggtctcccgagccgtacgggttcgttcgggtacgggtgggttcgtcggggtaacagggtaactttccgaacgttcgtacccgtaaccacttcgaacggccggtacccctccggtacgtccgtaggtaaacgttcgttttacgtactttaacgttttactttaccgtacgtacctaaactacttacggtggtactaccggtcgtccgttacccgtagttccgtttacggccggaacggtacaacggtagagtaacacgaaacgtcgtagcggtnaccggcaacctnctcgtctcncgttcctccgtacg

SEQ ID NO: 219526 - DNA, 719 bp, Homo sapiens
  misc_feature: GYAE6OF01EH1YU.24.87.H10.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (639)..(639): a, c, t, g, unknown or other
  misc_feature (639)..(639): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctggctcccagactaccactggagaagtagtcatgacgcagtctccagccacctgtctgtgtcnccgagggaancgcccacctctctgcgaggccagtgagtactgtcgcagactaacgttcgcctaggtaccagacaacggaaccgtcggaccacggtccctccgaacggtccttccccgtaccttacgtacgtccgtcgttccgtccctacccggaccggtaccgggtaccccgtgggttcccgtacccgtacgttacccgggttagggtttccggttggggtcggttcggggttacggtacgggaactacggtttaaccttctaactccgtaccacgttacgtacgacggtcccggtaccttaccggtaacgttcgaaggttaacgttttctttacgtacctttaacgttttacttccgtacttaccgtaacgttacgttgtaccggttctaccggttccgtaccgtaccgttactaccgggttacgaccggtacgtaaacctaggngtaacgaaccgtaacgtaaaccgtagttcggtcgacgtacacctactcttacgttcctccttaacgtccttcccgtccgc

SEQ ID NO: 219527 - DNA, 871 bp, Homo sapiens
  misc_feature: GYAE6OF01EA3JF.24.87.H10.1.454.CMB.1.raw
tcagactactatgtcacgaccggtgctcgatttagcagtactgcgttggggtttgggggaggaactgctcagttaggacccagacggaaccatggaacgccccagcgcagcttctcttcctcctgctactctggcctcccagactaccacgtggagaagtagtcatgaccgcagtctccacgcccaccctgtctgtcgtctaccggaaggggaaacgccgcccacccttctcctgccgagggccagtgatagtgtgcagtactaacttcgccgtagtaccaggacaacgaaccggtcggaccgacggtccctacccgacggtcccttcccttaccttccgtacgtccgtcgttacccgttcctaccccggtacccggtaccccggggtccccgttcgggtcccgtacccccgtacgggtaccggtttcggggtttccggggttcgggggtccggggttgggtaccgggtacggggtacttacggtttactttaccctaccgttcccgacctaactcggtaccgcggtacccgtccctaccgtcgttacgtacgttaacgtttcgtttacgttacctttaacgtttttacgttacgtttacgaacccgttaacgtaccgtttaggtttacggttaccgttaccgggtttccccgttaccgttttaccccggttaccggtttaaccggtttcccggggaacccgggtaaaccggggtaacccgttaaccggtagggtaaccgtaaacgttaaccggtaaaaccggtccgggtttaggacccgggttaccaacccggtttcccgtaacccgttccgtttacggtttcctttaccctttacccggtaacccttttccccggtaccccttaacccg

SEQ ID NO: 219528 - DNA, 949 bp, Homo sapiens
  misc_feature: GYAE6OF01A7DPK.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctcggcctcccagactaccactggagaagtagtcatgacgctagtctcccagcccaccctgtactgtctctaccgaaggggaaacgacgccaccctctccgtgacgacgggccaggtgaacgtaagttggttacggacctacggtacctaaacgtttaccgtacccggttacggtaacccgtacggaccaaaccggtaaaacccgtcggaccccgaaccggggtccctaccccggaaccggttccccgttacccccttcccgttacctttaacgtcgttaccgttccgttaccctaccccgtaacccggtacccggggtccccgttacgggttcccggtaccccgtacccggtcccgggttaacgggttttccggggttcgggggtcccggggtttacgggggttccggttaccggggaaccgttacggtttaccgtttaccgtccttacccgtaccctaaccgtaccgttcccggaaccgggccccggtacccgttacccgtacgttaccggttaacgggtaattttacggttttacggtaccttttaaggttttaccgtttaaccggtcgtacccggtaagtccggtaaccgtaccgtaaccggtacggtttacgggaccgggttcccggtacccggttaccggtttcccggtttaccggggttaaccggggaaccggggttaaccgggaacgggttaaacgggtacggtaaacgtaaacccggttaaaccggaaaccgggttacggacggttacgggccttaccggaaccttccgtaagtttcccgttacgtttccgttaccttcccgttacccccgg

SEQ ID NO: 219529 - DNA, 805 bp, Homo sapiens
  misc_feature: GYAE6OF01COPBK.24.87.H10.1.454.CMB.1.raw
  modified_base (224)..(224): a, c, t, g, unknown or other
  misc_feature (224)..(224): n is a, c, g, or t
  modified_base (447)..(447): a, c, t, g, unknown or other
  misc_feature (447)..(447): n is a, c, g, or t
tcagactactatgtcacgaccggtgctcgatttagcagtactgcgttggggtttgggggaggaactgctcagttaggacccagacggaaccagtggaacgccccagcgcagcttctcttcctcctgcttactcgtggcctcccagactacccagtagggagaagttagtcagtgacgcacgtctccacgcccacctgtctgtcgtacgtccggaaggggaaacncgcccaccctctccgtgcgacgggccaggttgagtaattcgggtcgacctagacctaacgtttcggaccgttacggtaaccgagaccgaaacgtaaaccggtcgggacctacggtccctacccggtacggtccctttcccctccttaccgttgttccggtaccttccggttacccctaccccggacccgggtacccgggttcccccggtggtccccgtacccncgggtccgttacggggtttccggttcggggtacggtcgggttacgcgggtaactacgttacttcctacttcccagtaccctagtccgaccggtcccgtccctacgtacggttaccgtaaggttaaccgttcgttttacgtccgttttaacctttacgtttccttacgttaaccgtaacgttaacgttcggtttacggtacgtaccggttccgttaaccgtccgtttaacgtttaccgggttaccgggaccggtaaccggtaacgttacggtaggaacgttaacaacggtaacgtcggtcggtacgtccgacgtacaccgttctaccgttcttacgtccttaccttccccgtcggtacc

SEQ ID NO: 219530 - DNA, 1083 bp, Homo sapiens
  misc_feature: GYAE6OF01AWNWC.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgaccgctagtcctccacgcccaccctgtccgtgtcgtctccgaaggggaaacgcgcccaccctctccgtgccgacggggcctaaggtggaaggtaagttggttacggcacgtaccgtaaacttacggtcccgttagggttaaccccaaggaccaaacggtaaaacccgtcggggacccgaacggggtccccttacccccggacggggtacccccttccccgttacccgtaccgtttaagtccggtccgtttccgttaccccgttaccccgaccccggtacccggggtaccccccgtttcggggttccccgtaccccggtacccgtcccgggtttaacggggttttcccgggttcgggggttacccggggtttcggggttacccggttagggggtaacccgtaacgtttaccgttttaccgacctttaccccgtacccgaaaccccgttacgtacccggtaaccgggtcccccgggttaccccgttaaccccggtaggtttcccggttaacgggtttaaaccggttttacgttttttaacccgttaacccgtttttaaccgttttttaccgtttaaccgtttacccgttaaaccttttaaacccgtaacgttttacgggttaccggttaccggttaacccggttccccggtttaaccccggttttaccccggtttaacccggtttttaacccgggttttacccggggaaaccccgggggttaaacccggggttaaaacccgttaaaccgggtacgggttaaacccgtaaccgggttaaaccccgtaaaaaccgggttaccggtttacggggttacccggtacgtaacccggtaacccccgtaacctttaccgggtttaaccctttccgggttccccttttaaaccccgtcccggttttaccccctaacccccggttaacccg

SEQ ID NO: 219531 - DNA, 773 bp, Homo sapiens
  misc_feature: GYAE6OF01ATG9N.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactcgtggctccagataccactggagaagtagtcatgacgcagtctccagccaccctgtctgtgtctccgaggggaaangccacccgtctcctgcgacgggccagtgaagaagttggttggcgagactaacttacgccgtaggtacccgagaccaaggaaacccgtggaccgtaggccctcccgaggccttccctcctactatcgtctcgtcctccgaccggtccgggtccccgtggttcccgtccccgacgtcccggttacgggttccggttcggggtcgggttcgggttaccggtggggacgtacggtacttttaccgacttcccgtccaaccgtgccgtaacggtcccgtacccgttccgtacgttcgtaaggtaacgttacgttttacgtctttaacttttacgtttacttacgtacctaacgtaccgttaagttcgggttacgtaccgttaccgtcccgttaccggtttaaccgttaccggtttttaccggggtaacccgggtaacggggttaaacccaaggttaacggtaacggtaactaaccggtaaaaaccgttacggttaaggtcggtaccggtacggaccttaacccgtaagttccgttcgtttaccttactccggtttccccgttcccgttaacccg

SEQ ID NO: 219532 - DNA, 863 bp, Homo sapiens
  misc_feature: GYAE6OF01CL0C8.24.87.H10.1.454.CMB.1.raw
  modified_base (814)..(814): a, c, t, g, unknown or other
  misc_feature (814)..(814): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagcccaccctgtctgtgtctccgagggaaagcgccgaccctctccgtgcgagggccaaggtcgagaatggttggacagtacaacgttcgccgtacggtaaccacgacaacgtaaacccgtcggacccgtaacggtcccgtcccgtaacgggtccccttaccccttaccgttccgttaacgttccggtaccgtttccggttaccctaccccgtaaccccgggtaacccggggttacccccgtttcgggttaccccggttacccccgtaccggaccccggtttaccggggtttttaccggggtttcgggggtccggggtttcgggggttaccggtttacgggggaacccttagggttttaaacccgttttccgaacccgtttacgtaccccgttaaacctccgtaaccggtaccgggtcccgttaaccccgttcccgtaaccggttacgttaacggttaacgttttaaccgttttacgtaccgttttaaccgtttttacttaccgttacgttaaccgtaaactacgtttaccggttaggtacgtccgttcggtacccttccgttacgttaccggtttacgggacccgtaaacgggtaactaacggtaggtaacgaacgtaaccgaaacgtcgtacggtcgtacncgtacctacgactttcgtacgtttactactaccgttcccgtccgtaacc

SEQ ID NO: 219533 - DNA, 931 bp, Homo sapiens
  misc_feature: GYAE6OF01AND2Y.24.87.H10.1.454.CMB.1.raw
  modified_base (258)..(258): a, c, t, g, unknown or other
  misc_feature (258)..(258): n is a, c, g, or t
tcagactactatgtcacgaccggtgctcgatttagcagtactgcgttgggtttgggggagaactgctcgagttaggacccagacggaaccagtggaacgccccagcgcagtcttctcttcctcctgctactctcggcctccaagtactaccgacgtagggaacgtaagttacgtactagtcgaaccgcgtacgttcctacccgacgtaccccttcccgtgttccgtggtaccgttccggtaacggaaaggggaaaccnccggtaccccctaccgttcccgttccgacggaccggtacgggtacccgtaagggttagtaaacggttggtttcgggtacggaaccaaccgggttaacttaaccggttacccggaccggtaccggtaaccgaccggaaacgtaaacccggaaccggttcccgggaaccctaacggtccccgtaacccggtcccgtaccctttccgtaccccttaggtttacgtcccggttaccgttccccggtaaccctacccgggaacccgggttcccccgggttccgtggtaccccgtaccgtaccgggttcgggtttccggtcgggggtcggtaccggggttcgtaaccgggttcggaattcccgttagttcccaccggtttcccaacgggtaccccgttgacggtaccccgttaggaccggtaacgtacggttaccgttaaggtttacggtttacccgttaagtttaccgtttactaccggttacgtccgacgttccgttaccgtcccgtaccggttccgtaccgtccgggttacggtccggggttacggggaccgggtacgggtagggtacggtaaaggccggtacggttacggcgtcggttcggaccggttacgaccgttcttacggttgttaccgttaccctcccgtcttacccgcgttacttaccgtaacgtaacg

SEQ ID NO: 219534 - DNA, 659 bp, Homo sapiens
  misc_feature: GYAE6OF01ELG4F.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtcgtctccgaggggaaancgcccaccctctcctgccgagggccagtcgagatggttggcagctaacgttgcctggtaccagcaacgtaaccgtggaccacggtcctaccgacggtcctccgtcctctactcgcgtcgtcctcccgaaccgtcgggtcccctggtccgtcccgtacgtccggtagggtttccggtggggtcggtcggtcggagggactagtacttccgacttcaccgtactacgccgacggccggtaccctaccgtacggttccgtaggtaacgtttcgttttacggactttaacgtttttcgtttaccgttacgttaacctaacgtacttagggttcggtacgtaccgttcgtacccttcgttacgttacgttcgggaccgtacgggtaacccaggtcgaacgtactacgaaacgtgtcgtcgtctagccacgtctctcgttacctgtcttccgtccgtac

SEQ ID NO: 219535 - DNA, 905 bp, Homo sapiens
  misc_feature: GYAE6OF01B6D39.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggcctcccagatacccacgtggagaagtagtcatgacgcacgttcctccagcccacccgttgtcctgttcgtcgtaccggaaggggaaacacgccccaacccgttcctccgtcggacgacgggaccaggtagaacgtaagttggttacggacagtaccgtaacgttacggtacccgtacggtaacccgtacgaccgaacggtaaacccgttcggacccgacggtcccgtaccccgccggtccttacccccttaccgttcgttaacgtcgtccgttaccggttccctaccccggtaccccggtaccggggtacccccgttacgggttcccgtaccccgaaccggtcccggttaacggggttttccgggtccggggtccgggttcgggttacggtacggggtaaccttacggtttaaccgttaccgttaacccgttccgtacccgtaaccctacgtaccggaccggtccccggttaccccgtacggtaacgttaccgttaacgttacgtttaccgttttacgttaaccggttttacttttaagtttcccttacgtaacctaacgttacgttacgggttacggttaccgttcggttacccgttacctttaacccggttacgtttaccgggtttaaccggaaccgggttaaccgggtaaaccgttaaccgggtcggtaaacgtaaccgtaacggtaaaccgtacgggtacgtccggtacgacctacggtacccttagtccttaccgttacttacccacggtttccccctcgttaacccg

SEQ ID NO: 219536 - DNA, 904 bp, Homo sapiens
  misc_feature: GYAE6OF01AI8BV.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttccgtcctgctactctggcctccagataccactggagaagtagtcatgacgcagtctccagccaccctgtctgtgtctccgaggggaacncgcccaccctctcctgccgagggccagtgagaactggttaggacagtcctaacgttaggccgttacgggttacccaggtacgaacggtaaacccgttggacccgtacggggcccttaccccggaacggggtcccctttcccccgttaccccttaccgtttaacgtttccggtaccgtttacccggttccccgttacccccggtaaccccggtaacccgggggttcccccccggtttacggggttccccgtaacccccgtaacggggtcccccggttaacccggggtttttcccgggtttaggggggttccccggggttcggggggttacccggttaggggggtaacccttaacggggtttacttttacccgtaacccgtttcccgaccctaaccgtactccggaccggtcccgggtacccttcccgtaacggttcgtaacgggtaagtttccttttacggaaccttttacttttaacgtttcctacgttaccctaacttaacgttcgtacgggttacgtacccgttccggtcccgttccgttaaccgttacggtttaccgggtacccggtaacggggttaacccaacggttacgggaagtacctaaccggtaaaccgtgttacggaccggtcaccgtaccgttaacccacggttcgttaccgttacccgttactacccgttccccgttacccgtacccg

SEQ ID NO: 219537 - DNA, 255 bp, Homo sapiens
  misc_feature: GYAE6OF02ILWMO.24.87.H10.1.454.CMB.1.raw
  modified_base (254)..(255): a, c, t, g, unknown or other
  misc_feature (254)..(255): n is a, c, g, or t
tcagactactatgtcacgaccggtgctcgatttagcagtactgcgttgggtttgggacagatttcactctcaccatcagcggcctccagtctgaagatttgcactttatttctgtcaacactatggtgactggcctccgtacacttttggccaggggaccaaactggagatcaaacgaactgtggctgcaccatctgtcttcatcttcccgcatctgaacatagtagtctgagcgggctggcaaggcgcatagnn

SEQ ID NO: 219538 - DNA, 692 bp, Homo sapiens
  misc_feature: GYAE6OF02GI4U8.24.87.H10.1.454.CMB.1.raw
tcagactactatgtcacgaccggtgctcgatttagcagtactgcgttaggttggggaggaaacggtcgaacctcaccgttacggtacccgagaacggaaccccatggaagccccagcgccagccttctcgttccgtccctggctactctcggttcttcccgaggataccactggacgaaagtaggtcactgaccgcgtagtccttccgagcccaccctgtcgtgtcgtctccaggggtaaagcgccaaccctcctccggtcgccaaggggtccaagttggacgtaacttggttcggactaggcctaaactttaggtacccttaggttacccttacgacctaacggtaaaaccttgggacctaggggtcctaccccgaacggccgtccccggtaccgtcggtacttggacttggtccttccggacctaggggcccctgggtcgtcccctaaggaccctaaaggttcggttggcggtggggtctggggactacggagtttcacgtcgtcaccatcacgccggccgtccacgtctcgaacgtatttacgctacctttattctgtactaacgtacgtatcgtgactgcctcgtactacgtttcggcctacgggtacctaacgtggagacgtacgaacgacttagtcggactcgtccgacctagtcgttcgtaccttacgtcttccgttccgtaccg

SEQ ID NO: 219539 - DNA, 515 bp, Homo sapiens
  misc_feature: GYAE6OF02GLPSG.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagatttcactctcaccatcagcggcctccagtctgagatttgctactttattctgtctaacactatggtgactggcctccgtactacttttggcctagggaccaaacgtggagatacaacgaactgtggctgcaccatctgtcttcatccttcccgtcc

SEQ ID NO: 219540 - DNA, 256 bp, Homo sapiens; identical to SEQ ID NO: 219046
  misc_feature: GYAE6OF02GCEWD.24.87.H10.1.454.CMB.1.raw
  modified_base (256)..(256): a, c, t, g, unknown or other
  misc_feature (256)..(256): n is a, c, g, or t

SEQ ID NO: 219541 - DNA, 508 bp, Homo sapiens
  misc_feature: GYAE6OF02IQHLQ.24.87.H10.1.454.CMB.1.raw
  modified_base (202)..(202): a, c, t, g, unknown or other
  misc_feature (202)..(202): n is a, c, g, or t
  modified_base (426)..(426): a, c, t, g, unknown or other
  misc_feature (426)..(426): n is a, c, g, or t
tcagactactatgtcacgaccggtgctcgatttagcagtactgcgttgggtttggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccagggcccctggtgtcccagccaggttcgttggcggtgggtctgggacaggatttcgactctcaccatcagcggcctcagtctgaagattttgcactttattctgtcaacactatggtnactggcctcgtacacttttggccaggggaccaaactggagatcaacgactgtggctgcaccatctgtcttcatcttcccgac

SEQ ID NO: 219542 - DNA, 513 bp, Homo sapiens
  misc_feature: GYAE6OF02GR6PW.24.87.H10.1.454.CMB.1.raw
  modified_base (203)..(203): a, c, t, g, unknown or other
  misc_feature (203)..(203): n is a, c, g, or t
  modified_base (417)..(417): a, c, t, g, unknown or other
  misc_feature (417)..(417): n is a, c, g, or t
  modified_base (469)..(469): a, c, t, g, unknown or other
  misc_feature (469)..(469): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtcctccaccagggcccctggtgtcccagccaggttcgttggcggtgggtctgggacagatttcactctcacatcagcgcctcagtctgaagtatttgctactttattctgtcaacncttatggtgactggcctccgtactacgttttggccgagggaccaaactgganatacaagactggtggctgccactatctgtcttcattcctccgcc

SEQ ID NO: 219543 - DNA, 516 bp, Homo sapiens
  misc_feature: GYAE6OF02H38K4.24.87.H10.1.454.CMB.1.raw
  modified_base (398)..(398): a, c, t, g, unknown or other
  misc_feature (398)..(398): n is a, c, g, or t
  modified_base (495)..(495): a, c, t, g, unknown or other
  misc_feature (495)..(495): n is a, c, g, or t
tcagactactatgtcacgaccggtgctcgatttagcagtactgcgttgggtttgggggaggaactgctcagttaggacccagacggaaccatggaagccccagcgcagcgttctcttcctcctgctactctggctccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggccccctggtcgtcccagcccaggttcgttggcggtgggtctgggacagatttcactctcaccatcagcggcctccagtctgaagnttttgctactttatttctgtcaacactatgtgactggcctcgtactacttttggccaggggtaccaaacgtggagatcaaacgactgtgctgcaccntctgtcttcattcctcctacc

SEQ ID NO: 219544 - DNA, 490 bp, Homo sapiens
  misc_feature: GYAE6OF02HE1TT.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttaggaagttgttagcctggtatcaacacaaacatggccaggctccccggctcctcatctatgatgcatccaatagggccactggcatcccagacaggttcagtggcagtgggtctgggacagacttcactctcaccatcagcagtgtagagcctgaagattttgctagtttattactgtcagcacgtgacaactggccactttcgcctggaccagactggacagtccaacgactgtggctgcaccatctgtcttc

SEQ ID NO: 219545 - DNA, 268 bp, Homo sapiens
  misc_feature: GYAE6OF02GI7RH.24.87.H10.1.454.CMB.1.raw
  modified_base (262)..(268): a, c, t, g, unknown or other
  misc_feature (262)..(268): n is a, c, g, or t
tcagactactatgtcacgaccggtgctcgatttagcagtactgcgttgggtttgggacagagttcactctcgaccatcacgcggcctccagtctcgaagattttgctactttatttctgtcaacactatggtagactggcctccgtacacttttggccaggggaccaaactggagatcaaacgtactgtggcttagcaccatctgtcttcatcttccgcatctggaacatagtagtctgagcgggctggcaaggcgcatagnnnnnnn

SEQ ID NO: 219546 - DNA, 534 bp, Homo sapiens
  misc_feature: GYAE6OF02JFGTE.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtccccagccaggttcgtggcggtgggtctgggacaggatttcactctcaccatcagcgcctccagtctgaagtatttgctactttatttctgttcaactactattggtgtactggcccttccgtacctacgttttcggccgtaggggtaacccaaacgtggagataccaacgtacgtgtggctgcacatctgtctcacttccttcccgtac

SEQ ID NO: 219547 - DNA, 525 bp, Homo sapiens
  misc_feature: GYAE6OF02FPU1A.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtgtcccagccaggttcgttggcggtgggtctgggacagatttcactctcaccatcagcggcctccagtctgaagtattttgctactttatttctgtcaacactatggtgactggcctccgtactaccttttggcctaggggtacccaaacgtggaagatacaacgaactggtggctgcaccatctgtcttcacttcttcccgacc

SEQ ID NO: 219548 - DNA, 517 bp, Homo sapiens
  misc_feature: GYAE6OF02G7XEP.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccagggcccctggtgtcccagccaggttcgtggcggtgggtctggggacagatttcactctcaccatcagcggcctccagtctgagtatttgctactttatttctgtcaacacttatggtgactggcctccgtactacttttggcctaggggacccaaacgtggagatacgaacgtactgtggctgcctaccatcgtgtcttcattctgcc

SEQ ID NO: 219549 - DNA, 533 bp, Homo sapiens
  misc_feature: GYAE6OF02GOCSK.24.87.H10.1.454.CMB.1.raw
  modified_base (310)..(310): a, c, t, g, unknown or other
  misc_feature (310)..(310): n is a, c, g, or t
  modified_base (375)..(375): a, c, t, g, unknown or other
  misc_feature (375)..(375): n is a, c, g, or t
tcagactactatgtcacgaccggtgctcgatttagcagtactgcgttgggtttgggggaggaactgctcagttaggacccagacggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacngggtcactggccgtccccgcaggttcagtggcagtgggtctgggacagacttcactctcaccgtnagcagccctagacgcctgaagtattttgcggttttactactgtcagcagtcgttccgcctggccgctaacgtttcgggcggggaccagggtggagaggagacgaacgtggtggctgcaccatctgtcttcattccttcccgcctatctgactatacgg

SEQ ID NO: 219550 - DNA, 514 bp, Homo sapiens
  misc_feature: GYAE6OF02H0WJM.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccagggcccctggtcgtcccagccaggttcgtggcggtgggtctggggacagatttcactctcacatcagcgcctcagtctgagtatttgctacttatttctgttctaacactatgtgactggcctccgtactacttttggccgtagggacctaaacgtggagatacaacgactgtggctgcaccatctgtcttcacttctcccgtcc

SEQ ID NO: 219551 - DNA, 507 bp, Homo sapiens
  misc_feature: GYAE6OF02GPINA.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtcagagtgttagcagcagctacttagcctggtaccagcagaaacctggcctggctcccaggctcctcctctatgctgtctccaccagggcccctggtgtcccagccaggttcgttggcggtgggtctgggacagatttcactctcaccatcagcgcctccagtctgaagattttgctactttatttcttgtcaacactatgtgactggcctccgtactacttttggccagggaccaaacgtgagatcaacgaactgtggctgcacatctgtcttcattcc

SEQ ID NO: 219552 - DNA, 519 bp, Homo sapiens
  misc_feature: GYAE6OF02JDUXR.24.87.H10.1.454.CMB.1.raw
  modified_base (212)..(212): a, c, t, g, unknown or other
  misc_feature (212)..(212): n is a, c, g, or t
tcagactactatgtcacgaccggtgctcgatttagcagtactgcgttgggtttggggaggaactgctcagttaggacccagacggaaccatggaagccccagcgcagcttctcttcctcctgctactctggctcccagccatcaccggaggaattgtgttgacgcagtctccaggcaccctgtctttgtctccaggggagagagccaccctntcctgcagggccagtcagagtgttagcagcagctacttagcctggtaccagcagaaacctggcctggctcccaggctcctcatctatggtgcgtccaccagggccactggcgtcgcggacaggttcgttgggcggtgggtctgggacaggatttcactctcaccatcagcgcctccagtctgagtatttgctactttattctgtcaacactatggtgtactggcctccgtactacgttttggcctaggggaccaaacgtggagtacgtacaacgtaacgtgtggctgcctacatctgtcttcattcc

SEQ ID NO: 219553 - DNA, 536 bp, Homo sapiens
  misc_feature: GYAE6OF02HPM22.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaagagccaccctctcctgcagggccagtgagaatgttggcagcaacttagcctggtaccagcagaaacctggccaggctcccaggctcctcctctatgctgtcctccaccacgggcccctggtcgtcccagccaggttcgtggcggtgggtctgggacagtatttcactctcaccatcagcgcctccagtctgaagtatttgctactttatttctgtctaactactattggtgtactcggtctccgtactacgttttcggccgtacggggacctaacgtcggaagtactacgaacgtacgtaggtggctgcaccatctcgtcttctactcctcctcc

SEQ ID NO: 219554 - DNA, 545 bp, Homo sapiens
  misc_feature: GYAE6OF02GJ3AE.24.87.H10.1.454.CMB.1.raw
tcagactactatgtcacgaccggtgctcgatttagcagtactgcgttgggtttgggggagggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaattagcctggtaccagcagaaacctggccaggctcccaggctcctcctctatgctgtctccaccagggcccctggtgtcccagccaggttcgtggcggtgggtctgggacagatttcactctcaccatcagcgcctccagtctgagatttgctactttattctgtcacactatgtgactggtcctccgtactacttttcgccgtagggaccgtaaacgtacggtagacgtacaacgtaacgtaggtcggacgttacgccgtaccacgttcctacgttctttcctattccttcccgtaccc

SEQ ID NO: 219555 - DNA, 573 bp, Homo sapiens
  misc_feature: GYAE6OF02IXF0K.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactcttggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggcctccgaggctcctcctctatgctgtcctccaccgacgggcccctggtcgtcccagcctaggttcgttggcggtgggtctgggacaggtatttcactctcaccatcacgcgcctccacgtctagaagtatttgctactttattctgtactaactactagtggtgactcggtccttccgtactacgttttcggccgtacggggtaacctaaacgtggaacgtacgtacgaacggtaacgttggtcggcgtgacctaccgtattcgttcgttccttacgtacttccgttcccgtaccg

SEQ ID NO: 219556 - DNA, 558 bp, Homo sapiens
  misc_feature: GYAE6OF02JM8GT.24.87.H10.1.454.CMB.1.raw
  modified_base (202)..(202): a, c, t, g, unknown or other
  misc_feature (202)..(202): n is a, c, g, or t
  modified_base (544)..(544): a, c, t, g, unknown or other
  misc_feature (544)..(544): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccaggggaaancgccacctctcctgcagggccagtgagaatgttggcagcaacttgcctggtaccagcagaaacctggccaggctcccaggctcctcctctatgctgtcctccaccgacgggcccctgggtcgtcccgacggcccgtaggttccggttcggcggttaggggtcctggggaccaggtactttcacgtctcaccatcagccgcctccagtctagaagtactttgactactttattctgtactaactctatggtgtactcggccttcgtactacgtttggccgtacgggacctaacgtggagactacgaacgtacgtggtaggctgactactagttctgttacctnacttcctcccgtac

SEQ ID NO: 219557 - DNA, 521 bp, Homo sapiens
  misc_feature: GYAE6OF02I7Q0R.24.87.H10.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagatttcactctcaccatcagcggcctccagtctgaagtntttgctactttattctgtccaanacttatggtgactggcctccgtactcttttggccaggggaccaaactggagataccaacgaactggtggctgccaccatctgtcttcacttccttcccgtc

SEQ ID NO: 219558 - DNA, 256 bp, Homo sapiens; identical to SEQ ID NO: 219046
  misc_feature: GYAE6OF02G2VBU.24.87.H10.1.454.CMB.1.raw
  modified_base (256)..(256): a, c, t, g, unknown or other
  misc_feature (256)..(256): n is a, c, g, or t

SEQ ID NO: 219559 - DNA, 525 bp, Homo sapiens
  misc_feature: GYAE6OF02IW7ZW.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagatttcactctcaccatcagcgctccagtctgaagtattttgctactttatttctgttcaactactatggtgactggcctccgtactacgttttggcctaggggaccctaaacgtggaagatacaacgtaactggtggctgcaccgatctgtcttcattctcccgcc

SEQ ID NO: 219560 - DNA, 509 bp, Homo sapiens
  misc_feature: GYAE6OF02HG11L.24.87.H10.1.454.CMB.1.raw
  modified_base (202)..(202): a, c, t, g, unknown or other
  misc_feature (202)..(202): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
  modified_base (469)..(469): a, c, t, g, unknown or other
  misc_feature (469)..(469): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagagtagtcatgacgcagtctccagccaccctgtctgtgtctccaggggaaanagccaccctctcctgcagggccagtgagaatgttggcagcaacttagcctggtaccagcagaaacctggccaggctcccaggcctcctcctctatgctgtctccaccagggcccctggtcgtcccagccaggttcgtggcggtgggtctgggacagtatttcactctcaccatcagcgcctcagtctgaagtntttgctactttntttctgtcaactactatggtgactggcctccgtactactttggccgagggaccaacgtgganatacaacgactgtgctgcacatctgtcttcattcctccgc

SEQ ID NO: 219561 - DNA, 504 bp, Homo sapiens
  misc_feature: GYAE6OF02HNEA4.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctccccggctcctcatctatgatgcatccaatagggccactggcatcccagacaggttcagtgcagtgggtctgggacagacttcactctcaccatcagcagtgtagagcctgaagtattttgctagtttattactgtcagcaccgtgacaactcggcctacttcggccctgggaccagactggacctacgtaccaacgtaactgtggctcgacaccgatctgttcc

SEQ ID NO: 219562 - DNA, 520 bp, Homo sapiens
  misc_feature: GYAE6OF02F7372.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtgtccccagccaggttcgttggcggtgggtctgggacagatttcactctcaccatcagcggcctccagtctgaagattttgctactttatttctgtcaacactatgtgactggcctccgtactacttttggcctaggggaccaaacgtggagatacaacgaactggtggctgcaccatctgtcttcattccttcccgtcc

SEQ ID NO: 219563 - DNA, 515 bp, Homo sapiens
  misc_feature: GYAE6OF02JAW0I.24.87.H10.1.454.CMB.1.raw
  modified_base (203)..(203): a, c, t, g, unknown or other
  misc_feature (203)..(203): n is a, c, g, or t
  modified_base (360)..(360): a, c, t, g, unknown or other
  misc_feature (360)..(360): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagntttcactctcaccatcagcgcctccagtctgaagatttgctactttattctgtcaacacttatgtgactggcctccgtactcttttggccaggggaccaaacgtggagatacgaacgactgtggctgcacatctgtccttcacttccttcccgcc

SEQ ID NO: 219564 - DNA, 513 bp, Homo sapiens
  misc_feature: GYAE6OF02F7027.24.87.H10.1.454.CMB.1.raw
tcagactactatgtcacgaccggtgctcgatttagcagtactgcgttgggtttggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtgtcccagccaggttcgttggcggtgggtctgggacagatttcactctcaccatcagcggcctcagtctgaagatttgctactttatttctgtcaacactatggtgactggcctccgtactactttggccaggggtaccaaacgtggagatcaacgactgtggctgcaccatctgtcttcattccttcccgtcc

SEQ ID NO: 219565 - DNA, 667 bp, Homo sapiens
  misc_feature: GYAE6OF02H98XS.24.87.H10.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
tcagactactatgtcacgaccggtgctcgatttagcagtactgcgttgggtttgggggaggaacgtgctcagttaggacccagacggaaccatggaagcccagcgcagcttctcttcctcctgctactctggctcccagataccactggagaagtagtcatgacgcagtctccagccaccctgtctgtgtctccgaggggaaanagccacctctcctgcagggccagtgagaatgttggcagcaacttagcctggtaccagcaagaacctggcaggctcccaggcctcctccnctatcgctacgtcctccgaccgacggggtcccccttgggtccgttacccccgaggtccccgtaggggttttccggtttcggggccggtttcgggggtccgttagggggaacctacgggttattttccgaccgttctccaaccgtactcgacgggccggtccctccgacgttcctaggtaaacgtatttttcggacttacgttttactttcgtacgttactaaccgtacttagttacggtcgtacgtcggtcccttacgtacgttacgtttcggaccgtaacgggtacctaaacggtgaacgtaacgtaccaaacggtaccttggacggtccgtacgaccactattctacgttccttctacttccgtaccccgtc

SEQ ID NO: 219566 - DNA, 780 bp, Homo sapiens
  misc_feature: GYAE6OF02JZ8KA.24.87.H10.1.454.CMB.1.raw
  modified_base (222)..(222): a, c, t, g, unknown or other
  misc_feature (222)..(222): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactcgtcgcctccagactaccacgtggaagtaagtagtcagtcgaccgcgtagtcctccacgcccaccgtgtctgtcgtcctaccggaaggggaaanccgccctacccttcctccgtgaccgacgggacctaggtagaagtaagttggttcggacgacgacctaaacgttcgaccgtacggtaccgacgacgaaacgtaaccgtcggaccgacggtccctaccggacggtccttccctccgtacgtacgtcgtcgttccgtccctacccgaccggtaccgggtccccgtgggtccctacccgacggtaccggttcggtttcgggttcgggtcgggttcgggtccggtacgggacgtacggtttcttaccgacttcctaccgtacctagtccgacggtcccgtcccgtaccgtacgttcgtacggttaacgttcgtttcgtacctttacgttttactttcgttacgtactaacttacgttagttcggtacgtacgtccggttacccgttaccgttaacgttaccggtttaccgggaccggtaaccggggtaacctaacggtacggtaacgtaacgtaaccgaacgtacgtacggtcgtacgtacggtaaccctacgtacgttcgttacgtccttacgtcgttcccgtacccgtacg

SEQ ID NO: 219567 - DNA, 655 bp, Homo sapiens
  misc_feature: GYAE6OF02IQGZ2.24.87.H10.1.454.CMB.1.raw
tcagactactatgtcacgaccggtgctcgatttagcagtactgcgttggggttgggaggactagctcgagttaggacccagaccggaaccgattggaagtccccagcgtcagcttcgtcttcctcctggctacctcgtggcctccagatacccactggacgaagtagtccagtgacgcagtctccgagccaccgtgtcctgtcgtactccagggaaagcgccaccctctcctgtcacgggccagtcgaagaatgttaggcctagcctaacgttagcctggtaccagaccaggaacctggccacggactccaggctccttcctcgtatgtctacggtcgtcccgacccagggcccctggtcgtcccgtagccgaggttcggtcggtcggtgggtctagggtacagtactttcacctctccaccatcacgcgcctccagtcgtagagtatttcgactactttactttctcgtacaactacttattggtactaccgtcggtcccgttaccgttaccgtaccgttttacggggacccgtaagggggtaaccctaaaacgttcggaaacgacgttacgtaaccggactttacggtacggtacctcgtacctaaccgtattacctcggttacctttaccgtaccgttccttccccggtacc

SEQ ID NO: 219568 - DNA, 623 bp, Homo sapiens
  misc_feature: GYAE6OF02HZ2IW.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcaagaaacctggccaggcctcccgaggctcctcctctatgctgtcctccaccgacgggcccctggtcgtcccacgcctaggttccggttgggcggttggggtcgtgggacagtactttcacttctccacctagtcaggccgcctccgcgtctagtagtattttgcttactttattcttgtacaactacttagttggtacgtacgtcggtccttcccgttacttaccgttttcggaccgtaacggggtaaccgtaacgtacggtaacgtacgtacgtaacgtaccgttaggtcggtaccgtcggaccgtaacccgtagttccgttacggttcctttaccgtacgttaccccgttcccgtaccc

SEQ ID NO: 219569 - DNA, 515 bp, Homo sapiens
  misc_feature: GYAE6OF02HBJQ2.24.87.H10.1.454.CMB.1.raw
tcagactactatgtcacgaccggtgctcgatttagcagtactgcgttgggtttgggggaggaactgctcagttaggacccagagggaaccatggaagccccagcgcagcttctcttcctcctgctactctggctcccagataccactggagaagtagtcatgacgcagtctccagccaccctgtctgtgtctccaggggaaagagccaccctctccctgcagggccagtgagaatgttggcagcaacttagcctggtaccagcagaaacctggccaggcctcccaggctcctcctctatgctgtctccaccacgggcccctggtcgtcccagccaggttcgtggcggtggtctgggacagattcactctcaccatcagccggcctccagtctgaagtatttgctactttatttctgtcaacactatgtgactggcctccgtactactttgccgtagggaccaacgtggagatacaacgactgtggctgcaccatctgtcttcacttcctcccgtc

SEQ ID NO: 219570 - DNA, 525 bp, Homo sapiens
  misc_feature: GYAE6OF02I13CL.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagatttcactctcaccatcagcgcctcagtctgaagtatttgctactttatttctgtctaacacttatgtgactggcctccgtactacgttttggccgtagggaccaacgtggaagactacgaacgactggtggctgccaccatctcgtcttcacttcctcccgtacc

SEQ ID NO: 219571 - DNA, 503 bp, Homo sapiens
  misc_feature: GYAE6OF02HDMV1.24.87.H10.1.454.CMB.1.raw
  modified_base (334)..(334): a, c, t, g, unknown or other
  misc_feature (334)..(334): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaaacctggcctggctcccaggctcctcatctatggtgcgtccaccagggccactggcgtcgcggacnggttcagtggcagtggctttgggacagacttcactctcatcatcgacagactggagccgaagattttgctagtgtattactgtcagctgttggtccctctcctcctatgtactactttggcctagggttccaggtcgtggagatcaagcgaactgtggctgcacctacg

SEQ ID NO: 219572 - DNA, 528 bp, Homo sapiens
  misc_feature: GYAE6OF02FWR9S.24.87.H10.1.454.CMB.1.raw
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtcctccaccacgggcccctggtcgtccccagcccaggttcgttgggcggtgggtctgggacagatttcactctcaccatcagcgcctccagtctgaagtntttgctactttatttctgtcaactactatggtnactggccttccgtactcttttggccgtaggggaccaaacgtggagactacgaacgactgtggctgcaccatctgttccttcacttcctcccgtc

SEQ ID NO: 219573 - DNA, 533 bp, Homo sapiens
  misc_feature: GYAE6OF02F8YCY.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctcccaggctcctcctctatgctgtcctccaccagggcccctggtcgtcccagccaggttcgttggcggtgggtctgggacagatttcactctcaccatcagcgcctcagtctgagtatttgctactttattctgttcaactacttatggtgactggccttccgtactcttttggcctaggggacctaaacgtggagtacgtacaacgtacgtggtggtctaggcctacatcttcgtcttcacttccttcccgtacc

SEQ ID NO: 219574 - DNA, 542 bp, Homo sapiens
  misc_feature: GYAE6OF02IMWGP.24.87.H10.1.454.CMB.1.raw
  modified_base (203)..(203): a, c, t, g, unknown or other
  misc_feature (203)..(203): n is a, c, g, or t
  modified_base (358)..(358): a, c, t, g, unknown or other
  misc_feature (358)..(358): n is a, c, g, or t
  modified_base (437)..(437): a, c, t, g, unknown or other
  misc_feature (437)..(437): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctccagataccactggagaagtagtcatgacgcagtctccagccaccctgtctgtgtctccaggggaaancgccaccctctcctgcagggccagtgagaatgttggcagcaacttagcctggtaccagcagaaacctggccaggctcccaggctcctcctctatgctgtctccaccacgggcccctggtcgtcccagccaggttcgtggcggtgggtctgggacngtatttcgactctcacctatccagcgcctccagtctgaagtattttgcttactttatttctgtacaactacttatggtnactcggcctccgtactacgtttcggaccaggggtaccaaacgtggaacgatacaacgtactgtacggctgccacctatctgttccttaccacttcctcccgtacc

SEQ ID NO: 219575 - DNA, 532 bp, Homo sapiens
  misc_feature: GYAE6OF02ICC1V.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagatggaaccatggaagccccagcgcagcttctcttcctcctgctactctggctcccagataccactggagaagtagtcatgacgcagtctccagccaccctgtctgtgtctccaggggaaanagccacctctcctgcagggccagtgagaatgttggcagcaacttagcctggtaccagcagaaacctggccaggctcccaggctcctcctctatgctgtcctccaccacgggcccctggtcgtccccagcctagggttcgttggccggttgggtctgggacagatttcgactctcaccatcacgcggcctcagtctgaagtatttgctactttatttctgttcaactacttatggtgactggccctcgtactacgttttcggcctaggggtaccaaactggagactacgaaacacgtggtgctgtacacatctcgttctctactctcccg

SEQ ID NO: 219576 - DNA, 512 bp, Homo sapiens
  misc_feature: GYAE6OF02IGMAG.24.87.H10.1.454.CMB.1.raw
  modified_base (354)..(354): a, c, t, g, unknown or other
  misc_feature (354)..(354): n is a, c, g, or t
tcagactactatgtcacgaccggtgctcgatttagcagtactgcgttgggtttggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctctctatgctgtctccaccagggcccctggtgtcccagccaggttcgtggcggtgggtctgggacngatttcactctcaccatcagcggcctccagtctgaagattttgctactttatttctgtctaacactatgtgactggcctccgtacacttttggccaggggaccaaacgtggagatcaacgactgtggctgccaccatctgtcttcattccttcccgcc

SEQ ID NO: 219577 - DNA, 258 bp, Homo sapiens
  misc_feature: GYAE6OF02IO87B.24.87.H10.1.454.CMB.1.raw
  modified_base (254)..(258): a, c, t, g, unknown or other
  misc_feature (254)..(258): n is a, c, g, or t
tcagactactatgtcacgaccggtgctcgatttagcagtactgcgttgggtttgggtacgagatttcactctcaccatcagcggcctccagtctgaagatttgcactttatttctgtcaacactatggtgactggcctccgtacacttttggccagggaccaaactggagatcaaacgaactgtggctgcaccatctgtcttcatcttccgcatctgaacatagtagtctgagcgggctggcaaggcgcatagnnnnn

SEQ ID NO: 219578 - DNA, 698 bp, Homo sapiens
  misc_feature: GYAE6OF02FNC6J.24.87.H10.1.454.CMB.1.raw
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
tcagactactatgtcacgaccggtgctcgatttagcagtactgcgttgggtttgggggacgaaactgcctctaggttaggaccctacgacggaaccatggaagcccccagccgcaggcttcgtcctttccgtcctgcttaccttcctgggctcccagataccactaggagaagtacgtcactgacgcaagtcgtccagcctaccctggtcctgtgtctaccgaggggaaacnggccaccgtntaccgtgccagggccaggtcagatgttggtcagtcaacttgcctggtaccgagcaagaaaccgtcggtccgaggacgtcccctagggccttccgtaccttcggtatcggcctacggttcctcccaaccgaaggggtcccccttggggtcgttccccagggtcccagggtttccgtttcgggcgggttgggtactaggggtacctaggtacttttccgacgtcctccacctactcgacgccggaccctcctacgtcgtagaacgtacgttttcgactacgtttattcgtagtacctaactacttatcggtagtacttcggtccttccgtactacggttttcggccgtagggtaccctaaagtcggtaactacgtacgtaaacgtacgttcgttcgggacttacggtcgaccgtaagttccgttcggttaccttccgtacttcccgttacccgtaccc

SEQ ID NO: 219579 - DNA, 614 bp, Homo sapiens
  misc_feature: GYAE6OF02JGD0E.24.87.H10.1.454.CMB.1.raw
tcagactactatgtcacgaccggtgctcgatttagcagtactgcgttgggtttgggggaggaactgctcagttacggacccagacggaaccatggaagccccagcgcagcttctcttcctcctgctactctggctcccagataccactggagaagtagtcatgacgcagtctccagccaccctgtctgtgtcctccaggggaaaagcgccaccctctcctgccagggccagtgagaatgttggcagcaacttagcctggtaccagcagaaacctggaccaggcctcccaggcctcctcctctatgctgtcctccaccacgggccccttggtcgtcccagccgtaggttcgttggcggtgggttccgtgggaccagtacgtttcacgtctccactacgtcacgtcggcctccagttcctagaacgtacttttcggacttacgtttatttcgtgtacctaaactactagtggtacgtactcgggtccttaccgtacttaccgttttcggaccgtacggggtaacctaaaccgtggtaacgacttacgaaacgtacgttggtacggtctcgtaccaccgtacttcgtacggtccttacctacgttcctacccgtacc

SEQ ID NO: 219580 - DNA, 702 bp, Homo sapiens
  misc_feature: GYAE6OF02I1ZPH.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccacctctcctgcagggccagtgagaatgttggcagcaacttagcctggtaccagcagaacctggccaggctcccaggcctcctcctctatgctcgtctccaccacgggcccctggtcgtcccacgcctagggttccgttcggcggttgggtcgtgggacaggtaccttcgactcgtaccaccgtcagccgagtccctagacgccgtagaaagtacgttttggtacggtttacttaacgtgtctaggtcgtacggtccgttcccgccgtcgggtcccgtacgttaaaccggttttccggggacccgggggggtaacccgtacggggggttacgggtaacggggtaacggggaacgggtaaccgggtaaccggttcgggtacgggaccgttacggggaccctaacccggtaacgttcccggttaacggtttcccgtttaacgtacccggtttaccccgtttacccccggtacccgttaccgtacccggtttaaaccgg

SEQ ID NO: 219581 - DNA, 572 bp, Homo sapiens
  misc_feature: GYAE6OF02I6M36.24.87.H10.1.454.CMB.1.raw
  modified_base (203)..(203): a, c, t, g, unknown or other
  misc_feature (203)..(203): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (433)..(433): a, c, t, g, unknown or other
  misc_feature (433)..(433): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgtggcagcaacttagcctggtaccagcagaaacctggccaggctcccaggctcccgtcctctatgctgtcctccaccacgggcccctggtcgtcccagcctaggttcgtggcggtgggtctgggacaggtatttcgacgtctcaccatcagcgcctcagtcngaagtntttgctatttattctgtacaacacttatggtntactcggccttccgttactacgttttcggaccgtacgggtacctaaacgtggtaacgtactacgaaacgtaacgtggtacggtcctcgacctaccgtattccgttcggttaccttccgtaacttcccgttacccgtacc

SEQ ID NO: 219582 - DNA, 594 bp, Homo sapiens
  misc_feature: GYAE6OF02IZGJU.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccacgggcccctggtcgtcccagccaggttcgtggcggtgggtctgggacaggtatttcactctcaccatcagcgcctcagtctgagtatttgctactttattctgtactaactacttatgtgtactcggcccttccgtacctacgttttcgggccgtaacgggggtaacctaaacgtggaacgtaacgtaccgaaaccgtaacgtcggtacgggtccgtacggaccctaacccgtacgttccgttacggttacctttaccgtaacgtttcccgttccccggtaccc

SEQ ID NO: 219583 - DNA, 519 bp, Homo sapiens
  misc_feature: GYAE6OF02HVR6N.24.87.H10.1.454.CMB.1.raw
  modified_base (202)..(202): a, c, t, g, unknown or other
  misc_feature (202)..(202): n is a, c, g, or t
  modified_base (384)..(384): a, c, t, g, unknown or other
  misc_feature (384)..(384): n is a, c, g, or t
  modified_base (411)..(411): a, c, t, g, unknown or other
  misc_feature (411)..(411): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccaggggaaanagccaccctctcctgcagggccagtgagaatgttggcagcaacttagcctggtaccagcagaaacctggccaggctcccaggctcctcctctatgctgtctccaccacgggcccctggtctcccagccaggttcgtggcggtgggtctgggacagtatttcactctcaccatcagcgcctcngtctgagtatttgctactttatttctntctaactactatcggtgactggtcctccgtactacgttttggcctagggaccaaacgtgagatacaacgactgtggctgcaccatctcgtcttcacttcctccctacc

SEQ ID NO: 219584 - DNA, 573 bp, Homo sapiens
  misc_feature: GYAE6OF02IOAHA.24.87.H10.1.454.CMB.1.raw
  modified_base (203)..(203): a, c, t, g, unknown or other
  misc_feature (203)..(203): n is a, c, g, or t
  modified_base (283)..(283): a, c, t, g, unknown or other
  misc_feature (283)..(283): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatgccaccggagacattgtgttgacacagtctccagccacctgtctttgtctccgaggggaaanagccacctctcctgcagggccagtgacaatgtaggaagttgtagctggtatcaacacaaacatggccaggcctccccggntcctcatctatgatgcatccaatacggccatgcatcccagacaggttcagtggcaggtgggtctgggacagacttcactctcacatcagcagtcgtagacgcctagaagtattttgcttaagtttacttactgtcaagtcctaacgttgaacctaactcggacccctacgtttccgggacccttacggggacccaacggtaccgttgggaaccctaacgtacccgaaacggtaaccgttggtacggtcttacggacctaccctagttaccgtcggttacccttctaaccg

SEQ ID NO: 219585 - DNA, 537 bp, Homo sapiens
  misc_feature: GYAE6OF02GPMN9.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagtatttcactctcaccatcagcgcctcagtctgaagtatttgctactttatttctgtctaactacttattggtgtactcggtccttccgtactacgttttcggccgtaacggggtaccaaacgtggacgtatacaacgaactgtggtctgcaccatctgtcttctactccttcccgtcc

SEQ ID NO: 219586 - DNA, 542 bp, Homo sapiens
  misc_feature: GYAE6OF02G1QZN.24.87.H10.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccacctctcctgcagggccagtgagaatgttggcagcaacttagcctggtaccagcagaaacctggccaggctcccaggctcctcctctatgctgtcctccaccagggcccctggtcgtcccagccaggttcgttggtggtgggtctgggacaggtatttcactctcacatcagcgacctccagtctgaagtntttgactactttatttctgtctaactactatgtgtattggcctccgtactacgttttgctacggggtacctaacgtggaacgtagtacaacgtaacgtcggtaggtctggacaccgattctcgtccttcacttccgttcccgtcc

SEQ ID NO: 219587 - DNA, 729 bp, Homo sapiens
  misc_feature: GYAE6OF02FFK0U.24.87.H10.1.454.CMB.1.raw
  modified_base (151)..(151): a, c, t, g, unknown or other
  misc_feature (151)..(151): n is a, c, g, or t
  modified_base (205)..(205): a, c, t, g, unknown or other
  misc_feature (205)..(205): n is a, c, g, or t
  modified_base (701)..(701): a, c, t, g, unknown or other
  misc_feature (701)..(701): n is a, c, g, or t
  modified_base (720)..(720): a, c, t, g, unknown or other
  misc_feature (720)..(720): n is a, c, g, or t
tcagactactatgtcacgaccggtgctcgatttagcagtactgcgttgggtttggggaggaactgctcagttaggacccagacggaaccatggaagccccagcgcagcttctcttcctcctgctactctggcctcccagataccactgganaagtagtcatgacgcagtcctccagccacctgtctgtgtctaccgaggggaacncgcccaccctctccgtgccgagggccaggttacgaagtactggttcggacacggtacctaaacgttcgccgtacggaccaagccaacggtaaccgtcggacccacgggtccctaccccggacggtccccttccctccgttacgtacgtccgtccgttccgtaccctacccggaacccggtcggggtcccccgttgggtaccgttaccccgacgggttccccggttaggggtttccgggttcggggtccgggttacgggttaccgtacggggtaaccttacggttaccttttcccgacctccgtaccacccgtagtccgaaccggtccgtaccctacgtacgtacttacgtaacgtttactttacgtacctttacgtttactactacgtactaactacgttacgtcggtactaccggtaccgttaccgttaccgtacgttaccggttacggaccgtaacggaaccaacgtagactacgaacgtacacgtcgtcgtcncgtactctactctctctcnctcctctac

SEQ ID NO: 219588 - DNA, 549 bp, Homo sapiens
  misc_feature: GYAE6OF02H3D07.24.87.H10.1.454.CMB.1.raw
  modified_base (203)..(203): a, c, t, g, unknown or other
  misc_feature (203)..(203): n is a, c, g, or t
  modified_base (410)..(410): a, c, t, g, unknown or other
  misc_feature (410)..(410): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatcgctgtctcccaccacgggccccctggtcgtcccagcccgtaggttcggttggccggtgggtctggggacagtatttcacttctcaccatccagcggcctccagtctgaagtntttgctactttatttctagttcaactactatggtgtactggcctcgtactctttcggccgtagggccaaacgtggaacgatacgaacgacgtggtggccgtgcctacctatcgttacgtcttcacttccgttccctacc

SEQ ID NO: 219589 - DNA, 520 bp, Homo sapiens
  misc_feature: GYAE6OF02GPLG2.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgtggcggtgggtctgggacagatttcactctcaccatcagcgcctccagtctgaagtatttgctactttatttctgtcaactactatgtgactggcctccgtactacttttggcctagggacctaaacgtggagatacaacgactggtggctgacaccatctgtcttcacttccttcccgtcc

SEQ ID NO: 219590 - DNA, 554 bp, Homo sapiens
  misc_feature: GYAE6OF02GD8A9.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcagaaacctggccaggctcccaggctcctcctctatgctcgtctccaccgacgggcccctggtctcccagccaggttcgttggcggtgggtctgggacagatttcactctcacatcagcgcctccagtctgaagtattttgctactttattctgtactaactatatggtgtactcggccttccgtacttcgttttcggaccgtacggggacctaaacgtggaacgtagtacgaacgtaactggtcggtacgtagcctacgtattctcgtaccttcacttcccttcccgtacc

SEQ ID NO: 219591 - DNA, 684 bp, Homo sapiens
  misc_feature: GYAE6OF02JONFW.24.87.H10.1.454.CMB.1.raw
  modified_base (204)..(204): a, c, t, g, unknown or other
  misc_feature (204)..(204): n is a, c, g, or t
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccaccggagacattgtgttgacacagtctccagccaccctgtctttgtctccgaggggaaangccaccctctcctgcagggccagtgaacaatgttaggaagttgttagcctggtatcaacacaaacngtcggaccaggtcctaccccggntcctcattctatgactgactactaccaagtcggaccacgtggaaacctcccgaagtaccgtaggtttccaggtcggacgtacggttggggtcctaggggaacacggtaacttcgacttcctaccacctagttccgaagctagtagtagacgtaccgtagaagttatttgacttagtttacgttacgttgtacgtacgtaccgtaaccgtacgtaaccgtaacgttaccggtacccgttacggtttcccggacccggttacgggtaaccgtacggtaccgtacggaaccgttaacgtacccgtaaacgtaaccgtcggtaacggtccgtaccgtaccgtaaccgttacgttaccgttccgttaccgttccgtaccgtttccccgtaaccccg

SEQ ID NO: 219592 - DNA, 258 bp, Homo sapiens; identical to SEQ ID NO: 219036
  misc_feature: GYAE6OF02IJD1A.24.87.H10.1.454.CMB.1.raw
  modified_base (256)..(258): a, c, t, g, unknown or other
  misc_feature (256)..(258): n is a, c, g, or t

SEQ ID NO: 219593 - DNA, 715 bp, Homo sapiens
  misc_feature: GYAE6OF02IXPSV.24.87.H10.1.454.CMB.1.raw
  modified_base (216)..(216): a, c, t, g, unknown or other
  misc_feature (216)..(216): n is a, c, g, or t
tcagactactatgtcacgaccggtgctcgatttagcagtactgcgttgggtttggggggaggaactgctcagttaggacccagacggaaccatggaagccccgagctcagcttctcttcctcctgctactctggctcccagtatgccaaccggaggtaccatttgtgttgtaacacgagtcctccagccacccgtgtctttgtctcgaggggaaancgccgaccctctccgtgcacgggccaagtcgacaatgttaggaagttgttagcctggtatcaacacaaaatgcaggctcccggctcctcatctatgatcgcataccgaagtacgggccacgtggcgtaactcccgagactaggttcaggtaggactaggtcgggtcgtgggaacacggtacgttcaccgttcgtacgaccctattccacgactagtcggtaaggacgtaccgttagaaagtacgttttacgaccttaagttttaacttaacgttacgttacgtaacgtaccgtaaccgttaggtaaccgtaaaccggttccgggtacccctaaccgtttttcccggggaccccgttttacggggtaaccctaacgggtaccgtacgggtaaccctacgtaacccgaaacggtaacggttcggtaacggggtaccttacggtacccgtacccgtacttacccgtttaccggttaccctttaccgttacctttaccccggg

SEQ ID NO: 219594 - DNA, 260 bp, Homo sapiens; identical to SEQ ID NO: 219041
  misc_feature: GYAE6OF02F50RX.24.87.H10.1.454.CMB.1.raw
  modified_base (256)..(260): a, c, t, g, unknown or other
  misc_feature (256)..(260): n is a, c, g, or t

SEQ ID NO: 219595 - DNA, 609 bp, Homo sapiens
  misc_feature: GYAE6OF02ILE86.24.87.H10.1.454.CMB.1.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtcctccaccngggcccctggtcgtcccagccaggttcgtggcggtgggtctgggacctagactttcactcgtacaccatcgagccggcctccgagtcgtgaagtatttgctactttatttctgttcaactactagttgtagtacgtcggtcttaccgttactaccgttttcggacccgtacggggtaaccctaaacgtcggtaacgtaacgttacgaaacgtaaccgttggtacgggtaccgttcggtaccgtacccgtacgttccgtacgttaccgtttaccgtaacgttcccgttacccgtacccg

SEQ ID NO: 219596 - DNA, 527 bp, Homo sapiens
  misc_feature: GYAE6OF02GB3PZ.24.87.H10.1.454.CMB.1.raw
  modified_base (203)..(203): a, c, t, g, unknown or other
  misc_feature (203)..(203): n is a, c, g, or t
  modified_base (436)..(436): a, c, t, g, unknown or other
  misc_feature (436)..(436): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtcctccaccagggcccctggtcgtccccagcccaggttcgtggcggtgggtctgggacaggtatttcactctcaccatcagcggcctccagtctgaagtattttgctactttattctgttacaactactatggtnactggcctcgtactacgtttggcctaggggaccaaacgtggagatacaacgactggtggctggcaccatctcgtcttcacttcctcccgtc

SEQ ID NO: 219597 - DNA, 823 bp, Homo sapiens
  misc_feature: GYAE6OF02J5OGW.24.87.H10.1.454.CMB.1.raw
  modified_base (235)..(235): a, c, t, g, unknown or other
  misc_feature (235)..(235): n is a, c, g, or t
tcagactactatgtcacgaccggtgctcgatttagcagtactgcgttgggtttggggagaactgctcagttaggacccagacggaaccatggaacgccccagcgcagtccttctcttcctcctgcctactcgtggcctaccgaagactaccgagtaggagtaacgttacgcagtcgacctctacgtcctaccacgtccctacgttgtcgtagtacgtaccgaccggaaggaaccncctccctccttcgtcgaggaccggacgtacgtagtacgtaagtacgtttcggacgaacgtacgtaacccgttaacgttccgaccggtaaccgtaaccgaacgtaccgtaaaccgtcccggtccgaccccggtacgtccctacccggtacttcccttaccttttacgacttcggtccgttacccgtacccgtacccggtacccggaccgggttcccggttcccgttgggtacccaccgggtacggtttccggggttaggttccgggtacggtcggtaacgtacgtacacttacttcctccgactaccaccgtacgtcgtccggtaccgtccctacgttacgtagttacgttagttacttttacttaccgttactttaccgtttcgaccgtactaaccgttacgtaggtttaccgacggttacctaccgggtttacccgttacccgttaaggttaccggttacggtaacccggaacggttaaaccgaacgtagaacgtactaacccgaacggttcttcggtcgaccgttcctaccgtaccttctttacggtcctttaaccgaccttacccttccggtacccgtattaacg

SEQ ID NO: 219598 - DNA, 563 bp, Homo sapiens
  misc_feature: GYAE6OF02H47PM.24.87.H10.1.454.CMB.1.raw
  modified_base (203)..(203): a, c, t, g, unknown or other
  misc_feature (203)..(203): n is a, c, g, or t
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
  modified_base (402)..(402): a, c, t, g, unknown or other
  misc_feature (402)..(402): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgtggcagcaacttagcctggtaccagcagaaacctggccaggctcccgaggctcctcctctatcgctgtcctccaccacggggccccctggtcgtcccngcccagggttcgtggcggtgggtctgggacngtatttcactctcaccatcagcgcctcgagtctgaagntttgctacgtttattctagttcaactactatgtagctgccttcgtactacgtttcgacgagggtaccaaagtggaacgtataccgaacgacgttaggtcgaccgttggacctaaccgatttaccgtcgttaccttcgttactcccgtttaccccgtacccg

SEQ ID NO: 219599 - DNA, 527 bp, Homo sapiens
  misc_feature: GYAE6OF02F5PTX.24.87.H10.1.454.CMB.1.raw
  modified_base (203)..(203): a, c, t, g, unknown or other
  misc_feature (203)..(203): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
  modified_base (502)..(502): a, c, t, g, unknown or other
  misc_feature (502)..(502): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaacctggccaggctcccaggctcctcctctatgctgtcctccaccacgggcccctgggtcgtccccagccaggttcgttggcggtgggtcttgggacagatttcacttctcaccatcngcgcctccagtctgaagtntttgctactttatttctntcacactatgtnctgcctcgtactctttcggcctacggggacctaacgtcggagactacgaacgtaactggtcggctgcaccntctgtcttacacttcctccgtaccc

SEQ ID NO: 219600 - DNA, 514 bp, Homo sapiens
  misc_feature: GYAE6OF02FHU35.24.87.H10.1.454.CMB.1.raw
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
tcagactactatgtcacgaccggtgctcgatttagcagtactgcgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctgggtaccaacagaaacctggccaggctcccaggctcctcatctatgatgtctccaacagggtcactggccgtccccgcaggttcagtggcagtgggtctgggacagcttcactctcaccgtcagcagcctagcgcctgagatttgcggtttactactgtcagcagtcgttccgcctcggccgctacgtttcgggcgggggaccagggtggagaggagacgaactggtgctgcacntctgtctcntctccncatcnacntag

SEQ ID NO: 219601 - DNA, 624 bp, Homo sapiens
  misc_feature: GYAE6OF02JMC56.24.87.H10.1.454.CMB.1.raw
  modified_base (201)..(201): a, c, t, g, unknown or other
  misc_feature (201)..(201): n is a, c, g, or t
  modified_base (599)..(599): a, c, t, g, unknown or other
  misc_feature (599)..(599): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctttgtctccagggganagagccaccctctcctgcagggccagtcagagtgtagcagcagctactagcctggtaccagcagaacctggcctggctcccaggctacctcatctatgctcgtctccaccgcgggcccctggtcgtcccagtccgtaggttccgttgggccgggtggtcgtgggactaggtatttccgacgttcctcgtaacccaagttccgaggcccggtcctcccgtaggtcctggtaacgttattttcggaccttacgttttactttcgtacgttacaacctacttacgtgggttagaccgttcggtccctaccgttacctccgttttacggacccgtaggggaacccaagttcggacgtagtacccgaaacggtaacgtggtacggccgtacggacctaccgtntacgttacgttaccgtacttacccg

SEQ ID NO: 219602 - DNA, 691 bp, Homo sapiens
  misc_feature: GYAE6OF02JGQFB.24.87.H10.1.454.CMB.1.raw
  modified_base (291)..(291): a, c, t, g, unknown or other
  misc_feature (291)..(291): n is a, c, g, or t
  modified_base (617)..(619): a, c, t, g, unknown or other
  misc_feature (617)..(619): n is a, c, g, or t
tcagactactatgtcacgaccggtgctcgatttagcagtactgcgttgggtttgggggaggaactgctcagttaggacccagacggaaccatggaagcccagcgcagcttctcttcctcctgctactctggctcccagactaccactggagaagtagtacatgacgcagtctccacgccaccctcgtctgtgtctccgagggaagacgaccaccctcctcctcgacgacgaggccgaggtagagtagtgtggcgacgcaacgttacgaccgtacggtaaccgacgacgacnggaaaccctagggaccacggaccgtacccgacggtaccgtacccgtaccgtaccgtactacgtacctacgtacctaccgacccgtacgggtaccccgtacggtacgtacccgacggtccgtacgggttcggttcgggtccggtcggggtacgtacgggtacgtacgtacgtttacgtacctaccgtacgtaccacgtacgtacgtaccggtaccgtaccgtacgtacgtacgtaacgtacgtttacgtacgttactttacgtttacgttacgttactaactacgttacgttacgtacgtacgtacgtaccgttaccgttacgtacnnntgtacgacgtacggacgtacgtacgtaacgtacgtacgtaacgtaacgtacgtacgtacgtacgtacgtacg

SEQ ID NO: 219603 - DNA, 524 bp, Homo sapiens
  misc_feature: GYAE6OF02FZ94N.24.87.H10.1.454.CMB.1.raw
  modified_base (433)..(433): a, c, t, g, unknown or other
  misc_feature (433)..(433): n is a, c, g, or t
  modified_base (522)..(522): a, c, t, g, unknown or other
  misc_feature (522)..(522): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctccctgcagggccagtgagaatgttggcagcaacttagcctggtaccagcagaaacctggccaggctcccaggcctcctcctctatgctgtcctccaccagggcccctggtcgtcccagccaggttcgttggcggtgggtctgggacaggatttcactctcaccatcacgcgcctccagtctgaatattttgctactttattctgtcaactactatggtnactcggcttccgtactacgtttgccgagggacctaacgtggaagatacaacgtactggtcggctgcaccatctgtcttcattccttccncc

SEQ ID NO: 219604 - DNA, 531 bp, Homo sapiens
  misc_feature: GYAE6OF02GC49Q.24.87.H10.1.454.CMB.1.raw
  modified_base (203)..(203): a, c, t, g, unknown or other
  misc_feature (203)..(203): n is a, c, g, or t
  modified_base (395)..(395): a, c, t, g, unknown or other
  misc_feature (395)..(395): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctcccaggctcctcctctatgctgtctccaccagggcccctggtgtcccagccaggttcgttggcggtgggtctggggacagatttcactctcaccatcagcggcctccagtctgaagnttttgctactttattctgtcaacactatggtgactcgcctcgtactacgtttcggccgtacgggaacctaaagtggagtatacgaacgacgtggtcggactcgacaccatcgtgttccttcacttcctcccgtacc

SEQ ID NO: 219605 - DNA, 701 bp, Homo sapiens
  misc_feature: GYAE6OF02H4G01.24.87.H10.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaacctggccaggctccagctcctctctatnctntctccaccacgggcccctggtctcccagccgaggttcgtggcggttgggtctgggactagtactttcacgttcctcaccgtatccgacggcccggtccctccgtacgtccgtaggtaacgttacgtttttaggacctttaacgttttacttttccgttacggttaaccttaaccttaaccgttaagttacgggttacgtaaccgttccggtacccgtttacccggttaaccttaccggttttttaccgggacccggttaacgggggtaaaccctaaacggttacgggaacgttaacgtaaccgtaaaaccggtacgttacggtacgggtaccgttacggtaccctaacccgtacgttccttacggttaccctttaccgtactttccccgttaccccgttaacccg

SEQ ID NO: 219606 - DNA, 568 bp, Homo sapiens
  misc_feature: GYAE6OF02G2VUJ.24.87.H10.1.454.CMB.1.raw
  modified_base (203)..(203): a, c, t, g, unknown or other
  misc_feature (203)..(203): n is a, c, g, or t
  modified_base (401)..(401): a, c, t, g, unknown or other
  misc_feature (401)..(401): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccacctctcctgcagggccagtgagaatgttggcagcaacttagcctggtaccagcagaaacctggccaggctcccaggcctcctcctctatcgctgtcctccaccgacgggcccctggtcgtcccagcctaggttcgtggcggtgggtcgtgggacagtatttcactctcacatcagccgcctcagtctgtagtntttgctactttattctgtactaactactagtggtcgtacgtggtccttccgttaccttacgttttcggaccgtacgggtaacctaaacgtcggaacgtactacgaacgtaacgtggtcggtctcgacctacctacgttcttcgtcttacctacttccgtcccgtacc

SEQ ID NO: 219607 - DNA, 521 bp, Homo sapiens
  misc_feature: GYAE6OF02GNK8P.24.87.H10.1.454.CMB.1.raw
  modified_base (475)..(475): a, c, t, g, unknown or other
  misc_feature (475)..(475): n is a, c, g, or t
  modified_base (500)..(500): a, c, t, g, unknown or other
  misc_feature (500)..(500): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtggggtctgggacaggatttcgactctcaccatcacgcggcctccagtctgaagtacttttgctactttattctgtcaacactatgtgactggcctcgtactacttttgccgtaggggaccaacgtgganagtacaacgtactgtggctgccacntctgtcttcattcctcccgtc

SEQ ID NO: 219608 - DNA, 606 bp, Homo sapiens
  misc_feature: GYAE6OF02JZGCF.24.87.H10.1.454.CMB.1.raw
  modified_base (200)..(200): a, c, t, g, unknown or other
  misc_feature (200)..(200): n is a, c, g, or t
  modified_base (305)..(305): a, c, t, g, unknown or other
  misc_feature (305)..(305): n is a, c, g, or t
  modified_base (480)..(480): a, c, t, g, unknown or other
  misc_feature (480)..(480): n is a, c, g, or t
tcagactactatgtcacgaccggtgctcgatttagcagtactgcgttgggtttgggggaggaactgctcagttaggacccagagggaaccatggaaaccccagcgcagcttctcttcctcctgctactctggctcccagccatcaccggaggaattgtgttgacgcagtctccaggcaccctgtctttgctccagggganagagcccaccctctcctgcagggccagtcagagtgttagcagcagctacttagcctggtaccagcagaaacctggacctggctccgaggctcctcatctatggtncgtccacgagggccacgtggccgtcgcggacaggttcagttggcaggtcggctttgggacagtaccttcacgttctcacgtttcagtcgacagacgtacggacgacccgtaagtacgtttgctacgtgttagttacgtgtcgagtctcgtttcggtcccttcgtccttaccgttnttacgttaccttacgttttcggtccgtacgggttccgtacggtacgttacgggtacgtactacggtaacggtacgttaacggttacggttacgggtccgttcggtacgtacccgtagtttacccgg

SEQ ID NO: 219609 - DNA, 561 bp, Homo sapiens
  misc_feature: GYAE6OF02GM9XP.24.87.H10.1.454.CMB.1.raw
  modified_base (203)..(203): a, c, t, g, unknown or other
  misc_feature (203)..(203): n is a, c, g, or t
  modified_base (366)..(366): a, c, t, g, unknown or other
  misc_feature (366)..(366): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggcctcctcctctatgctgtcctccaccgacgggcccctggtcgtcccagccgtaggttcgtggcggtgggtctgggacagtntttcactctcacatcacgcgcctcagtctgaagtatttgctactttattctgtactaactacttagtggtgtactcggtccttccgtacttacgttttcggaccgtacggggaccaagtcgtaggacgtatacgaacgtacgtggtacggctcgacctaccgtattccgttacgttcttctacttccttaccccg

SEQ ID NO: 219610 - DNA, 527 bp, Homo sapiens
  misc_feature: GYAE6OF02F5P10.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttgcctggtaccagcagaaacctggccaggctcccaggctcctcctctatgctgtcctccaccagggcccctggtcgtccccagccaggttcgttggcggtgggtctgggacagtatttcacgtctcaccatcagcggcctccagtctgaagtatttgctactttattctgtcaacactatgtgactggcctccgtactactttggccgtagggaccaaacgtggaagacgtacaacgactggtggactgcaccatcgtcgtcttctacttcctcccgtac

SEQ ID NO: 219611 - DNA, 534 bp, Homo sapiens
  misc_feature: GYAE6OF02IQOQV.24.87.H10.1.454.CMB.1.raw
  modified_base (203)..(203): a, c, t, g, unknown or other
  misc_feature (203)..(203): n is a, c, g, or t
  modified_base (361)..(361): a, c, t, g, unknown or other
  misc_feature (361)..(361): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctcccaggctcctcctctatgctgtcctccaccacgggcccctggtcgtcccagccagggttcgttggcggtgggtctggggacngtatttcactctcacatcagcgcctccagtctgaagtatttgctactttatttctgtctaactacttatgtgtactcggtccttccgtactacgtttcggccgtagggacctaacgtggagatacgaacgtaacgtggtggctgctaccatctcgtcttcacttcctccgtcc

SEQ ID NO: 219612 - DNA, 607 bp, Homo sapiens
  misc_feature: GYAE6OF02G6P6W.24.87.H10.1.454.CMB.1.raw
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaacctggccaggctcccaggctcctcctctatgctgtctccaccacgggcccctggtcgtcccagccaggttcgtgggcggttgggtctgggacagtatttcactcncacntcgagccgcctccagtctgaatctttgctactttatttctgtctaactacttatggtcgtacttcggtcccttccgtaccttaccgtttttcgggacccgtaacgggggtaaccctaaacggtcgggtaacgtacgttaaccgaaaccggtaacgttggtacgggtaccttacggaccgtacctacgttccgttacggttccttaccgtaccgtttcccgttccccgtacccg

SEQ ID NO: 219613 - DNA, 501 bp, Homo sapiens
  misc_feature: GYAE6OF02GTAT0.24.87.H10.1.454.CMB.1.raw
  modified_base (420)..(420): a, c, t, g, unknown or other
  misc_feature (420)..(420): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctttgtctccaggggagagagccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacagacttcactctcatcatcgacagactggagcccgaagattttgctagtgtattactgtcngcttgtttgtccctctcctctatgtactactttcgcctagggttccaggtctggagatcgaagcgactgtggctgctaccg

SEQ ID NO: 219614 - DNA, 551 bp, Homo sapiens
  misc_feature: GYAE6OF02I3PCB.24.87.H10.1.454.CMB.1.raw
  modified_base (203)..(203): a, c, t, g, unknown or other
  misc_feature (203)..(203): n is a, c, g, or t
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagtaatgttggcagcaacttgcctggtaccagcagaaaacctggccaggcctcccagggctcctcctctatgctgtcctccaccgacgggcccctggtcgtccccagccaggttcgtggcggtgggtcgtagggcagtatttcactctcaccatcagtcgctccagtctgaagtntttgctactttattctgttacaactctagtgtntctcggtcctccgtactcgtttggaccgtagggaacctaacgtggtacgacgtacgaacgtactggtggtctcgactacctagttcgtacgttccttctacttcctcccgtacc

SEQ ID NO: 219615 - DNA, 553 bp, Homo sapiens
  misc_feature: GYAE6OF02F939E.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaacctggccaggctcccaggctcctcctctatgctgtctccaccagggcccctggtcgtcccagccaggttcgtggcggtgggtctgggacagacttcactctcaccgtcagcagcctagacgcctagaacgtattttgcggttttactactgtcagcacgtcgttccgccgtcggcccgtcgttaaccgtttccggggccggggggtacccgtagggggtcggaggaggaggacgaacgtggtggcgtggcgaccatctgttcttcacttccttcccgctactctacg

SEQ ID NO: 219616 - DNA, 536 bp, Homo sapiens
  misc_feature: GYAE6OF02F31HT.24.87.H10.1.454.CMB.1.raw
  modified_base (201)..(201): a, c, t, g, unknown or other
  misc_feature (201)..(201): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagccatcaccggaggaattgtgttgacgcagtctccaggcaccctgtctttgctccaggggganagagccaccctctcctgcagggccagtcagagtgttagcagcagctacttagcctggtaccagcagaaacctggcctggctcccaggctcctcatctatggtcgcgtccaccacgggccactggcgtcgcggacaggttcagtggcagtggctttgggacagacttcactctcatcatcgacagactggacgcccgaagtatttgctagttgtatttactgtcagtcttgtttcggtccctcttcctccttattcgttacttacgtttcggcctacgggttccagggtcgttgggagtacgtcgaagcgtaacgttggtcggctcgccacctacg

SEQ ID NO: 219617 - DNA, 589 bp, Homo sapiens
  misc_feature: GYAE6OF02FHZW7.24.87.H10.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
tcagactactatgtcacgaccggtgctcgatttagcagtactgcgttgggtttgggggaggaactgctcagttaggacccagagggaaccatggaagccccagctcagcttctcttcctcctgctactctggctcccagagaccaccggagaaattgtgttgacacagtctccaggccaccctgtctttgtcctccgagggganagagccacctctcctgcagggccagccggagtgttagtaagtacttaggctggtaccaanagaaacctggccaggctccaggctcctcatctatgatgtctccaacngggtcacgtggccgtccccgcaggttcaggtggcaggtgggtctgggacagacttcccatctcaccgtcagcagcctagacgcctagaagtattttggcggttttactactgtcagcagtccgttccgccttcggcccgtcttaaccgtttcggggacgggggtaccgaggggttcgggaggacgggacgaacggaacgttggtcggctgaccaccgtacgttcgtcgttccttacacttcccgttcccgcctacttccgtacgtaactagttaacgg

SEQ ID NO: 219618 - DNA, 551 bp, Homo sapiens
  misc_feature: GYAE6OF02JIHMS.24.87.H10.1.454.CMB.1.raw
  modified_base (273)..(273): a, c, t, g, unknown or other
  misc_feature (273)..(273): n is a, c, g, or t
  modified_base (500)..(501): a, c, t, g, unknown or other
  misc_feature (500)..(501): n is a, c, g, or t
tcagactactatgtcacgaccggtgctcgatttagcagtactgcgttgggtttgggggaggaactgctcagttaggaccagacggaaccatggaacgcccagcgcagcttctcttcctcctgctactctggctccagactaccactggagaagtagtcatgacgcagtctccacgccacctcgtctgtcgtctcgagggaagacgccacctcctcctcgcgcggcagtgacgaagtcgttaggcaagacaacttaacgacctacggtaccacnggaccaggaaacctggccacggactccacggctcctcctctactcgctcgtctccaccacgggcccgtcggtcgtccgacgccgtacggttcgttcggcggtcgggtcgtcgggacgtacgtacgttctacgtctcgaccactcacgcggccgtccacgtacgtacgtaagtagtttacgtctactttactttctcgtactaactactatgtacgacgtcgtctacnntactacgtttacggtaccgtacgggaccgtaacgtacggtacgtagtacg

SEQ ID NO: 219619 - DNA, 517 bp, Homo sapiens
  misc_feature: GYAE6OF02GQD0F.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtcctccaccagggcccctggtcgtcccagccaggttcgtggcggtgggtctgggacagtatttcactctcacatcagcgcctcagtctgagtatttgctactttattctgtcaactactatgtgtactggcctccgtactacgtttcggccgtagggaccaacgtggagatacaacgactggtggctgacaccatctgtcttcacttcctccgtcc

SEQ ID NO: 219620 - DNA, 636 bp, Homo sapiens
  misc_feature: GYAE6OF02JKCEW.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggccctccgaggcctccctacctctatcgcctcgtcctccgaccgacgggcccctgggtctcccgagcccgtaggttccggttcggcggtagggtctgggaccaggtactttcacttctacgaccctatccgaggccgtcctccgtacgttccgtagtaacgtacttttcgaccttacgtttactttcgttacgttaccgtaacctacttacgttaggtcgtacgtcggtaccgttccgttactaccgttttcggccgtacgggtacctaacgtacggtacgtacgtacgaacgtaacgtcgtacggactacggacctaccgtagtccgttacgtccttacgtacgttccttacccgtaccg

SEQ ID NO: 219621 - DNA, 589 bp, Homo sapiens
  misc_feature: GYAE6OF02H86I2.24.87.H10.1.454.CMB.1.raw
  modified_base (203)..(203): a, c, t, g, unknown or other
  misc_feature (203)..(203): n is a, c, g, or t
  modified_base (391)..(391): a, c, t, g, unknown or other
  misc_feature (391)..(391): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagcccaccctctcctgcagggccagtgagaatgttggcagcaacttagcctggtaccagcagaaacctggccaggctcccaggctcctcctctatgctgtctccaccacgggcccctggtcgtcccagccgaggttcgttggcggtgggtctgggacagtatttcactctcaccatcacgcggcctcncgtctgaagtatttgctactttatttcgtgtacaactactagtggtacgtacgtcggtccttccgtaccttacgttttcggaccgtacggggaacctaaacgtggaacgtactaccgaacgtaacgtaggtcggtcctcggaccacctaacgttccgttacggttcctttaccgtaactttcccgttaccccgtaccc

SEQ ID NO: 219622 - DNA, 582 bp, Homo sapiens
  misc_feature: GYAE6OF02ISVEV.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccacctctcctgcagggccagtgagaatgttggcagcaacttagcctggtaccagcagaaacctggccaggctcccgaggcctcctcctctatgctgtctccgaccacgggcccctgggtcgtcccagcctaggttccgtggcggtgggtctgggacaggtatttcgactctcgaccatcacgccgtcctaccgacgtctacgtaagtacgttttcgacttaacttttatttctgtacaactactatcggtacactggcctcgtactacgtttcgccgtacggacctaacgtcggaagtactacgaacgtactggtacgtctaggacctaaccgtacgttcgttacgttaccttcgtaaccttcccgttcccgtacc

SEQ ID NO: 219623 - DNA, 259 bp, Homo sapiens
  misc_feature: GYAE6OF02FVLP1.24.87.H10.1.454.CMB.1.raw
  modified_base (255)..(259): a, c, t, g, unknown or other
  misc_feature (255)..(259): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttccgccatctgaacatagtagtctgagcgggctggcaaggcgcatagnnnnn

SEQ ID NO: 219624 - DNA, 538 bp, Homo sapiens
  misc_feature: GYAE6OF02IKXGO.24.87.H10.1.454.CMB.1.raw
  modified_base (203)..(203): a, c, t, g, unknown or other
  misc_feature (203)..(203): n is a, c, g, or t
  modified_base (366)..(366): a, c, t, g, unknown or other
  misc_feature (366)..(366): n is a, c, g, or t
  modified_base (435)..(435): a, c, t, g, unknown or other
  misc_feature (435)..(435): n is a, c, g, or t
  modified_base (482)..(482): a, c, t, g, unknown or other
  misc_feature (482)..(482): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatcgctgtcctccaccacgggcccctggtcgtcccgagccgtaggtttcgtggcggtgggtctgggacagntttcactctacacatcagccgcctcagtctagaagtatttcgctacttatttctgtcaactctatggtnactggtcctcgtacgtctttggccgtacggggacctaaacgtggaanactacgaacgtactggtggctgacctacattctcgttcttccacttcctcccgtac

SEQ ID NO: 219625 - DNA, 521 bp, Homo sapiens
  misc_feature: GYAE6OF02HI2TS.24.87.H10.1.454.CMB.1.raw
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
  modified_base (429)..(429): a, c, t, g, unknown or other
  misc_feature (429)..(429): n is a, c, g, or t
  modified_base (463)..(463): a, c, t, g, unknown or other
  misc_feature (463)..(463): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctcccaggctcctcctctatgctgtctccaccagggccccctgggtcgtccccagccctaggttcgttggcggtgggtctgggacngatttcactctcaccatcagcagtgtagagcctgaagtatttgctagtttattactgtcagcacgtnacaactgaccctagttcggccctgggaccagtcnggacatacccagtaactgcggctgccaccgatctacgttccttcacttcctcccgtac

SEQ ID NO: 219626 - DNA, 546 bp, Homo sapiens
  misc_feature: GYAE6OF02F2F3V.24.87.H10.1.454.CMB.1.raw
  modified_base (203)..(203): a, c, t, g, unknown or other
  misc_feature (203)..(203): n is a, c, g, or t
  modified_base (445)..(445): a, c, t, g, unknown or other
  misc_feature (445)..(445): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtcctccaccagggcccctggtcgtccccagcccaggttcgttcgggcggttgggtcgtgggacaggtactttcacgtctcacctatcacgcggcctccagtctgaagtattttgctactttatttctgtctaacactattggtnacgtcggccttccgtactccttttcggccgtacggggacctaaacgtggaatagtacaacgactggtggctcgacacatctgtcttcacttcctcccgtcc

SEQ ID NO: 219627 - DNA, 537 bp, Homo sapiens
  misc_feature: GYAE6OF02F72VF.24.87.H10.1.454.CMB.1.raw
  modified_base (203)..(203): a, c, t, g, unknown or other
  misc_feature (203)..(203): n is a, c, g, or t
  modified_base (358)..(358): a, c, t, g, unknown or other
  misc_feature (358)..(358): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctcccaggcctcctcctctatgctgtctccaccagggcccctggtcgtcccagccaggttcgttggcggtgggtctgggacngatttcactctcaccatcagccgcctccagtctgaagtatttgctactttatttctgttctaactacttatggtgactggtccttccgtacctacgttttcggccgtacgggtacctaacgtggagatacgaacgactggtggtctgactacatctcgtcttctacttcctcccgtacc

SEQ ID NO: 219628 - DNA, 750 bp, Homo sapiens
  misc_feature: GYAE6OF02J3RHH.24.87.H10.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (488)..(488): a, c, t, g, unknown or other
  misc_feature (488)..(488): n is a, c, g, or t
tcagactactatgtcacgaccggtgctcgatttagcagtactgcgttgggtttgggggaggaactgctcagttaggacccagacggaaccatggaagccccagcgcagcttctcttcctctgctactctggcctcccagataccactggacgaagtagtcatgacgcagtctccagccacctgtctgtgtctaccgaggggaanacgccacccttcnccgtgccgagggccagtgacgaatggttgacagactaacgttgccgtaggtaccagacaacgaacctggccaggcctcccgaggcctacctcctctactcgcctcgtcctaccgaccgacgggtccccctggtccgtccccgacggtccgttagggttccggtttacggggcggttcggtcggtcgggtactaggttactttccgaccttcgccacctactccgtacggccgggtcctccgtacgtccgttacggtaagttccgttttacnccgttttaaccgttttatttacccgtacgttaccgttaaacctacgtttaaggtccggtttacgtaccgtccggttaaccccgttaccgttaaccgttaccggttttaccgggacccggttaacgggtaaaccctaacggttacgggtaactaaccgtaaccgaaacggttaccggtccggttaacggtcctacgtaacccgttaactaaccgtttcgttcggtacccctttacgtcccgtttaccccgttcccgttaaccg

SEQ ID NO: 219629 - DNA, 253 bp, Homo sapiens
  misc_feature: GYAE6OF02FPTIB.24.87.H10.1.454.CMB.1.raw
  modified_base (248)..(248): a, c, t, g, unknown or other
  misc_feature (248)..(248): n is a, c, g, or t
tcagactactatgtcacgaccggtgctcgatttagcagtactgcgttgggtttgggacagatttcactctcaccatcagcggcctccagtctgaagatttgcactttatttctgtcaacactatggtgactggcctccgtacacttttggccaggggaccaaactggagatcaaacgaactgtggctgcaccatctgtcttcatcttcccgcatctgaacatagtagtctgagcgggctggcaaggcncatag

SEQ ID NO: 219630 - DNA, 802 bp, Homo sapiens
  misc_feature: GYAE6OF02I60MU.24.87.H10.1.454.CMB.1.raw
  modified_base (208)..(208): a, c, t, g, unknown or other
  misc_feature (208)..(208): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccacctgtctgtcgtcgtaccgaggggaaacncgcccaccctctcctggccagggccaaggtgagtaactcgttaggcagtcaaccttagccctaggtaccagcgacgaacctggacccaggccttcccgaggccttccgtcctctactcgtccgtcggtcctccgaccgtaccgggccccttggtccgtccccgaggtccccgtagggtttccggtcggtccgggttacggggtccgtacgggggtacctaacgggttacgtttccgaccgttcttacccgaaccctacgtccgaacggtcccggtacccttaccgaacgttaccgtacggtaaacggtactttttcggtacctttaacttttaacgttttccgtacggtttaacctaaaccgtaacgtttacgttacggttaccgtaccgtaccgggttcccgttaccgggttaccttaccggtttttaccgggacccggtaacggggtaaccctaaacgggttcggtaacgtaacgtaccgtaaaccggtacgttacgggtacggtaccgttacggaaccctaacccgttagtttacccgttaccggttaccctttaaccgtacccgttttaccccgttacccccggtaaccc

SEQ ID NO: 219631 - DNA, 609 bp, Homo sapiens
  misc_feature: GYAE6OF02GRXCJ.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgagggggaaagngcccaccctctcctgcagggccagtgagaatgttggcagcaacttagcctggtaccagcagaaacctggccaggcctcccaggcctcctcctctatcgctgtcctccaccgacgggcccctggtcgtcccagccaggttcgtggcggtgggtctgggacagtacttcactctcacgtcagcagcctagacgcctgaacgtagttttcgtacggtttactacgttgtactacgcgacggtccgttcccgccgtcggccgtccgttaaccggtttccggggaccggggggtacgtcggggtacgggacggagggacggaacggtaacgtggtacggcgtcggcctaaccgacgttccttcggttcttccgtacgttcccgtttaccccggcctaccgtctaacgg

SEQ ID NO: 219632 - DNA, 530 bp, Homo sapiens
  misc_feature: GYAE6OF02GYSIT.24.87.H10.1.454.CMB.1.raw
  modified_base (204)..(204): a, c, t, g, unknown or other
  misc_feature (204)..(204): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagatgttggcagcaacttagcctggtaccagcagaaacctggccaggctccaggctcctcctctatgctcgtctccaccagggcccctggtcgtcccagccaggttcgtggcggtgggtctgggacaggtatttactctcaccatcagcggcctcgagtctgaagtnttttgctactttattctntctaactactagtgtgactcggtcctcgtctactttcggccgtacgggaccaagtcggacgatacaacgtacgtagtcggctacgcaccactctcgttcttcactccttccgctac

SEQ ID NO: 219633 - DNA, 552 bp, Homo sapiens
  misc_feature: GYAE6OF02IWIC9.24.87.H10.1.454.CMB.1.raw
  modified_base (334)..(334): a, c, t, g, unknown or other
  misc_feature (334)..(334): n is a, c, g, or t
  modified_base (408)..(408): a, c, t, g, unknown or other
  misc_feature (408)..(408): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctccgaggggaaagagcccaccctctcctgcagggccagtgagaatgttggcagcaacttagcctggtaccagcagaaacctggccaggcctcccaggcctcctcctctatgctgtcctccaccgacgggcccctggtcgtcccngccagggttcgttggcggtgggtcgtgggacaggtatttcactctcaccatcacgcgcctccagtctgtaagtnttttgctactttatttctgtactaactactatgtgactcggctccgtactacgtttcggcgtacggggacctaaacgtggaagatacgaacgacgttcgtggtctgccacgtactctcgttcttccgacttccgttcccgtacc

SEQ ID NO: 219634 - DNA, 511 bp, Homo sapiens
  misc_feature: GYAE6OF02GAU1V.24.87.H10.1.454.CMB.1.raw
  modified_base (203)..(203): a, c, t, g, unknown or other
  misc_feature (203)..(203): n is a, c, g, or t
  modified_base (428)..(428): a, c, t, g, unknown or other
  misc_feature (428)..(428): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggcctcctcctctatgctgtctccaccagggcccctggtcgtcccagccaggttcgtggcggtgggtctgggacagatttcactctcaccatcagcgcctccagtctgaagtatttgctactttatttctgtcaactactatgtnactggccttccgtactcttttggccgtagggaccaaacgtggagatacaacgactgtggctgcacatctgtctcattctccgc

SEQ ID NO: 219635 - DNA, 534 bp, Homo sapiens
  misc_feature: GYAE6OF02FYYQ2.24.87.H10.1.454.CMB.1.raw
  modified_base (203)..(203): a, c, t, g, unknown or other
  misc_feature (203)..(203): n is a, c, g, or t
  modified_base (522)..(522): a, c, t, g, unknown or other
  misc_feature (522)..(522): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttgcctggtaccagcagaaacctggccaggctcccaggcctcctctctatgctgtcctccaccagggcccctggtcgtcccagcctaggttcgttggcggtgggtcctggggacaggatttcactctcaccatcagccggcctccgagtctgaagtattttgctactttattctgtacaactacttatggtgacgtggcccttccgtactacgtttcggccgtaggggaaccaacgtggaagagtacaacgactggtgctcgcaccatctgttctcncttcctcccgtc

SEQ ID NO: 219636 - DNA, 618 bp, Homo sapiens
  misc_feature: GYAE6OF02HR6AK.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctcgaggggaaangccacctctcctgcagggccagtgagaatgttggcagcaacttagcctggtaccagcagaaacctggccaggctccaggctcctctctatcgctgtctccaccgacgggcccctggtcgtcccgagcctagggttcgtgggcggtgggtcgtgggactaggtactttcgactctacaccactcgagccggtacctccgacgtctagtaagtacttttgccttactttatttcgttgttactaactaccgtattggttacgtactcggtcccttccggttaccttacgttttcggaccgtaacggggaacctaaaccggtggaacgacgttacgaaacgtaacgttcggtcggtaccgtcgacgtaacccagttccttacggttacctttaccgtactttcccgttaccccgtaccg

SEQ ID NO: 219637 - DNA, 558 bp, Homo sapiens
  misc_feature: GYAE6OF02IURZE.24.87.H10.1.454.CMB.1.raw
  modified_base (204)..(204): a, c, t, g, unknown or other
  misc_feature (204)..(204): n is a, c, g, or t
  modified_base (397)..(397): a, c, t, g, unknown or other
  misc_feature (397)..(397): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagatgttggcagcaacttgcctggtaccagcagaacctggccaggctcccaggctcctcctctatgctgtcctccaccacgggcccctggtcgtcccagcctaggttcgtggcggtgggtctgggacagtattcactctcaccatcacgcgcctcctagtctgaagtntttgctactttattctgtcctaactacttagtggtgtacgtggcccttcgtaccttacgttttcgggccgtacggggaacctaaacgtggaacgatacgaacgtactggtggcctggaccaccgtattccgttgttccttacgacttcccgttcccgtacc

SEQ ID NO: 219638 - DNA, 548 bp, Homo sapiens
  misc_feature: GYAE6OF02GPLQ7.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaagagccaccctctcctgcagggccagtgagaatgttggcagcaacttagcctggtaccagcagaacctggccaggctcccaggctcctcctctatgctgtctccaccacgggcccctggtcgtcccagccaggttcgttggcggtgggtctgggacagtatttcactctcaccatcagcgcctccagtctgaagtatttgctactttatttctgtacaactactatggtgtacgtggtccttccgtactacgttttcggccgtacggggaacctaaacgtggaagtactacaaacgtacgtggtcggtcgtgcaccgatccgtgttccttcacgttccttcccgtacc

SEQ ID NO: 219639 - DNA, 654 bp, Homo sapiens
  misc_feature: GYAE6OF02HS81E.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaanagccacctctcctgcagggccagtgagatgtggcagcaacttgcctggtaccagcagaaacctggccaggctccaggctcctcctctatgctgtcctccaccgacgggccccctggtcgtcccacgcccgtaggttcggttgggccggtggggtctgggacagtatttcactctacaccatccgagccgtcctccgtacgtctacgtaacgtattttcggtcttactttacttttccttacgttacctaactaaccttagttggttacgtacgttccgggtcccgttacccggttaaccgttaccgtttttacgggacccggtaacgggggtaaccctaaaacggtacgggtaacgtaacgttaaccgaaacgtaacgttacggtacggtccgttacggacctaccgtagttccgttcgttccgttacctaccttcccgttccccgtacccg

SEQ ID NO: 219640 - DNA, 531 bp, Homo sapiens
  misc_feature: GYAE6OF02I8X3G.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagctcagcttctcttcctcctgctactctggctcccagataccactggagaagtagtcatgacgcagtctccagccaccctgtctgtgtctccaggggaaagngccaccctctcctgcagggccagtgagaatgtggcagcaacttgcctggtaccagcagaaacctggccaggctcccaggctcctcctctatgctgtctccaccgagggcccctggtcgtcccagccaggttcgttggcggtgggtctggggacagtatttcactctcaccatcagcgcctccagtctgatatttgctactttatttctgttcaactactatggtgactggcctcgtactcgttttcggcctaggggacctaaacgtcggagatacaacgtacgtgtcggactgcacgtactcgtcgtcttctactccttccgtaccc

SEQ ID NO: 219641 - DNA, 561 bp, Homo sapiens
  misc_feature: GYAE6OF02GY28S.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccagggcccctggtcgtcccagccaggttcgtggcggtgggtctgggacagatttcactctcaccatcagccggcctccagtctgaagtatttgctactttattctgtctaacacttagtggtcgacttcggcccttccgttacctacgttttcgggacccgtacggggtaacccaaacgtcggaagtactacgaacgtactaggtcggactgacctacctatcgttcgttccttactacttccttcccgtacc

SEQ ID NO: 219642 - DNA, 525 bp, Homo sapiens
  misc_feature: GYAE6OF02G0Q4T.24.87.H10.1.454.CMB.1.raw
  modified_base (203)..(203): a, c, t, g, unknown or other
  misc_feature (203)..(203): n is a, c, g, or t
  modified_base (375)..(375): a, c, t, g, unknown or other
  misc_feature (375)..(375): n is a, c, g, or t
  modified_base (398)..(398): a, c, t, g, unknown or other
  misc_feature (398)..(398): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtcctccaccagggcccctggtcgtcccagccaggttcgtggcggtgggtctgggacagtatttcactctcaccntcagcggcctccagtctgaagtnttttgctactttatttctgtcaactactatggtgactgtcctccgtactcgtttggccgtagggaccaacgtggagatacaacgactgtggctgccaccatcgtgttccttcacttcctcccgtacc

SEQ ID NO: 219643 - DNA, 552 bp, Homo sapiens
  misc_feature: GYAE6OF02HF2WX.24.87.H10.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
tcagactactatgtcacgaccggtgctcgatttagcagtactgcgttgggtttgggggaggaactggcttcagttaggacccagacggaaccatggaagccccagcgcaagcttctcttcctcctgctactctggctccagataccactggagaagtagtcatgacgcagtctccagccaccctgtctgtgtctccaggggaaanagccacctcctcctgcagggccagtcagagtgttancagcagctactagcctggtaccagcagaaacctggcctggcctcccgaggctcctcatctatggtnccgtccacgngggccactggcgtcgcggacnggttcagtggcagtgcgtttgggactagtacttcactctcagtcactcgacagactcggacgccgtaagtactttcgacgtagtagttacttacgtgtctagtcttcgttcggtccctctaccttcttactcgtacgtacgtttgaccgtacggttccgacggtcgtaggtagtacgtacgtacgacgtacgttggtcggacgtgacgtaaccg

SEQ ID NO: 219644 - DNA, 621 bp, Homo sapiens
  misc_feature: GYAE6OF02I42PQ.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagatgttggcagcaacttagcctggtaccagcagaaacctggccaggctcccaggctcctctctatgctgtcctccaccgacgggtcccctggtcgtcccagccaggttcgtggcggtgggtctgggacagtatttcactctcacctatcgacgccggcctccgagtcctagtaacgtattttgcttacgtttactttcgtgttactaactacttagttggtacgtaccgttcgggtcccttccgttaccttacgtttttacgggcccgtaacggggtacctaaacgttcgggaacgtacgttaccgaaacgtaacgttaggtcgggtacctcggtaccctaaccgtatttccgttcgttaccgtttactaccgttcccttaccccggtaccc

SEQ ID NO: 219645 - DNA, 548 bp, Homo sapiens
  misc_feature: GYAE6OF02GPHLH.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactggctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttgcctggtaccagcagaaacctggccaggcctcccaggctcctcctctatgctgtcctccaccacgggcccctggtcgtccccagtcctaggttccgttgggccggttggggtctggggacagtatttcactctcacatcgagcggcctccacgtctagaagtatttgctactttatttctgtacaactactatggtgtctggcctccgtactcgtttggccgagggtaccaaacgtggagactacgaacgacgtggtcggctgaccaccgtatctcgttccttctacttcctcccgtacc

SEQ ID NO: 219646 - DNA, 517 bp, Homo sapiens
  misc_feature: GYAE6OF02GGMCY.24.87.H10.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctntcctgcagggccagtgagaatgttggcagcaacttagcctggtaccagcagaaacctggccaaaggctcccaggctcctcctctatgctgtctccaccagggcccctggtcgtcccagccaggttcgtggcggtgggtctgggacagatttcactctcaccatcagcgcctccagtctgagtatttgctactttatttctgtcaacacttatggtgactggcctccgtactacttttggccaggggacccaaacgtggaagatcaacgactggtggctgcacatctgtctcacttctcccgtacc

SEQ ID NO: 219647 - DNA, 527 bp, Homo sapiens
  misc_feature: GYAE6OF02F0NQN.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtcctccaccagggcccctgggtgtccccagccaggttcgttggcggtggggtctgggacagatttcactctcaccatcagcggcctccagtctgaagattttgctactttatttctgtcaacacttatggtgactggccttccgtactacttttggccgtaggggtaccaaactggagatacaacgaactgtggctcgcacagtctcgtcttctactctcccgtcc

SEQ ID NO: 219648 - DNA, 532 bp, Homo sapiens
  misc_feature: GYAE6OF02IOMOK.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttgcctggtaccagcagaaacctggccaggctccaggctcctcctctatgctgtcctccaccaggcccctggtcgtcccagccaggttcgtggcggtgggtctgggacagtatttcacgtctcaccatcgacgccgcctccagtctgaagtatttcgctactttatttctgttcaactactatggtcgtactcggtcctccgtacctacgtttggccgtagggtaccaacgtggacgatacgaacgtactaggtgtctgcactatctgtcttcacttccgtccctac

SEQ ID NO: 219649 - DNA, 614 bp, Homo sapiens
  misc_feature: GYAE6OF02HFO8G.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccacctctcctgcagggccagtgagaatgtggcagcaacttagcctggtaccagcagaaacctggccaggctcccaggctcctcctctatcgctgtctccaccacgggtcccctggtcgtcccagcctaggttcgttggcggttgggtctggggacaggtatttcacgtctcgacagtcaggccgtcctccagtctagaacgtattttgacttacgtttatttctgtactaactactagtggtagtacgtcggtccctccgttacgttacgttttcggaccgtaacggggacctaaacggtggtaacgtactaaccgaaacggtaacgttggtacggtaccgttacggaccctaaccgtattacccgttacggttcctttaccgtaactttcccgttaccccggtaaccc

SEQ ID NO: 219650 - DNA, 522 bp, Homo sapiens
  misc_feature: GYAE6OF02FZTKX.24.87.H10.1.454.CMB.1.raw
  modified_base (204)..(204): a, c, t, g, unknown or other
  misc_feature (204)..(204): n is a, c, g, or t
  modified_base (472)..(472): a, c, t, g, unknown or other
  misc_feature (472)..(472): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccagggggaaanagccaccctctcctgcagggccagtgagaatgttggcagcaacttgcctggtaccagcagaaacctggccaggctcccaggcctcctcatctatggtcgcgtccaccagggccacgtggcgtcgcggacaggttcagtggcagtggctttgggacaggacttcacttctcatcatcgacagactggacgcccgaagtatttgcagttgtattactgtcagtctgtttcgtcctctcctcttatcgttactctttggcctagggttccngtcgtggacgtatcgaacgtcgaacgtggtcggtctgcctacctattccg

SEQ ID NO: 219651 - DNA, 564 bp, Homo sapiens
  misc_feature: GYAE6OF02IO8PD.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagngcccaccctctcctgcagggccagtgagaatgttggcagcaacttgcctggtaccagcagaaacctggccaggctcccaggctcctcctctatgctgtcctccaccgacgggcccctggtccgtcccagcctaggttcgtgggcggtgggtctgggacagtatttcactctcaccatcagcgcctccgagtctgaagtatttgctactttattctgtcaactacttatggtgtactggtcccttccgtacctacgttttcggaccgtacggggaaccctaaacggtcggaagagtaccaacgtacgtaggtcggtactgaccactacgtctcgttccttctacttcccttcccgtaccc

SEQ ID NO: 219652 - DNA, 652 bp, Homo sapiens
  misc_feature: GYAE6OF02FU0JN.24.87.H10.1.454.CMB.1.raw
  modified_base (238)..(238): a, c, t, g, unknown or other
  misc_feature (238)..(238): n is a, c, g, or t
  modified_base (329)..(329): a, c, t, g, unknown or other
  misc_feature (329)..(329): n is a, c, g, or t
  modified_base (411)..(411): a, c, t, g, unknown or other
  misc_feature (411)..(411): n is a, c, g, or t
tcagactactatgtcacgaccggtgctcgatttagcagtactgcgtttggggttttgggggggaaggaacgtagctcaggttacccggacccgagtacggaaccgatggaaggccccagcgcgacgcgttctcttccctccgtgacgtactcttcggcctcccagactaccacgtggacggaagtaggtcaagtggacgacagtctccagccaccctgtctttgtctccaggggaaanagccaccctctcctgcagggccagtgagaatgttggcagcaacttagcctggtaccagcagaaacctggccaggctcccaggctcctcctntatgctgtctccaccacgggccccctggtcgtcccagccaggttcgttggcggtggtctgggacagtatttcactctcaccntccagccggcctccgagtctagaacgtgttttcgctacttttatttctgttaccaacgttacctagttgggttacgtacttcgggtcccttccgtaccgttaccgtttttcgggacccgtaaggggtaccctaaacgttcggaaggacttaccgaaaccgtacgttggtcggtaccgtcgaccaaccgacgtttccgttaggttcctttaccgtactttcccgtttccccgaccttaaccg

SEQ ID NO: 219653 - DNA, 586 bp, Homo sapiens
  misc_feature: GYAE6OF02IZYYU.24.87.H10.1.454.CMB.1.raw
  modified_base (205)..(205): a, c, t, g, unknown or other
  misc_feature (205)..(205): n is a, c, g, or t
  modified_base (378)..(378): a, c, t, g, unknown or other
  misc_feature (378)..(378): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaaangccacctctcctgcagggccagtgagaatgtggcagcaattagcctggtacagcagaaacctggccaggctcccgaggctcctcctctatcgctgtcctccaccgacggcccctggcgtcccagcctaggttcgtggcggtgggtactgggactggtatttcacgtctcaccntcagccggtcctcgtagtcctagaagtatttgtctactttcttctgtactaacgtacttgtgttacgtacgtcggtcctaccgttactacgttttcggccgtaacgggacctaaagtcggtaacgatacgaacgtaagtcggtacggtacgttgaacctaccgtaacgttcgttacgttaccttacgtacttcccgttacccgtaccg

SEQ ID NO: 219654 - DNA, 607 bp, Homo sapiens
  misc_feature: GYAE6OF02IFF3D.24.87.H10.1.454.CMB.1.raw
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
  modified_base (397)..(397): a, c, t, g, unknown or other
  misc_feature (397)..(397): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtcttcagccaccctgtctgtgtctcgaggggaaagagccaccctctcctgcagggccagtgagaatgtggcagcaacttagcctggtaccagcaagaacctggccaggcctcccaggctccctcctctatcgcttgtcctccaccgacgggcccctggtcgtcccgacgccgtaggttcgtgggcggtgggtcgtgggacngtatttcactctcacntcagccgcctcngtctgaagtatttgctactttatttctgtactaactactagtgtcgacgtcggtcctaccgttactaccgtttcggaccgtaacggggaacctaaacggtacggacgtaacgtaccgaaaccggtaacgttggtacggtccgtacgggtaccctaacccgtattccgttacggtttcctttacctaccgtttcccttacccccgtacccg

SEQ ID NO: 219655 - DNA, 583 bp, Homo sapiens
  misc_feature: GYAE6OF02HR7I1.24.87.H10.1.454.CMB.1.raw
  modified_base (203)..(203): a, c, t, g, unknown or other
  misc_feature (203)..(203): n is a, c, g, or t
  modified_base (399)..(399): a, c, t, g, unknown or other
  misc_feature (399)..(399): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttgcctggtaccagcagaacctggccaggctcccaggctcctcctctatgctgtcctccaccacgggcccctggtcggtcccagccaggttcgtggcggtgggtctgggacagtatttcactctcaccatcagcgtcctccagtctagaagtntttgcttactttatttctgtctaactactatggtagtacttggccttccgtacttacgttttcgggccgtaacggggtaaccctaaacggtggaacgtaactacgtaaacgtaacgttagggtcggtacctggacctaaccgtacttcgttcgttcctttacctacgtttcccttacccgtacc

SEQ ID NO: 219656 - DNA, 617 bp, Homo sapiens
  misc_feature: GYAE6OF02IPR9U.24.87.H10.1.454.CMB.1.raw
  modified_base (118)..(118): a, c, t, g, unknown or other
  misc_feature (118)..(118): n is a, c, g, or t
  modified_base (201)..(201): a, c, t, g, unknown or other
  misc_feature (201)..(201): n is a, c, g, or t
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
tcagactactatgtcacgaccggtgctcgatttagcagtactgcgttgggtttggggaggaactgctcagttaggacccagacggaaccatggaagccccagcgcagcttctcttccncctgctactctggctcccagataccactggagaagtagtcatgacgcagtctccagccacctgtctgtgtctcgaggggaaangccaccctctcctgcagggccagtgagatgttgcagcaacttgcctggtaccagcaagaacctggccaggctccgaggctcctctctatcgctagcctccaccgcggccctgtcgccagcgtaggtcgttggcggtcggtacgtggacncgtacttcgacttcgtacacctntcgacggccgtcctcacgtctagacgtatttggacctacttttacgttctacggttacctaaactagttacgttcggtacgtacgtcggtcccgtttacgttaacccgttacgttttccggaaccggtaacggggtaacctaaaccgggttggaaacgaacttaccgaaaccgtagttcggacggtctacggtacctacgtagttccgtagttccgtttaccgactttacccgtcccggtaacc

SEQ ID NO: 219657 - DNA, 602 bp, Homo sapiens
  misc_feature: GYAE6OF02I2XTF.24.87.H10.1.454.CMB.1.raw
  modified_base (203)..(203): a, c, t, g, unknown or other
  misc_feature (203)..(203): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatggttggcagcaacttagcctggtaccagcagaacctggccaggcctcccaggcctcctcctctactgctgtcctccaccgacgggccccctgggtcgtcccgacgcctagggtttcggttcgggccggttggggtctggggactaggtactttcactcctcaccatccgacgccgcctccgtagtctagaagtntttcgctactttnttctgtacaactacttagtgtcgtacgtcggtccttccgttacttacgttttcgggaccgtaacggggtaaccaaacgttcggaacgtataccgaacgtacgttggtcgggtctacggaccacctattcgttacgttccttactactttccctcccgtaccc

SEQ ID NO: 219658 - DNA, 580 bp, Homo sapiens
  misc_feature: GYAE6OF02JFC2T.24.87.H10.1.454.CMB.1.raw
  modified_base (204)..(204): a, c, t, g, unknown or other
  misc_feature (204)..(204): n is a, c, g, or t
  modified_base (420)..(420): a, c, t, g, unknown or other
  misc_feature (420)..(420): n is a, c, g, or t
  modified_base (457)..(457): a, c, t, g, unknown or other
  misc_feature (457)..(457): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcagaaacctggccaggctcccaggctccctcctctatgctcgtctccaccgacgggcccctgggtcgtcccacgccgtaggttccgttggcggttgggtcgtggggacagtatttcacgtctctaccatcgacgtccggcctccgacgtcgtgaagtntttgcttactttatttctgtctaactacttagtggtntacgtcgtccttccgtacttacgttttcggaccgtacggggtaacccaaggtcggaagtactaacgaacgtacgtggtcgtctcgcacgtactcgtcgttaccttctacttccgtcccgtacc

SEQ ID NO: 219659 - DNA, 579 bp, Homo sapiens
  misc_feature: GYAE6OF02IBDEG.24.87.H10.1.454.CMB.1.raw
tcagactactatgtcacgaccggtgctcgatttagcagtactgcgttggggtttgggggaggaactgctcagttaggacccagacggaaccatggaagccccagcgcagcttctcttcctcctgctactctgtctcccagataccactggagaagtagtcatgacgcagtctccagccaccctgtctgtgtctccgaggggaaagcgcccaccctctcctgcacgggccaggtgagatgttggcagcaacttagcctggtaccagcagaaacctggccaggctcccaggctcctcctctatgctgtcctcccaccgacgggcccctggtcgtcccgagccgtagggttcgttgggcggttggggtcgttggggacagtatttcgactctcaacctatcagcgcctccagtctgaagtatttgactactttatttctgtactaactactatggtgactggcctcgtacctacgtttcgcgtacgggaccgtaaacgtcggaagtacgtacaacgtaacgtaggtcggtcctacgccaaccgtattccgttcgttccttctaccgttcccttcccgtaccc

SEQ ID NO: 219660 - DNA, 666 bp, Homo sapiens
  misc_feature: GYAE6OF02GR7WE.24.87.H10.1.454.CMB.1.raw
  modified_base (210)..(210): a, c, t, g, unknown or other
  misc_feature (210)..(210): n is a, c, g, or t
  modified_base (249)..(249): a, c, t, g, unknown or other
  misc_feature (249)..(249): n is a, c, g, or t
tcagactactatgtcacgaccggtgctcgatttagcagtactgcgttaggggtttgggggaggaactgctcagttaggacccagacggaaccatcggaaggccccagcgcagcttctcttcctcctgctactctggcttcccagtataccactggagaagtagtcatgacgcagtctccagccaccctgtctgtcgtctccgaggggaangccacctctccgtgcgacgggccagtgagaatgttggcngcaagttagcctggtaccagcagaaacctggccaggtcctccgaggcctcctcctactagtcgctgtcctccgaccgtacgggtccctgggtctcccgaggcctacggttcgtcgggtcggttgggtctggggacaggttactttcgactctaccactagtcgacgccggtcctccgacgttccgtaggaacgttacgtttacgtccttaactttactttcctacgtaacctaacctacgttagtcggtagtaccgtcgggtcccttccgttaaccgtaccgttttacggaccgtacgggtaaccctaaacggtacggaagtacgtaccgtaacgtacgtacggtacggtcgtacggtaccgaaccgttagttccgttacgtttaccgtttacgtaccgtttccctacccgtacccg

SEQ ID NO: 219661 - DNA, 544 bp, Homo sapiens
  misc_feature: GYAE6OF02H6XRV.24.87.H10.1.454.CMB.1.raw
  modified_base (309)..(309): a, c, t, g, unknown or other
  misc_feature (309)..(309): n is a, c, g, or t
  modified_base (520)..(520): a, c, t, g, unknown or other
  misc_feature (520)..(520): n is a, c, g, or t
tcagactactatgtcacgaccggtgctcgatttagcagtactgcgttgggtttgggggaggaactgctcagttaggacccagacggaacatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccncgggcccctggtcgtcccagccgaggttccgttgggcggtgggtctgggactagtatttcacttcctcacctatcagccggcctcagtctgaagtatttgcttactttatttctgtacctaactactattggtgtactcggtccttccgtacttcgtttcggccgtagggtaaccaacgtggagatacgaacgacgtgtggctcgctaccntctgtccttctcttccctccgtcc

SEQ ID NO: 219662 - DNA, 584 bp, Homo sapiens
  misc_feature: GYAE6OF02H424Z.24.87.H10.1.454.CMB.1.raw
  modified_base (202)..(202): a, c, t, g, unknown or other
  misc_feature (202)..(202): n is a, c, g, or t
  modified_base (410)..(410): a, c, t, g, unknown or other
  misc_feature (410)..(410): n is a, c, g, or t
tcagactactatgtcacgaccggtgctcgatttagcagtactgcgttgggtttgggggaggaactgctcagttaggacccagacggaacatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaacctggccaggctcccaggctcctctctatcgctgtcctccaccgacgggccccttggtcgtccccagcccgtagggtttccggttggggcggttcggggtctcggggactaggtatttcactcctcaccatcaggccgtcctccngtctgtaagtatttgcttactttatttcttgtactaactacttagtgtgtactcggtccttccgttactacgttttcggaccgtacggggtacctaacgtaggaacgtactacgaacgtacgtacggtggtcctgacctaccagtctcgttccttctacttcccttcccgtacc

SEQ ID NO: 219663 - DNA, 599 bp, Homo sapiens
  misc_feature: GYAE6OF02G6RP9.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagngccaccctctcctgcagggccagtgagaatgttggcagcaacttagcctggtaccagcagaaacctggccaggctcccaggcctcctcctctatgctgtcctcccaccgacgggccccctgggtcgtccccagcccgtagggttcgttgggcggttgggtctggggacagtcttcgactctccaccatccgacgccggtcctccgacgttctagtaacgtattttgcttactttatttccttgttactaactacttagtcggtagaccttggccttccgttacttaccgttttcggaccgttacggggaaccctaaacgtggaacgtataccgaacgtacgtggtcggacgtcggcctaccgattcgtcgttaccttcacttccttcccgtacc

SEQ ID NO: 219664 - DNA, 526 bp, Homo sapiens
  misc_feature: GYAE6OF02FJEXY.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtccccagcctaggttccgttggcggtgggtctgggacagatttcactctcacatcagcgcctcagtctgaagtatttgctactttattctgtactaactacttatggtgtactggtcccttcgtactacttttcggccaggggtaccaaacgtggagtatacaacgatggtgctgccacatctcgtcttcattccttcccacc

SEQ ID NO: 219665 - DNA, 549 bp, Homo sapiens
  misc_feature: GYAE6OF02FPUAI.24.87.H10.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (398)..(398): a, c, t, g, unknown or other
  misc_feature (398)..(398): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctntcctgcagggccagtgagaatgttggcagcaacttagcctggtaccagcagaaacctggccaggctcccaggcctcctcctctatgctgtctccaccagggcccctggtcgtcccagcctaggttcgttggcggttgggtctgggacagatttcactctcaccatcagcgcctcagtctgaagtntttgctactttatttctgtctaacactatgtgtactggcctccgtactacgttttcggccgtagggtaccaaacgtcggagtactacaacgtaactcggtcggctcggcctacacgttcgtacgttccttactacgttccttcccggtacc

SEQ ID NO: 219666 - DNA, 583 bp, Homo sapiens
  misc_feature: GYAE6OF02I454I.24.87.H10.1.454.CMB.1.raw
  modified_base (204)..(204): a, c, t, g, unknown or other
  misc_feature (204)..(204): n is a, c, g, or t
  modified_base (392)..(392): a, c, t, g, unknown or other
  misc_feature (392)..(392): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatgccaccggagacattgtgttgacacagtctccagccaccctgtctttgtctccgaggggaaanagccaccctctcctgcagggccagtgacatgttaggagttgttagctggtatcaacacaaacatgccaggctccccgtctcctcatctatgatgcatccaagtacggccacgtggcactcccagactaggttcagtcggactaggtggtctgggacagtactcactctacaccatcagctagtgtagngcctagaacgttatttcgactagttttactacgtgtacacgtccgtaccgtagaacctaaccgtcggtacccttaacgtttcccggccgttacgggaaccctaggtacctaggacctactacccggaaaccgtacgtcggtacggtcctacgacccgtaccgtacgttccgttacgttccttacgtacccg

SEQ ID NO: 219667 - DNA, 553 bp, Homo sapiens
  misc_feature: GYAE6OF02FSD3G.24.87.H10.1.454.CMB.1.raw
  modified_base (204)..(204): a, c, t, g, unknown or other
  misc_feature (204)..(204): n is a, c, g, or t
  modified_base (536)..(536): a, c, t, g, unknown or other
  misc_feature (536)..(536): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagatttcactctcaccatcagcgcctccgagtctgaagtattttcgctactttattctgttactaactactatggtagactggtccttccgtacttacgttttcggcccgtaggggaacctaacgtggaagatacgaacgtaactggtggtcgtcgctacctatctacgttccttacncgttcccttcccgtacc

SEQ ID NO: 219668 - DNA, 531 bp, Homo sapiens
  misc_feature: GYAE6OF02IM1C4.24.87.H10.1.454.CMB.1.raw
  modified_base (203)..(203): a, c, t, g, unknown or other
  misc_feature (203)..(203): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttgcctggtaccagcagaacctggccaggctccaggctcctcctctatgctgtctccaccagggcccctggtcgtcccagcccaggtttcgtggcggtgggtctggggacagactttcacttctcaccatcagcggcctccncgtcngagtatttgctactttatttctgtcaactactatggtgactgtcctccgttactacgttttcggaccgacgggaccaaacgtggagactacaacgactggtggtctcgcaccgatctcgtnttcncttcctcccgtcc

SEQ ID NO: 219669 - DNA, 571 bp, Homo sapiens
  misc_feature: GYAE6OF02HXT0O.24.87.H10.1.454.CMB.1.raw
  modified_base (201)..(201): a, c, t, g, unknown or other
  misc_feature (201)..(201): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
tcagactactatgtcacgaccggtgctcgatttagcagtactgcgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatgatgtctccaacgagggtcacgtggcctccccgcaggttcagtggcaggtgggtctgggacagtacttcactcncaccgtnagcagcctagacgtcctagagtattttgtacgtttactacgtgtcagcacgtccgttccgccgtcggccgtacgttaaccgtttccgggcgggggtaccgaggggtcggaggagggacggacgaacgtgtcggctgcaccgtagtcgttcgttcttctacgttccgttcccgctacttctacgtactatacgg

SEQ ID NO: 219670 - DNA, 529 bp, Homo sapiens
  misc_feature: GYAE6OF02GTSQY.24.87.H10.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccacgggcccctggtcgtcccagccaggttcgttggcggtgggtctgggacagatttcactctcaccatcagcggcctcagtctgaagtntttgctactttatttctgtcaactacttatggtntactggcctccgtactacgttttcggccgtagggaccaaacgtggaagagtacaacgactggtggctgcaccatctgtccttcacttcctcccgtacc

SEQ ID NO: 219671 - DNA, 554 bp, Homo sapiens
  misc_feature: GYAE6OF02F4A38.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctcccaggctcctcctctatgctgtctccaccagggcccctggtcgtcccagccaggttcgttggcggtcgggtctggggaccaggatttcactctcaccatcagcggcctccagtcctagagtatttgctactttattctgtcaacacttatggtgcgtcggcctccgtactacgttttacggcccgtaggggacctaaacgtggaagtactaccgaacgtaactgtacggctagacctaccgtatccgttcgtccttcacttccttcccgtacccg

SEQ ID NO: 219672 - DNA, 603 bp, Homo sapiens
  misc_feature: GYAE6OF02H6IZQ.24.87.H10.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (358)..(358): a, c, t, g, unknown or other
  misc_feature (358)..(358): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttgcctggtaccagcagaacctggccaggctcccaggcctcctctctatgctgtcctccaccncgggcccctgggtcncccagccgaggttcgtggcggtgggtctgggacngtatttcactctcaccatcgagccgtcctccacgtctgtaagtattttcgacttactttatttcttgtactaactactagtgtgacgtcggccttccgtacttaccgttttcggaccggtaacggggtaaccctaaacgtcggtaacgtaacgtaccaaaccggtacgttggtacgggtacctacggaccttaacctagtttccttacggttcctttaccgtacgtttcccgttaccccggtacc

SEQ ID NO: 219673 - DNA, 602 bp, Homo sapiens
  misc_feature: GYAE6OF02JD99D.24.87.H10.1.454.CMB.1.raw
  modified_base (204)..(204): a, c, t, g, unknown or other
  misc_feature (204)..(204): n is a, c, g, or t
  modified_base (378)..(378): a, c, t, g, unknown or other
  misc_feature (378)..(378): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangcccaccctctcctgcagggccagtgagaatgttggcagcaacttagcctaggtaccagcagaaaccgtggccaggcctacccgaggcctcctcctctactcgcctgtcctaccgaccgaccgggtcccctggtctcccacgcctacggttcgtcgggcggtgggtctgggacngtacttcactctcacctagtcacggtccgtacctccgagtcgtacgaagttctttacgcttactttactttctacgtactaactcttagttggtctacgtcgtcctccgtactacgtttcgcgtacgggacctaacgtggacgtacgtacgaacgtacgtacggttcggttacgacctaaccgtagttccgttacgtccttactacttccgttacccgccgtac

SEQ ID NO: 219674 - DNA, 259 bp, Homo sapiens
  misc_feature: GYAE6OF02HOLGI.24.87.H10.1.454.CMB.1.raw
  modified_base (255)..(259): a, c, t, g, unknown or other
  misc_feature (255)..(259): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgcatctgaacatagtagtctgagcgggctggcaaggcgcatagnnnnn

SEQ ID NO: 219675 - DNA, 729 bp, Homo sapiens
  misc_feature: GYAE6OF02JUY0Z.24.87.H10.1.454.CMB.1.raw
  modified_base (212)..(212): a, c, t, g, unknown or other
  misc_feature (212)..(212): n is a, c, g, or t
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctacccagataccatggagaagtgtcatgacgcagtctccagcccaccctgtcctggtacgtcctaccgaaggggaaancgcccaccctctcctgcaggccagtgagatgtgcagctaacttgccgtagtacngcaagaacctggaccaggtccctacccgaggtcctcctaccctntagtcgcttcgacctacccgaccgtacgggtccccttgggtcctccccgaaggtcccgttaagggttccggtacggggtccggtcggggttaccgttgggaacctacggtttacttcggaaccttcgtaccaacccggtataccggacgggtcccgtacccgttacgtacggttacgtaacggtaaggtttacgtttacgacgttttaccttttacttaccgttacgttacttaaccgttacttacggttacggtacgttaccgtcgggtacccttacggttaaccttccggtttacgggaacccggtacggggtaaaccttaggtacggaacgttaacgtaccgaacggtacgttacggacgtcgtaccgtcctaacctggtaccttacgtccttccaccggtttaccctcgttaccc

SEQ ID NO: 219676 - DNA, 625 bp, Homo sapiens
  misc_feature: GYAE6OF02JZPKU.24.87.H10.1.454.CMB.1.raw
  modified_base (233)..(233): a, c, t, g, unknown or other
  misc_feature (233)..(233): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctggtgtctccgagggaagacgccaccctctcctgccagggccagtganatgtggcagcattgctgacagcagaactggcaggctccagctcctcctntactnctgtcctcaccgcggcccctggtcgcccacgtccagggttctgggcggtgggtcgtcgggacagtacgtttcactctcacgtatcgacgccgccgtccacgtctagtaagtacgtttcgaccttactttacttccgtacgtactaactccgttaagttcggtcgtaccgtcgggtacccttccggtactaccgttttcgggacccgtacgggtaacccgtaaacgtcggtaaacgtacgttaaccgtaacgtaccgtagggttcggacccttacggaacccaccgttaacttcccggttacttccgttaccctactttccccgttacccgttacccgg

SEQ ID NO: 219677 - DNA, 672 bp, Homo sapiens
  misc_feature: GYAE6OF02FVYIK.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttgcctggtaccagcagaaacctggccaggctcccaggcctcctcctctatgctcgtcctccgaccgacgggcccctggtcgtcccgagccgtaggttcgttgggcggtgggtcgtgggacagtatttcactcgtcacctatcgacgccgtcctcgagtctagaagtattttcgcttacgtttatttctcgttactaactacttattcgggttacgtacgttcgggtcccttccgttaaccgttaccgtttttccgggacccgttaacgggggtaaccttaaaaccggtcgggtaacgtaacgttaaccgtaaaccggtaacggttaccggttacgggtaccgttaccggtacccgttaaacccgtacggttacccgttacggttacccgttttaccaccgttttaccccgttcccccgtaacccg

SEQ ID NO: 219678 - DNA, 569 bp, Homo sapiens
  misc_feature: GYAE6OF02H50QS.24.87.H10.1.454.CMB.1.raw
  modified_base (206)..(206): a, c, t, g, unknown or other
  misc_feature (206)..(206): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaangccaccctctcctgcagggccagtgagatgttggcagcaacttagcctggtaccagcaagaaacctggccaggcctcccaggcctcctctctatgctgtcctccaccgacgggtcccctggtcgtcccagccgtagggttcgtggcggttgggtctgggacngtatttcactctcacntcacgcgcctcngtctagaagtntttgcttactttacttctgttactaactacttagtggtcgtacgtcggccttccgtacttacgttttcggaccgtacgggaacctaaacgtcggaacgtactaccgaacgtacgtggtcggctagccacctatcttcgttccttctacttcccttccctacc

SEQ ID NO: 219679 - DNA, 565 bp, Homo sapiens
  misc_feature: GYAE6OF02GXP5C.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtcctgtgtctccaggggaaagagccaccctctcctgcagggccagtgagaatgttggcagctaacttagcctggtaccagcagaacctggccaggctcccaggctcctcctctatgctgtctccgaccacgggcccctgggtcgtcccagcctaggttcgtggcggtgggtctgggacagtattcgactctcatcagtcgactagagtcggagacccgtaagtatttcgctagttgtattctgtacagtcgttgttcgtcctcgtcctcgttatcttactcgttttcgccgttcggttccgacgtcgtgggtacgattaccgaaggtacgtaacgttggtcggtactacggacctacctcgttaccttcgttacctttcccg

SEQ ID NO: 219680 - DNA, 553 bp, Homo sapiens
  misc_feature: GYAE6OF02IT00B.24.87.H10.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatgccaccggagacattgtgttgacacagtctccagccaccctgtctttgtctccaggggaaangccaccctctcctgcagggccagtgacaatgtagagttgtagctggtatcaacacaaacntggccaggcctccccggctcctcatctatgatgcatccaagtacgggccacgtcggacactcccagactaggttcagtggcaggtgggtctgggacagacttcactctcaccatcagcagtagtagagcctaggtaagtattttgacttagtttatttacgttgtactagctacgtagacctaacgtcgtaccctacgtttccggcccgttcgggacctagacgtcgactacgtacccgaacgtaacgtggtacgtcgtacgaccaccgtactcgtcgttccttctaccg

SEQ ID NO: 219681 - DNA, 681 bp, Homo sapiens
  misc_feature: GYAE6OF02JE6G3.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagngccaccctctcctgcagggccagtgagaatgttggcagcaacttagcctggtaccagcagaaacctggccaggcctcccaggcctcctcctctatcgctcgtcctccaccgacgggtcccctggtcgtccccgacgtccgtaggttcggttcgggcggttcggggtccgtgggactaggtactttcgaccttctccgacctactcgacgtccggaccctccgacgttccgtaggtaacgttacgttttcgactttacttttacgttttcctacgttacctaaacttaccgttaagttcgggttacgtacgttcgggtacccgttaccgttaacctttaccggtttttcggacccggtaagggggtaaccctaaacggtacggtaacgacgttaaccgaaacgtacgtacggttacggtctacggacctaaccgtacgttcttacggttccttacgtccgttaccttccccgtaccg

SEQ ID NO: 219682 - DNA, 654 bp, Homo sapiens
  misc_feature: GYAE6OF02HV24O.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagtaagtagtcatgacgctagtctccagccacctgtctgtgtctccgaggggaanagccaccctctcctgcgagggccagtgagatgttgcagcaacttgcctggtaccagacaagaaacctggccaggcctcccgaggcctcctcctctagtcgctcgtcctccgaccgacgggtccccttagggtccgtaccccaggcccgtagggtttccggttaggggtcggtggggttcctggggaacctaggtaactttcgactctacaccatcgagccgtcctccgagtctagaagtatttgacttactttatttctagtactaactacttagtggtagaccgtcggtccttaccgtactacgttttcggaccgtaacgggtaacctaaacggtaggaacgtaacgtaccgaaaccggtaacgttacgggtcggtaccgtacggtcccgtaacccttagttaccgttcggtttaccctttcctaaccgtttcccttaccccgtacccg

SEQ ID NO: 219683 - DNA, 539 bp, Homo sapiens
  misc_feature: GYAE6OF02HMZ9U.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtctccaccgacgggcccctggtcgtcccagcctaggttcgtggcggtgggtctgggacagtactttcactctcacatcagcgcctcagtctgatatttgctactttattctgtacactactatggtgtacgtcgtcctcgtacctacgtttcggccgtacgggtaacctaacgtggaacgtacgtacaacgtaacgtggtcggctcgaccactatctcgtcttctacttcctccctac

SEQ ID NO: 219684 - DNA, 726 bp, Homo sapiens
  misc_feature: GYAE6OF02H2CEB.24.87.H10.1.454.CMB.1.raw
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (215)..(215): a, c, t, g, unknown or other
  misc_feature (215)..(215): n is a, c, g, or t
tcagactactatgtcacgaccggtgctcgatttagcagtactgcgttgggtttgggggaggaacgtgctcagttaggacccagacggaaccatggaagccccagcgcagcttctcttcctcctgctactctggctcccagataccactggagaagtagtcatgacgcagtctccagccaccctgtctgtgtctcgaggggtaaancnccaccctntcctgcgagggcccagtagagtaatgttcggcagtcaaacttgcctggtaccagcagaaacgtcggccaggctccgaggctacctcctctatcgcctgcctccaccgacggcccctggtcgtcccgacgccgtagggttcgttcggcggtcggggttcacggggtacgacgtacggtttaccacggttctacctaccgtaagtccgaacggccggtaacccctccgacgtccgttacggtaacgttacgttttacgtacgttaaccgttttactttccgtttacgttaccgaaaccttacttaggttacggttagtacgtcggtccgttacccgtacgtaccgtttttccgggaccgttacgggtaacccgtaaacggtcggtaaacgttaacgtaccgtaaaccgtaacggttcggtaacggttaccgtaggtaaccgtaaacccgttcgtttaccggttacggtttacctttaacccggtaacgttttccccgttaccccgttaccccg

SEQ ID NO: 219685 - DNA, 560 bp, Homo sapiens
  misc_feature: GYAE6OF02J03YS.24.87.H10.1.454.CMB.1.raw
  modified_base (201)..(201): a, c, t, g, unknown or other
  misc_feature (201)..(201): n is a, c, g, or t
  modified_base (400)..(400): a, c, t, g, unknown or other
  misc_feature (400)..(400): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccaggggaangccacctctcctgcagggccagtgagaatgttggcagcaacttagcctggtaccagcaacgaaacctggccaggctcccgaggcctcctacctcatcgctgtctccacgcgggcccctggtcgtcccaggccctagggttccgttgggccggttgggtctgggactggtatttcacgtctcacctatcacgccgcctcncgtacgtgtaacgtatttgtactacgtttactttctgtactaactacgtatggtacgtactcggtaccttcgtactacgtttcgccgtagggtaccaacgtagacgtagtacaacgtacgtagtggctgactactatctcgtcttctattcctccgtacc

SEQ ID NO: 219686 - DNA, 535 bp, Homo sapiens
  misc_feature: GYAE6OF02HU6GF.24.87.H10.1.454.CMB.1.raw
tcagactactatgtcacgaccggtgctcgatttagcagtactgcggttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctccgtgcagggccagtgagaatgttggcagcaacttagcctggtaccagcagaaacctggccaggctcccaggctcctctctatgctgtctccaccacgggcccctggtcgtccccagcccgtaggttccgttgggcggtgggtctgggacaggatttcactctcaccatccagccgcctcacgtctgaagtatttgctactttactttctgtctaactactatggtagactcggcctccgtactacgtttcgccgtagggacctaaagtggaagatacaacgaactggtggctgcaccatctgtcttcacttcctccgtc

SEQ ID NO: 219687 - DNA, 713 bp, Homo sapiens
  misc_feature: GYAE6OF02JW6BH.24.87.H10.1.454.CMB.1.raw
  modified_base (203)..(203): a, c, t, g, unknown or other
  misc_feature (203)..(203): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccactggagaagtgtcatgacgcagtctccagcccaccctgtctgtcgtctccgagggganagacgcccaccctctcctgccgagggcccagccggagttgtaagtaagtacgttaggctcggtaaccaacgagaaacctggaccaggctacccgaggcctcctacatcctatgactgtccaccaacgngggtcacgtcggccgtaccccngtacgttcgagtcggacaggtcgggtactcggggaactaggtaaccgtttcgaacccttcgtaccgaccccgggtactaacggccaaacgggttcccgttaaggacccgtaccggtacgttaaacggttctttttagggtaccgtttttaacgtacccgttaggtacctacggtacgttaccggtccgtttcccggccgtcggtaccgttcgttaaccggttccgggacgggggtaccgtagggggtccgtaagggacgggacgtacggtaacgtcggttacgggaccgttacggacgtaccgtacgtcgtttacggtccgtttaccgcgttcccgttacccgtacgttactcgtaacgg

SEQ ID NO: 219688 - DNA, 751 bp, Homo sapiens
  misc_feature: GYAE6OF02IAC0F.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggagaactgctcagttaggacccagacggaaccatggaagccccagcgcagcttctcttcctcctgctactctggctccagataccactggagaagtagtcatgacgcagtctccagccaccctgtctgtgtctccgaggggaaagngccaccctctcctgcagggccagtgagaatgttggcagcaacttgcctggtaccagcaagaaccgtggccaggctcccgaggtcctcctctctatcgctgtcctccaccgacgggtcccctggtcgcccagcctacgggttcgttcggcggtcgggtctgggactgtactttcgaccgttctaccacctattccgacggtccggtaccctacgtagttccgtaagtaacgttacgttttcggtaccttaacttttacgtttccttacgttaacctaaaccgtttaccgttaaggttccgggtttacgtaaccgttaccgggttaccccgtttaacccggtttaacgtttaccgtttttacggggaccccggtaaacgggggttaaaccctaaaaccggttcgggaaacgtaacgttaacccggaaaaccgggttaacccgttacggggttaccggtacccgttacggtaaccccgtaaaccgttacgtttacccggttacgtttcccgttttaacccgtacccttttccccgttacccccggttaacc

SEQ ID NO: 219689 - DNA, 529 bp, Homo sapiens
  misc_feature: GYAE6OF02FJN2D.24.87.H10.1.454.CMB.1.raw
  modified_base (204)..(204): a, c, t, g, unknown or other
  misc_feature (204)..(204): n is a, c, g, or t
  modified_base (390)..(390): a, c, t, g, unknown or other
  misc_feature (390)..(390): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagaatgttggcagcaacttagcctggtaccagcagaaacctggccaggctcccaggctcctcctctatgctgtctccaccagggccccctgggtcgtcccagccaggttcgtggcggtggggtctgggacagtatttcactctcaccatcagccgcctccngtctgaagtattttgctactttattctgtacactactatgtgactggcctccgtactactttcggccgtagggtaccaacgtggagtagtacgaacgactggtggctgccacagtctgttcttctacttcctcccgtcc

SEQ ID NO: 219690 - DNA, 551 bp, Homo sapiens
  misc_feature: GYAE6OF02G4D2T.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanacgccaccctctcctgcagggccagtgagaatgtggcagcaacttgcctggtaccagcagaaacctggccaggcctcccgaggcctcctcctctatgctgtcctcccaccgacgggcccctggtcgtcccagcctaggttcgtggcggtgggtctgggacagtatttcactctcaccatcagccgcctccgagtctgtaagtatttgactactttacttctgtactaactactatggtgtacgtcgtccttccgtactacgtttcggaccgtacgggaccaaacgtggaacgtagtacaacgtagtacggtggactcgactacatctgtcttctacttcctccgtcc

SEQ ID NO: 219691 - DNA, 681 bp, Homo sapiens
  misc_feature: GYAE6OF02G3C9A.24.87.H10.1.454.CMB.1.raw
  modified_base (478)..(478): a, c, t, g, unknown or other
  misc_feature (478)..(478): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagcccaccctctcctgcagggccaggtgagaatgttggcagcaacttagcctggtaccagcgaagaaacctggaccaggcctcccgaggcctccctcctctatcgctcgtcctcccgaccgacgggcccctgggtccgtcccaggtccctagggttcggttcgggccgggttggggtcgtgggactaggtactttccacttcgtacctacctagtctacgggccggtccctaccgtacggtctaggtaagttacgttttcgactttaacgttttntttccgtcgttactaactaccgtttagtcgggttacgtaccgttcggtcccttacccgttaacgtttaccggttttcgggacccggtacggggaaccctaaacggtagggactacgtacgaaaccgtaggttacggtacggtccaggtacccaacgtattccggttacgttccttaccgtactttcccgttaccccgtaaccg

SEQ ID NO: 219692 - DNA, 556 bp, Homo sapiens
  misc_feature: GYAE6OF02HNC4O.24.87.H10.1.454.CMB.1.raw
  modified_base (204)..(204): a, c, t, g, unknown or other
  misc_feature (204)..(204): n is a, c, g, or t
  modified_base (385)..(385): a, c, t, g, unknown or other
  misc_feature (385)..(385): n is a, c, g, or t
tcagactactatgtcacgaccggtgctcgatttagcagtactgcgttgggtttgggggaggaactgctcagttaggacccagacggaaccatggaagccccagcgcagcttctcttcttcctgctactctggctcccagataccactggagaagtagtcatgacgcagtctccagccaccctgtctgtgtctccaggggaaagngcccaccctctcctgcagggccagtgagaatgttggcagcaacttagcctggtaccagcagaaacctggccaggctccaggctcctcctctatgctgtctccaccgacgggcccctggtcgtcccacgcctagggttcggttggcggttggggtcgtggggacagtatttcactctcaccntcagccggcctccgagtctgaagtattttgctactttatttctgttctaactactagttggtgactcggtccttccttactacgttttcggccgtagggacctaacgtggaacgtatacaacgtactggtggtctgccacctatctcgtccttctacttccttcccgtacc

SEQ ID NO: 219693 - DNA, 766 bp, Homo sapiens
  misc_feature: GYAE6OF02HV8I0.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccgagacggaaccatggaagccccagcgcagcttctcttcctcctgctactctggctcccagataccactggagaagtagtcatgacgcagtctccagcccaccctgtctgtgtctccgaggggaaangccaccctctcctgcagggccagtgagatgtgcagcaacttgcctggtaccagcagaacctggccaggctccaggcctcctcactctagtggtcgccgtccaccgagggcccacgtcggccgttccgacggactaggttccaggtcggcgaggttcggtcgttttaggggactacggtacctttccgaccttccgtactaactccaacgttccgaccgtaacggtaaccgttacgggaaccggtaccccggtaaaaggtttaacgttttcggaccggttaacggtttacggtttaactttttaaccgttcggttaccgtaacggttccgttttacgggtttttaccggttcccccgtttaccgtttccccgtttacccgtttaacgtttaccggtttaacccgtttaacccgggttttttaccgggacccggtttaacgggggtttacccgtacggggttaccgttacggggtaacgttaacggttaccggtaaacggtaccggtaaacggttcgggttaccgggtccgttacggtacccttacccgtaacgtttcccgg

SEQ ID NO: 219694 - DNA, 564 bp, Homo sapiens
  misc_feature: GYAE6OF02IA62W.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccacctgtctgtgtctccaggggaaanagccaccctctcctgcagggccagtgagaatggttggcagcaacttagcctggtaccagcagaaacctggccaggctcccaggctcctcctctatcgctgtccgtccaccagggccccttggtcgtcccagcctaggttcgttggcggtgggtctgggacagtatttcgactctcgaccatcagcggcctccacgtctgaagtatttgctactttatttcttgtctaactactatggtgtcgtcggtcctccgttactaccgttttaggccgtacggggaccaaacgtcggaagagtacaacgtacgtacgtcggactcgactaccaacttcgttcgtcgttctacttccttacccgtacc

SEQ ID NO: 219695 - DNA, 677 bp, Homo sapiens
  misc_feature: GYAE6OF02JD42P.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatacccactggagaagtagtcatgacgcagtctccagccaccctgtctgtgtctccgaggggaaagngccaccctctcctgcagggccagtgagaatgttggcagcaacttagcctggtaccagcagaacctggccaggctcccaggcctcctcctctatgctcgtcctcccaccgacgggcccctgggtcgtccccaggtccccgtagggttccgttcgggtcggtggggtccgtcgggggactaggtatttccgacttccgtaccaacctacgttccgaacggcccggtcctcccgtacgtcctagtaaacgttacttttacgtactacttttatttccgttacgttacctaactacttacgtggttacgtacgttcggtcccttaccgttaaccttccgtttttacggacccggtaacggggtaaccctaaacggtacggaacgtaacgtaccgaaacgtacgtaggtacggtacgttaccgaccgtaacctacgttcgttaccgttaccgttacctacttcccttcccgtaccc

SEQ ID NO: 219696 - DNA, 562 bp, Homo sapiens
  misc_feature: GYAE6OF02F5K0O.24.87.H10.1.454.CMB.1.raw
  modified_base (205)..(205): a, c, t, g, unknown or other
  misc_feature (205)..(205): n is a, c, g, or t
  modified_base (454)..(454): a, c, t, g, unknown or other
  misc_feature (454)..(454): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagactaccactggagaagtagtcatgacgcagtctccagccaccctgtctgtgtctccgaggggaaangccaccctctcctgcagggccagtgagaattgtggcagcaacttgcctgtaccagcagaacctggccaggctcccgaggctcctcctctatcgctgtcctccaccgacgggtcccctgggtcgtccccagtcctaggttcgttggccggttggggtctggggactaggactttcgacttcgtcaccatcgagccgtctcgacgtctagaagtatttcgcttactttattctcgtctaactactatggtnacgtcggtcctccgtactacgttttcggaccgtacgggaaccaacgtggacgatacgaacgagtcggtacggctacgacctacactctcgtccttcacttcctccgcc

SEQ ID NO: 219697 - DNA, 546 bp, Homo sapiens
  misc_feature: GYAE6OF02GIV5S.24.87.H10.1.454.CMB.1.raw
  modified_base (204)..(204): a, c, t, g, unknown or other
  misc_feature (204)..(204): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcagaaacctggccaggctcccaggctcctcctctatgctgtctccaccacgggcccctggtcgtcccagccaggttcgttggcggtgggtctgggacagatttcactctcaccatcacgcgcctccagtctgaagtatttnctactttattctgtctaacncttagtggtnactggccttccgtactacttttcggccgtaggggaccaaacgtggaagactacgaacgaactggtcggtactcgactaccgatccgtgttccttcacttccttcccgtacccg

SEQ ID NO: 219698 - DNA, 689 bp, Homo sapiens
  misc_feature: GYAE6OF02JCL6Q.24.87.H10.1.454.CMB.1.raw
  modified_base (212)..(212): a, c, t, g, unknown or other
  misc_feature (212)..(212): n is a, c, g, or t
tcagactactatgtcacgaccggtgctcgatttagcagtactgcgttgggtttgggggaggaactgctcagttaggacccagacggaaccagtggaagccccagcgcagcttcctcttcctcctgcttactctggcctcccagatacccactggagtaagtagtcatgacgcagtcctccagcccacctgtctgtcgtctccgaggggaaancgccacccgtctcctgcgagggcagtgagatgtgcagcaacgttgcctggtaccagtcgaacgtaaaccgtggaccgaagggccttacccggaggtcctcccgttacctacgtactcggtccttcgtcctcccgaaccgtccgggtccccctggtcccggtacccacggtcccgtagggtttccgtgggccggttcgggtccgtgggactacggtacttttcgaccgttcctactaccgtactcgacggtcccgtacctacgtacgtctaggtaactgtttcgtacgttactttagttactacgtacaacgttactacgtcggtacgaccgttcggtcctaccgttacttaccggttttccgaccgggtaacggaaccgttaagtacggtaacgtaacgtaaccgtaacggtactacgggtcgacgtaccgtacgtacctacgttcgtcgttaccttacgacgttccgtaccgtacg

SEQ ID NO: 219699 - DNA, 550 bp, Homo sapiens
  misc_feature: GYAE6OF02G8VVP.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttgcctggtaccagcagaaacctggccaggctcccaggctcctcctctatgctgtcctccaccacgggcccctggtcgtcccagcccaggttcgtggcggttgggtctggggcaggtctttcacttctcaccatccagcgtcctccacgtctgaagtattttcgctactttatttctgttactaactacttagtgtgtactggtcctccgttactacttttcggccgtacggggacctaacgtcggagtacgtacgaacgtacgtggtggactgcctacattcgtcgtctctacttcctccgtcc

SEQ ID NO: 219700 - DNA, 586 bp, Homo sapiens
  misc_feature: GYAE6OF02GWYEW.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctgccaggctcccaggctcctcctctatgctgtctccaccgcgggcccctggtcgtcccagccaggttcgtggcggttgggtctgggacagtattcactctcaccatcacgcgcctccagtctgaagtatttgacttactttatttctcgttctaactacttagttggtcgtacgtcgtccttaccgttactacgttttcggccgtacggggtaaccctaaacgtcggaacgtacgtacgaacgtacgtaggtacggtacgttacgacctaccgttacgttacgttcgttaccttctaccttcccgttcccgtaaccc

SEQ ID NO: 219701 - DNA, 577 bp, Homo sapiens
  misc_feature: GYAE6OF02FZ75O.24.87.H10.1.454.CMB.1.raw
  modified_base (416)..(416): a, c, t, g, unknown or other
  misc_feature (416)..(416): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaacctggccaggctcccaggcctcctcctctatgctcgtcctccaccgacgggcccctggtcgtccccagcctagggttcgttgggcggttgggtcgtgggactggtactttcgactctaccacctatcacgccgcctccagtctagaagtntttgctactttactttctgtacaactattagtggtgtactggtccttccgttactacgttttcggccgtacggggtaacctaaacgtcggagacgtacaacgtacgtaggtcggactagcctacctagtcgttcgtccttactacttcccgttcccgtacc

SEQ ID NO: 219702 - DNA, 588 bp, Homo sapiens
  misc_feature: GYAE6OF02G880O.24.87.H10.1.454.CMB.1.raw
  modified_base (412)..(412): a, c, t, g, unknown or other
  misc_feature (412)..(412): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgagggggaaagcgcccaccctctcctgcagggccagtgagaatgtggcagcaacttgcctggtaccagcagaaacctggccaggcctcccaggcctcctcctctatgctgtcctccaccgacgggcccctggtcgtcccagcctaggttcgtggcggtgggtcgtgggacagtactttcacgtctcaccatcgacggtccgcctccagtctagaagtntttgcttacttttattctgtacctaactacttagtcggtgtaccgtcggtacccttaccgtaccttacgttttcggaccgtaacggggtaaccctaaacgtggaacgtataaccgaacgtacgtggtcggactcgaccaccgtattccgtcgtcttcctacttccctacccgtacc

SEQ ID NO: 219703 - DNA, 715 bp, Homo sapiens
  misc_feature: GYAE6OF02IQIM2.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagagaccaccggagaaattgtgttgacacagtctccaggcaccctgtctttgtctccgagggganagacgcccaccctctcctgcagggccaggccggagtgttaagtaagtacttaggctaggtaaccaacgacgaacctggccaaggcctacccgaggcctcctcattctatgatcgtcctaccaacgtaggggtcacgtcggccgtccccgacgtaggttcaggttcggactagggttcgggtctcgggaactacggtaccttcaccgttctaccaccgtcaagcaacgccctaaggacgtcctaggtaacgtttagttttcggtacggtttaacctacgttgttaccgaggtcctacgggttcccgtttcccggccgttacgggacccttaaacggtttaaccgggttccggggggaccggggggtaaccgtagggggttcgggaaacggtaggggaacgtaccggtaagttcggtacgggactacggaccaacgtacgttcgttacgttaccttacgaacccgtttcccgttacccggccttaagttcccgtaacgtaaccgtagttaacgg

SEQ ID NO: 219704 - DNA, 763 bp, Homo sapiens
  misc_feature: GYAE6OF02H8FCS.24.87.H10.1.454.CMB.1.raw
tcagactactatgtcacgaccggtgctcgatttagcagtactgcgttgggtttgggggaggaactgctcagttaggacccagacggaacatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgtggcagcaacttagcctggtaccagcaacgaaccgtggccaggcctcccgaggcctccctcctctatcgctcgtcctcccaccgacgggccccttggtcgtcccaggccgtagggttccgttggggcggtggggttcgtggggactaggtacttttccaccgttcctaccaacccgtactcccgacggtccccgggtacccttcccgtaacgttccgttaacggttaaaggtttacgtttttacggtacctttaaccgtttttaccttttacgtttacgttaacccttaaaccttaacgttacggtttacgggtttacgtaccgttccgggttaccccgtttacccgttaaccggtttaccgtttttaccggggacccgggtaaccggggtaaacccgtaaaccggttagggaacgtaacgttaaccgaaaccggtaacgttacgggtcggtaccgttacggaccccgttaaccgtacgtttccgttcgtttacccttaccgttacctttaccccgttccccgtaccc

SEQ ID NO: 219705 - DNA, 535 bp, Homo sapiens
  misc_feature: GYAE6OF02I295E.24.87.H10.1.454.CMB.1.raw
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccaccctgtctgtgtctccagggaaaagagccaccctctcctgcagggccagtgagaatgttggcagcaacttagcctggtaccagcagaaacctggccaggctccaggctcctcctctatgctgtctccaccagggcccctggtcgtcccagccgaggttcgtggcggttgggtctgggacagtatttcactctcacatcagcgctcagtctagaagtattttgctactttatttctgtacaactactagtggtgtactggtcctcgtactacgttttcggccgagggaccaaacgtggaagatacgaacgtaatacggtggctgaccactagtctgttccttcacttcctcccgtac

SEQ ID NO: 219706 - DNA, 606 bp, Homo sapiens
  misc_feature: GYAE6OF02G3DGZ.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgtggcagcaacttgcctggtaccagcagaaacctggccaggcctcccaggcctcctcctctatgctgtcctccaccgacgggcccctggtctccccgagtcccgtaggttcgttgggcggtcggggtcgtgggacaggtctttcactctcacctatcgacgtccggcctccgagtcgtagtaagtagtttcgcttactttatttctgtactaactatagtggtgtactcggcctccgtacttacgtttcgggaccgtacggggaacctaaacggtcggaagtaacgtaacgaacgtaacgtacggtacggtaccgtacgtaccaaccgtacgttcgttacgttcttaccgtacttcccgttacccgtacccg

SEQ ID NO: 219707 - DNA, 529 bp, Homo sapiens
  misc_feature: GYAE6OF02G5Q3L.24.87.H10.1.454.CMB.1.raw
  modified_base (203)..(203): a, c, t, g, unknown or other
  misc_feature (203)..(203): n is a, c, g, or t
  modified_base (403)..(403): a, c, t, g, unknown or other
  misc_feature (403)..(403): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgtggcagcaacttgcctggtaccagcagaacctggccaggctcccaggctcctcctctatgctgtcctccaccgacgggcccctggtcgtcccagcctaggttcgtggcggttgggtctgggacagtctttacactctcaccatcgagtccggcctccgagtctgaagtntttcgctactttattctgtcaactatatgtgtactcgtcctcgtactacgtttgccgagggtaccaagtggagtatacacgtactggcgtctcgctactatctcgtcttctacttcctcccgtacc

SEQ ID NO: 219708 - DNA, 555 bp, Homo sapiens
  misc_feature: GYAE6OF02F2R03.24.87.H10.1.454.CMB.1.raw
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
  modified_base (542)..(542): a, c, t, g, unknown or other
  misc_feature (542)..(542): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgccagggccagtgagaatgttggcagcaacttgcctggtaccagcagaaacctggccaggctccaggctcctctctatgctgtctccaccgagggcccctgggtcgtcccagccgtaggtttccggttgggcggttgggtctggggacaggtntttcgactctcacctatcacgcgcctccagtctagaagtattttgcttactttattctgttacaactacttagtcggtgtacgtcgccttccgtacttacgttttcggaccgtaggggaacctaaacgtggagactacgaacgacgtggtgctcgctaccatctgtcttacncttcctccgtacc

SEQ ID NO: 219709 - DNA, 576 bp, Homo sapiens
  misc_feature: GYAE6OF02FEKB1.24.87.H10.1.454.CMB.1.raw
  modified_base (203)..(203): a, c, t, g, unknown or other
  misc_feature (203)..(203): n is a, c, g, or t
  modified_base (418)..(418): a, c, t, g, unknown or other
  misc_feature (418)..(418): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgccagggccagtgagaatgttggcagccaacttagcctggtaccagcagaaacctggccaggctcccaggcctcctcctctatgctcgtctccaccgacgggcccctggtcgtccccagcccgtaggttcggttgggcggttggggtcgtggggacaggtactttcgactctcaccatcgacgccgcctccagtctgaagtnttttcgcttactttattctgttacaactactagttggtgtacgtcggccttccgtacttaccgttttacgggccgtaacggggaaccctaaacgtgggaagtactacaacgactggtacggtcagcctaccatctgtccttcacttccgttcccgtac

SEQ ID NO: 219710 - DNA, 622 bp, Homo sapiens
  misc_feature: GYAE6OF02FX9GW.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttgcctggtaccagcagaaacctggccaggcctcccaggctcctcctctatgctgtcctccaccacgggcccctggtcgtccccagccgtaggttcgttgggcgggtgggtcgtggggacgtagtactttcgactcgtccacctactcacggccggtccctccgtacgtcgtaggtaagttagttttcgacttaacttttctttcgttgttcctaaactacgttattcgggtgtaccgtcggtcccgttaccgttacttccgttttacgggccggtaacggggtaaccctaaacgtggaacgtataccgaaacgtacgtaggtcggtctacgacaccgtagttccgtacgttccttacactttccctcccgtaccc

SEQ ID NO: 219711 - DNA, 535 bp, Homo sapiens
  misc_feature: GYAE6OF02HWH30.24.87.H10.1.454.CMB.1.raw
  modified_base (202)..(202): a, c, t, g, unknown or other
  misc_feature (202)..(202): n is a, c, g, or t
  modified_base (366)..(366): a, c, t, g, unknown or other
  misc_feature (366)..(366): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccaggggaaanagccaccctctcctgcagggccagtgagaatgttggcagcaacttagcctggtaccagcagaaacctggccaggctcccgaggcctcctcctctatgctgtcctccaccgacgggcccctggtcgtcccagccgtaggttcgtggcggtgggtctgggactagntttcactctcaccatcagcgcctctacgtctgtagtatttgctacttatttctgtactaactactagtgtgactcgtcctcgttactacgtttcgccgtagggtacctaaacgtgaacgatacgaacgtacgtcgtgctgcctacatctcgtcttctactcctccgtac

SEQ ID NO: 219712 - DNA, 592 bp, Homo sapiens
  misc_feature: GYAE6OF02GGRVB.24.87.H10.1.454.CMB.1.raw
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaattgctggtaccagcagaaacctggccaggctcccaggcctcctcctctatgctgtcctccaccgacgggcccctggtccgtcccaggtcctaggttcggtggcgggtgggtcgtgggacngtatttcnctctcaccatcacgcggccctcacgtcgtagaagtacttttgcttactttatttcctgtactaactacgttatggtacgtacgtcggtccttccgtacgttaccgttttcggaccggtacggggtaacctaaacggtggaagtactacgtaacgacgttacggtcggtcgtacgtaccacctagttccgttagtcctttacacttaccctccccgtaccg

SEQ ID NO: 219713 - DNA, 513 bp, Homo sapiens
  misc_feature: GYAE6OF02H4X8O.24.87.H10.1.454.CMB.1.raw
  modified_base (373)..(373): a, c, t, g, unknown or other
  misc_feature (373)..(373): n is a, c, g, or t
  modified_base (464)..(464): a, c, t, g, unknown or other
  misc_feature (464)..(464): n is a, c, g, or t
  modified_base (502)..(502): a, c, t, g, unknown or other
  misc_feature (502)..(502): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctccaggctcctcctctatgctgtctccaccacgggcccctggtcgtcccagccaggttcgttggcggtgggtctgggacagatttcactctcacntcagcgcctcatctgagtatttgctactttattctgtcaactactagtgtgacgtgcctcgtactcgtttgccgtagggaccaacgtgganacgtacaacgacgtggtggctcgcactatctgtcttcnttcctccgtcc

SEQ ID NO: 219714 - DNA, 261 bp, Homo sapiens
  misc_feature: GYAE6OF02IBXGF.24.87.H10.1.454.CMB.1.raw
  modified_base (257)..(261): a, c, t, g, unknown or other
  misc_feature (257)..(261): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacactttttggccaggggaccaaactggagatcaaacgaactgtggctgcaccatctgtcttcatcttcccgccatctgaacatagtagtctgagcgggctggcaaggcgcatagnnnnn

SEQ ID NO: 219715 - DNA, 631 bp, Homo sapiens
  misc_feature: GYAE6OF02I9AU6.24.87.H10.1.454.CMB.1.raw
  modified_base (205)..(205): a, c, t, g, unknown or other
  misc_feature (205)..(205): n is a, c, g, or t
  modified_base (417)..(417): a, c, t, g, unknown or other
  misc_feature (417)..(417): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaangcccaccctctcctgcagggccagtgagatgttggcagcaacttagcctggtaccagcagaacctggccaggctccaggcctcctcctctatgctgtcctccaccgacgggcccctgggtctcccgagcccgtaggttccggttggcggtgggtccgtgggagtagtctttcactctcaccatcgaggccgtcctccacgtctaggtaagtnttttgcttactttatttcgttgttacctaactacttagttggttacgtacgttcggtcccgttccgttaaccgttcgtttttacgggaccggtaacggggtaacccgtaaacggtacggaagtacgtaacgtaacgtacgttacggtacggtaccgtcgtacctaaccgtacgttacgttcgttacctttccgtacgttcccttccccggtacc

SEQ ID NO: 219716 - DNA, 605 bp, Homo sapiens
  misc_feature: GYAE6OF02F8XEL.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaacctggccaggctcccaggctcctcctctatgctgtctccaccgacgggcccctggtcgtcccagccgtagggttccgtggcggtcgggtcgtgggacgagtatttcgactctcaccatcgacgccggcctccggtctagaagtatttcgcttacttttatttcctgtactaactacttagttggtcgacttcggtcccttacgttacctacgttttcggaccgtacggggtacctaaaccgtggtacgtaactaccgaaacgtacgtacggtacgggtctacgaccgaacctagttccgttacggttccttacgtacttcccgttacccgtaccgttac

SEQ ID NO: 219717 - DNA, 539 bp, Homo sapiens
  misc_feature: GYAE6OF02HJH8A.24.87.H10.1.454.CMB.1.raw
  modified_base (203)..(203): a, c, t, g, unknown or other
  misc_feature (203)..(203): n is a, c, g, or t
  modified_base (398)..(398): a, c, t, g, unknown or other
  misc_feature (398)..(398): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacacagtctccagccaccctgtctgtgtctccaggggaaanagccaccctctcctgcagggccagtgagaatgttggcagcaacttagcctggtaccagcagaaacctggccaggctcccaggctcctctctatgctgtctccaccacgggcccctggtcgtcccagcctaggttcgttggcggtgggtctgggacagtattcacgtctcaccatcagcgcctcagtctagaagtntttgctactttattctgtacaactactagtggtgtactcggtccttccgtactacgtttggccgtaggggacctaaagtcggaagatacgaacgacgtaggtggctgcacctatctgttccttctacttccttcccgtacc

SEQ ID NO: 219718 - DNA, 537 bp, Homo sapiens
  misc_feature: GYAE6OF02FF90I.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangcccaccctctcctgcagggccagtgagaatgttggcagcaacttagcctggtaccagcacgaaacctggccaggctcccaggcctcctcctctatgctgtctccaccagggcccctggtcgtccccagccaggttcggttggcggtgggtctggggacaggatttcactctcaccatcagccggccctccacgtctgaagtattttgctactttatttctgttcaacactatgtgactggtccttccgtactacgttttggccgtacgggaccaaacgtggagactacaacgactggtggctgcaccatctgtccttctactcttcccgtacc

SEQ ID NO: 219719 - DNA, 548 bp, Homo sapiens
  misc_feature: GYAE6OF02IUD2J.24.87.H10.1.454.CMB.1.raw
  modified_base (297)..(297): a, c, t, g, unknown or other
  misc_feature (297)..(297): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
  modified_base (422)..(422): a, c, t, g, unknown or other
  misc_feature (422)..(422): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctttgtctccaggggagagagccaccctctcctgcagggccagtcagagtgttagcagcagctacttagcctggtaccagacagaaacctggcccaggcctcccaggcctccncatctatgatctccacacgacggtcacgcggcccgtccgcgtacgtcgngtcgngnggtcggcgnggacagtctcnctcnccgcgagcgcngtcgagcgctagactttgttcgtcttactctgangtcacgtcgtccgcgtcggacctacggttacggtcggggaccgggacggtggggagaacgggaggacggaccggtacggtgtacggctaccgagtacctgttccttcggttcctcgtcccttcccg

SEQ ID NO: 219720 - DNA, 685 bp, Homo sapiens
  misc_feature: GYAE6OF02IPU3A.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagccaacttagcctggtaccagcaagaaacctcggccaggcctcccaggcctccctccctctatcgtctcgttcctccgacccgacggggtcccccttgggtcgtcccccgaacggtcccgtagggtttcggttgggccgggttcggggtcgtcggggaaccaggtactttcaacgttcgtccaccatccgagctacggtcctcgacctaacccgtgaaacgttctttaggaccctaaacgtttaccttaattcgttactaaacgtacgtaacgttaaccgtacgtttaccccgggtccaaccgtttcgggaccggaacggggtaccgtaacggggtggaagtactaccgaaccgacgtagttacggtgggccttaccgacccgtaacctacgttccgttacgttaccgtttaccgtacctttacccggttcccccctacgttaac

SEQ ID NO: 219721 - DNA, 530 bp, Homo sapiens
  misc_feature: GYAE6OF02IKKHK.24.87.H10.1.454.CMB.1.raw
  modified_base (204)..(204): a, c, t, g, unknown or other
  misc_feature (204)..(204): n is a, c, g, or t
  modified_base (500)..(500): a, c, t, g, unknown or other
  misc_feature (500)..(500): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttagcctggtaccagcagaaacctggccaggctccaggctcctcctctatgctgtctccaccgacgggcccctggtcgtcccagccaggttcgtggcggtgggtctgggacagtatttcactctcaccatcagccgcctccagtctgaagtattttcgtactactttatttctgttacaactactagttggtgtactgtcctccgtactacgttttcgccgtagggaccaacgtggacgatacaacgactaggngctgcacatctgtcttcacttcctcctacc

SEQ ID NO: 219722 - DNA, 669 bp, Homo sapiens
  misc_feature: GYAE6OF02HNJZA.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtcgtctccaggggaaangcccaccctctcctgcagggccagtgagaatgttggcagcaacttagcctggtaccagcagaaacctggccaggctcccgaggcctcctcctctatgctgtctccgaccgacgggcccctggtcgtcccagcctaggttcgtggcggtgggtctgggactaggtatttcgactctaccacctactcgacggccgtcccgtaccgacgtaccgtagtaaacgtacttttacgactttactttacgttttacttacgttaacctaaactacttaagttgggtataccgttcgtacccgttaccgttaccgttacgttttcggacccggtaacggggtaaccctaaaacggttcgggaacgttaacgtaaccgaaaccggtaacgttacgggttcggtacttacggacctaacccgtatttaccgttcgttaccctttacgtaccctttacccgttccccgtaacccg

SEQ ID NO: 219723 - DNA, 597 bp, Homo sapiens
  misc_feature: GYAE6OF02G91DM.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccgagctcctctctatgctgtctccaccagggcccctggtcgtcccacgccaggttcgttggcggttcggggtctgggacagtatttcgactctcacctatcgagcggccctcacgtctagaagtacttttgcctactttactttctgttcctaacgtacttatggtgtactcggtcccttccgtactacgttttcggccgtacggggtacccaaacgttggaacgtacgtaccgtaacgtaacgtcggtacggtacttcggacctaaccctagttccgttcggttccttaccttaacttcccgttaccccggtacc

SEQ ID NO: 219724 - DNA, 606 bp, Homo sapiens
  misc_feature: GYAE6OF02HTKT1.24.87.H10.1.454.CMB.1.raw
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (407)..(407): a, c, t, g, unknown or other
  misc_feature (407)..(407): n is a, c, g, or t
tcagactactatgtcacgaccggtgctcgatttagcagtactgcgttgggtttgggggagaactgctcagttaggacccagacggaaccatggaagccccagcgcagcttctcttcctcctgctactctggctccagataccactggagaagtagtcatgacgcagtctaccagccacctgtctgtgtctcgaggggaaaacncgccaccctctccngccagggtccagtgagaatgtggcagcattagctgtaccancagaactggacaggctaccgaggctcctctctatgcttgcctaccgaccncgggccctggtctccgacgcgtaggttcggtggccggttagggtctagggactaggtatttcgacttcacgacctatccgacgtccggccttcgacgtntaggtaatacgtttgcttactttagtttctgtactaacgtacttagtcggtagacgtaggtaccttaccggttactacgttttcggaccgtaacgggactaaacggtggaacgtaactaaccgaacgtacgttggtacggccttacggaccgttaccgtacttcgttcgttacctttcaacgtttccctaccgtaaccg

SEQ ID NO: 219725 - DNA, 261 bp, Homo sapiens
  misc_feature: GYAE6OF02GLBU0.24.87.H10.1.454.CMB.1.raw
  modified_base (255)..(261): a, c, t, g, unknown or other
  misc_feature (255)..(261): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaacatagtagtctgagcggctggcaaggcgcatagnnnnnnn

SEQ ID NO: 219726 - DNA, 627 bp, Homo sapiens
  misc_feature: GYAE6OF02JZFU5.24.87.H10.1.454.CMB.1.raw
  modified_base (204)..(204): a, c, t, g, unknown or other
  misc_feature (204)..(204): n is a, c, g, or t
  modified_base (318)..(318): a, c, t, g, unknown or other
  misc_feature (318)..(318): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
  modified_base (435)..(435): a, c, t, g, unknown or other
  misc_feature (435)..(435): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaanagcccaccctctcctgcagggccaggtgagaatgttggcagcaacttagcctggtaccagcagaaacctggccacggctcccaggcctcctcctctatcggctgtcctccaccncgggtcccctggtcgtcccacgccgtaggttcggttggggccggtgggttcncgggactagtactttcgactctcacctntacgcgtaccgcctcctagtcctagtaacgtactttntacttactttacttctacgtactaactacgtatacgggttactccgtacggccttacccgttacgttacgttttcgggacccggtaacgggtaaccgtaacgtacggaacgtactaaaccgtagtacgttacggtggaccttcggacctaaccgtattccgttactccgttactaccttccgtacccgtacc

SEQ ID NO: 219727 - DNA, 570 bp, Homo sapiens
  misc_feature: GYAE6OF02IN8Q4.24.87.H10.1.454.CMB.1.raw
  modified_base (407)..(407): a, c, t, g, unknown or other
  misc_feature (407)..(407): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagcccaccctctcctgcagggccagtgagaatgttggcagcaacttagcctggtaccagcaagaaacctggccaggctccaggcctcctcctctatgctgtctcccaccgacgggcccctggtctcccgagccaggttcgtggcggtgggtctgggacagtactttcgactctcactatcgagtccggcctccagtctgaagtntttgctactttatttctgtactactactagtggtcgactcggccttccgtacttctttacggcgaacgggtacctaaacgtcggaagtactacgaaaccgtaacgtggtacggtctgcctaacctagttcctcggttccttacctactttccgtaccccgtcc

SEQ ID NO: 219728 - DNA, 611 bp, Homo sapiens
  misc_feature: GYAE6OF02GVPTU.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcagaaacctggccaggcctcccgaggcctcctcctctatgctgtcctccaccacgggccccttggtcgtccagccgtaggttcgttggcggtggggtctggggactaggtactttcacttctaccacctatccgagccggtcctccagtctagtaagtattttcgcttactttactttctcgttacaactacttagttcggttgtaccgtcggtcccttaccggttacctacggttttcgaccggtacgggtaaccgtaaacggtcggaagtactacgaaacgtacgtacggtcggtctacgaccgtacctagttccgttcgttacctttacacttccgttcccctacc

SEQ ID NO: 219729 - DNA, 684 bp, Homo sapiens
  misc_feature: GYAE6OF02GWSAN.24.87.H10.1.454.CMB.1.raw
  modified_base (204)..(204): a, c, t, g, unknown or other
  misc_feature (204)..(204): n is a, c, g, or t
  modified_base (418)..(418): a, c, t, g, unknown or other
  misc_feature (418)..(418): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaacncgcccacctctcctgcgagggccagtgagatggtgcagacaacttagccgtggtaccagacaacgaaccgtggaccacggcctacccgaggtccctccctcctctagtcgcctcgtcctaccgaccgaccgggtcccctggtccgtcccacggtccgtaggttcggtggtcggtgggtcgtagggactaggttacttcgacttcctaccacctntccgacggtcccggtaccctccgtacgttcgtagtaagtttacgttttcgtactttacgttttactttccgtacgttacctaacgtactttagtcggtacgtaccgtccggtacccttaccgttaccgttccggttttaccggaccggtaaccgggtaacctaaacggtcggaagtacgtaaccgtaacgtacgttacgggtcggtaccgtcgaccctaccgtacgttccgttacgttccttactaccgtttcccgtacccgtacc

SEQ ID NO: 219730 - DNA, 569 bp, Homo sapiens
  misc_feature: GYAE6OF02JFHCX.24.87.H10.1.454.CMB.1.raw
  modified_base (204)..(204): a, c, t, g, unknown or other
  misc_feature (204)..(204): n is a, c, g, or t
  modified_base (378)..(378): a, c, t, g, unknown or other
  misc_feature (378)..(378): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgccaccctctcctgcagggccagtgagaatgttggcagcaacttagcctggtaccagcagaaacctggccaggcctcccaggctcctcctctatgctgtctccaccacgggcccctggtcgtccccagccgtaggttcgtggcggtgggtctgggacagtattcactctcacntcacgccgtcctccagtcagtaagtatttcgcttactttattctgttaccaactactagtggtctacgtcggtcccttaccggtacttaccgttttcgggacccgtacggggaaccaaacggtggaacgtataccgaacgacgtggtcgcgtacgcctacgtactcgtcgttcttcacttcctcccgtacc

SEQ ID NO: 219731 - DNA, 682 bp, Homo sapiens
  misc_feature: GYAE6OF02IG9L5.24.87.H10.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (230)..(230): a, c, t, g, unknown or other
  misc_feature (230)..(230): n is a, c, g, or t
  modified_base (393)..(393): a, c, t, g, unknown or other
  misc_feature (393)..(393): n is a, c, g, or t
tcagactactatgtcacgaccggtgctcgatttagcagtactgcgttgggtttgggggaggaactgctcagttaggacccagacggaaccatggaagcccagcgcagcttctcttcctcctgctactctggctcccagataccactggagaagtgtcatgacgcagtctccagccacctgtctgtgtctccaggggaaangccaccctntcctgacagggtccaagtganaatgttggcagcaacttgcctggtaccagcagaacctggccaggctacccgaggctcctcctctatcgctgtcctccaccagggtcccctggtcgtcccacggtcccgaggttcgttcggcggttcgggtcgtagggacctaggtactttcgactctcgaccngtacgacgccggtaccttcgaacgttcgtacgttaaacgtgttttccgtacttacttttaacttttctacggttaaccaaacgttacttaacgttcggtacggtaacttccgggtacccgttccgtaacgtttaccgttttcggacccggtaacgggtaccctaaaacgtcggtaaactacgtaacccgtaaacgtaccgttaaggtcgggtaccttacgggaacccgttaaccacgtttaaccggttcgttaaccgtttacccggtaacttcccgtttaccccgtccg

SEQ ID NO: 219732 - DNA, 584 bp, Homo sapiens
  misc_feature: GYAE6OF02H5TIK.24.87.H10.1.454.CMB.1.raw
  modified_base (202)..(202): a, c, t, g, unknown or other
  misc_feature (202)..(202): n is a, c, g, or t
  modified_base (251)..(251): a, c, t, g, unknown or other
  misc_feature (251)..(251): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccacctgtctgtgtctccgaggggaaangccacctctcctgcaggccagtgagatgtgcagcaacttgctggtaccngcagaacctggccaggctcccaggctcctctctatgctgtcctccaccacgggtcccctggtccgtcccagcccgtaggttcgttcgggcggttgggtctgggacagtatttcgacttcgtccaccatcgacgccgtcctccacgtctagaagtattttgcttactttatttctgttacaaactacttatgggtctacgtcgtccttccgttaccgttccgttttacgggccgtaagggaaccctaaagtcggaagacttaacgaacgtactggtacggtctacgacctaccgtacttcgttcttccttactactttcccgttacccgtaccc

SEQ ID NO: 219733 - DNA, 711 bp, Homo sapiens
  misc_feature: GYAE6OF02HGZHC.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaanagccaccctctcctgcagggccagtgagaatgttggcagcaacttagcctggtaccagcagaaacctggccaggctcccaggctcctcctctatcgctcgtcctccaccgacgggcccctggtcgtccccaggcccgtaggttccgttgggccggttgggtccgtgggactaggtactttcgacgttctaccaaccgtataccgtacggtccggtcccgttcccgtaacggttccgtaagggtaaacgttacgttttagtaccgttaacctttttaacttttccgtacgttaccctaaacctactttaagttcggttacgtacgttccgggtcccttacccgttaaccttacgtttttaccgggacccgtaacgggggtaaccctaaaacggtcggtaaagtaaccgttaaccgaaacggtaacgttacgggttacggaccgttacgaaccgtacccgtaattccgttaccggtacctttaccgtacctttcccgttaccccgtacccg

SEQ ID NO: 219734 - DNA, 610 bp, Homo sapiens
  misc_feature: GYAE6OF02JZZGZ.24.87.H10.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
tcagactactatgtcacgaccggtgctcgatttagcagtactgcgttgggtttgggggaggaacttctcagttaggacccagacggaaccatggaagccccagcgcagcttctcttcctcctgctactctggctcccagataccactggagaagtagtcatgacgcagtctccagcccaccctgtctgtgtctccgaggggaaangcccacctctccngcagggccagtganatgtggcagcaagttcgcctggtaccngcagaacctggccaggctcccaggcctcgtcntacgngctgtctccaccgacgggcccctggtccgtccccaggtaccctggggttccgttcgggcggttgggtccctggggacaagtctttcgactctcaccgntcgaggccgtctccagtctgtacgtattcgtctatttactttgtcgttacacttactagtggttcgtagtacggtccttaccgttcgtaccttttcggaccgtacgggtaacctaacgtacgacggtaaccgtaacgtaaccgaacgtcgtacggtcgtacgtctaccgtaacgtccgttagttcctaccttacgttaccctttcccgaccttacg

SEQ ID NO: 219735 - DNA, 664 bp, Homo sapiens
  misc_feature: GYAE6OF02IKFWA.24.87.H10.1.454.CMB.1.raw
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccaccctgtctgtgtctcgagggaaagagccaccctctcctgcagggccaggtgagaatggttggcagctaacttagccgtggtaccagcagaaacctggccaggctcccgaggctccctccgtctatcgctcgtcctccaccgacggtcccctggtcgtccccgagccctaggttcggtggcggttcgggtcgtcggggactaggttactttcgaacttccgtacaccatccgacgtccggtcctaccgacgttcgtagtaacgtattttcggacttacttttactttcttgtacctaactacgttacgttgggttacgacgtcggtacccgttaccgttacgttaccgttttacgggacccggtaaaccggggtaacctaaaccgggttggtaacgtattaaccgaaccggtaagttcggttacggcctacggacctaaccgtagttcgtacgttaccttaccgacgtttcccttacccgtacccg

SEQ ID NO: 219736 - DNA, 634 bp, Homo sapiens
  misc_feature: GYAE6OF02IIPOD.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagatgttggcagcaacttagcctggtaccagcagaaacctggccaggctcccaggctcctcctctatcgctcgtctccaccgacgggcccctggtcgtcccacgccgtaggtttcggttgggcgggttgggtcgtggggacagtacgtttcgaaccttctacacctatccgacggcccggccttcccgtagtccgtaggtaagtatttttcgaccttactttagtttcttacgtacctaaactacttattgggtcgtacgtcggtccttccgtaccttaccgttttcgggaccgtaacggggtaccaaacggtcggaagtactacgtaaacgtacgttaggtcggcctggtaccctaccgtattcccgttcggtttccttacgttacgttcccttcccggtaccc

SEQ ID NO: 219737 - DNA, 562 bp, Homo sapiens
  misc_feature: GYAE6OF02H9IF5.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcagaaacctggccaggctcccaggctcctcctctatgctgtcctccaccacgggcccctggtcgtccccagccacggttcgttcgggtcggtcggggtcgtggggaccaggtactttcacttccgtcacactcacgccgctcccagtctagtaagtattttgctactttatttctgttctaactacttatgtgactgccttccgtactcgttttcgacgtacgggaccctaaagtcggagtactacgaaacacgtaggtgctgacctacctatcttcgttcttactcttccctcctaccc

SEQ ID NO: 219738 - DNA, 600 bp, Homo sapiens
  misc_feature: GYAE6OF02FRUP2.24.87.H10.1.454.CMB.1.raw
  modified_base (205)..(205): a, c, t, g, unknown or other
  misc_feature (205)..(205): n is a, c, g, or t
  modified_base (470)..(470): a, c, t, g, unknown or other
  misc_feature (470)..(470): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaangcccacctctcctgcagggccagtgagaatgtggcagcaacttgcctggtaccagcagaaacctggccaggcctcccaggcctcctcctctatcgctcgtcctccgaccacgggcccctggtcgtccccagccgtaggttcggttggcggtggggtcgtggggacctaggtactttcgactctacacctatccgacggccgcctccgacgtcgtgtaagtatttcgtcttactttactttctcgttacaactacttagttcggtnacgtcggtccttccgttactcgttttcggccgtacggggaaccaaacgtggtaacgtactacgaacgtaacgtggtcggacgtcgaccgtacctagttctcgttaccttaccgtcttccgtcccgtaccc

SEQ ID NO: 219739 - DNA, 560 bp, Homo sapiens
  misc_feature: GYAE6OF02FV89B.24.87.H10.1.454.CMB.1.raw
  modified_base (413)..(413): a, c, t, g, unknown or other
  misc_feature (413)..(413): n is a, c, g, or t
  modified_base (446)..(446): a, c, t, g, unknown or other
  misc_feature (446)..(446): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgccagggccagtgagaatgttggcagcaacttagcctggtaccagcagaaacctggccaggctcccaggcctcctcctctactgctgtcctccaccgacgggcccctggtcgtcccgagcccgtacggttcgttcgggcgggtggggtctggggacaggtattcactctcaccatcagcgcctcagtctgaagtntttgctactttattctgttcaactactatggtntactcggtccttcgtactcgttttcggaccggtacgggtaccaaacgttcggacgtactaccgaacgtacgtggtagcctagccacgtatctgtcctcgtactcttcccgtacc

SEQ ID NO: 219740 - DNA, 264 bp, Homo sapiens
  misc_feature: GYAE6OF02GSGWI.24.87.H10.1.454.CMB.1.raw
  modified_base (258)..(264): a, c, t, g, unknown or other
  misc_feature (258)..(264): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccagggggaccaaactggagatcaaaacgaactgtggctgcaccatctgtcttcatcttcccgcatctgaacatagtatctgagcgggctggacaaggcgcaatagnnnnnnn

SEQ ID NO: 219741 - DNA, 634 bp, Homo sapiens
  misc_feature: GYAE6OF02ICHTW.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagngccaccctctcctgcagggccagtgagaatggttggcagcaacttagcctggtaccagcagaaaccgtgccaggctcccaggctcctctctatcgctgtcctccaccgacgggcccctggtcgtcccacgccgtaggttcggtgggcgggtgggtcgtgggtacagtactttcacttctacaccatcgacgccggcctccgagttcgtgtaagtattttcacgttactttattcttgtactaactacttagtcgtgtacgtcggtcccttccgtaccttaccgtttcggacccgtacgggggtaaaccctaacggtaggtaacgtaacgtaccgtaaaccgtaacgttacgggtacggtaccgtacggtaccctaacctacgttcgttacggttacccttcgtttaccttacccgttccccgtacccg

SEQ ID NO: 219742 - DNA, 719 bp, Homo sapiens
  misc_feature: GYAE6OF02HCZMB.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttagcctggtaccagacaagaaacctggccaggcctcccaggcctcctcctctatgctgtcctcccaccgacgggtcccctggtccgtcccacgccgtagggtttcggtgggtcggttggggtcctggggactaggtactttcaccgttctacctacctagtccgacgggcccggtccctcccgacgttccgtaggtaacgttagttttacgtactttaccttttacttttaccgttcgttacctaaacctaccttagttacgggttacgtaccgttcgggtacccgttacccggttaaccttaccgtttttacgggacccggtaaccgggggtaacccgttaaaaccggttacgggtaagtaacgttaaccgtaaaaccggtaacgttacgggtacggtaccgttcggaccctaaccgtacgttaccgttcggtttacccttaccgttacctttacccgttccccgtaccc

SEQ ID NO: 219743 - DNA, 622 bp, Homo sapiens
  misc_feature: GYAE6OF02G2U28.24.87.H10.1.454.CMB.1.raw
  modified_base (203)..(203): a, c, t, g, unknown or other
  misc_feature (203)..(203): n is a, c, g, or t
  modified_base (388)..(388): a, c, t, g, unknown or other
  misc_feature (388)..(388): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttgcctggtaccagcagaaacctggccaggcctcccaggcctcctcctctatgctgtcctccaccgacgggcccctggtcgtcccagtcctagggttcgtgggtcggtgggtcgtggggacaggtactttcacttctcacctntcgacgccggcctccgagtcgtagtaagtacttttgcttactttactttctgtactaactacttagtgggttcgtaccgtcggtcccttccggtaccgttaccgttttcgggacccggtaacggggtaaccgtaaacgtcggaagtaacgtaccgaaacgtaaccgtggtacgggtacctcggcccaaccgtactcgttcggttccttacctaccttcccgttaccccgtaccg

SEQ ID NO: 219744 - DNA, 765 bp, Homo sapiens
  misc_feature: GYAE6OF02G9TUR.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagatgttggcagcaacttagcctggtaccagcaacgaaacctggccaggcctcccgaggcctccctcctctatcgtctcgtcctccaccgacgggtccccgtgggtccgtcccgacgtccgtacgggttcggttcggggtccgggtggggtcgtggggactaggtactttcgacttcctaccgacctatccgacggtcccgggcctacccgtacggttcgtaacggtaagtttactttttcggacctttaactttttacttttccgttacgttaccttaaaaccttacgttacgttgggttacgtaaccgttccgggtaccccgtttaccggtttaaccgtttaccggttttttaccggggaccccgggttaacgggggttaacccctaaaacgggttcgggaaaccgtaacgttaacccggaaacggttaaccggttgggtaacgggtccggttaccggaacccgttacccgtacgtttccggttaccgtttacctttacccgtaccgtttaccccgtttaccccccggtaacc

SEQ ID NO: 219745 - DNA, 606 bp, Homo sapiens
  misc_feature: GYAE6OF02FLVJA.24.87.H10.1.454.CMB.1.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (413)..(413): a, c, t, g, unknown or other
  misc_feature (413)..(413): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagagaccaccggagaaattgtgttgacacagtctccaggcaccctgtctttgtctccgaggggagagacgcccaccctctcctgcagggccagccggagtgttagtaagtacttaggctggtaccaacagaaacctggccaggcctcccgaggcctcctnatctatgatgtcctccaacgngggtccacgtcgggcccgtccccgcgtaggttcaggtcggctaggtgggtctgggacacggtacttcactctacgaccgtcaagcagcctagacnccgtagtaagtattttcgacggttttactacgtgtacagtcgacgtccgttccgccgttcggcccgtacgttaccggtttcggggaccgggggtaccgaggggtggaggagggacgacggtacgtggtggctcgacaccgtagtctacgttcttcgacttccgtcccgactacgtcgtacgtacgtattacgg

SEQ ID NO: 219746 - DNA, 536 bp, Homo sapiens
  misc_feature: GYAE6OF02H8AAE.24.87.H10.1.454.CMB.1.raw
  modified_base (203)..(203): a, c, t, g, unknown or other
  misc_feature (203)..(203): n is a, c, g, or t
  modified_base (516)..(516): a, c, t, g, unknown or other
  misc_feature (516)..(516): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctccaggctcctcctctatgcctgtcctccaccacgggtcccctggtcgtcccagcctaggttcgttggcggtgggtctggggacaggtatttcgactctcactactcgacgtccggtcctccacgtctgtaagtatttgctactttatttctgtacaactactatggtgtacgtcgtccttccgtactacttttcggacgacgggtaccaacgtgagatacaactactgtgctgctacntctcgtcttcactctcctac

SEQ ID NO: 219747 - DNA, 835 bp, Homo sapiens
  misc_feature: GYAE6OF02JHPCB.24.87.H10.1.454.CMB.1.raw
tcagactactatgtcacgaccggtgctcgatttagcagtactgcgttggggtttgggggaggaactgctcagttaggacccagaccggaaccatggaagccccagcgcgagcttctcttcctcctgctactctggcctcccagataccacgtggagaagtgtcgtatgacgcagttctaccagccacctgtctggtgtctaccgaggggaagacgtccaccgtcgtccgtggcgacggccgagtgagtaacttggtcgacgacgactaacgttcgccgaggttaccacgacgaacggtaaaccttcggaccgtaggtaccgtaccgtaggtcctccgtaccttcgttacgttcgacctttcggcccgttacccgacccggaaccgggtccccttgggtcccggttaacccgtcggacccggttaacgggtttcgggttaccgggccgggttacggggtacgtacgggtaacgtaagtttacgtttcgtaccgttactccgactaacgtccgaacggtccgtaccgacgtaaccgttcgtacggtaacgttcgtttaacgtcgttaactttacggttcctacggttaacctacgttaacgttcgttagttacgtacgttaccggtacccgtttaccgttaccgttaccggttttaccgggaaccggttaccggggtaaaccgttaccgggtacggttaacgttaacgttaaacccggtaaccggtttaaccgtaacgggttccggtacgttaccgggtaacccttaaccgtttaaccggtcttttaaccgggtaccttttacccgggtaacccttttcccggtcccccgtttaacg

SEQ ID NO: 219748 - DNA, 714 bp, Homo sapiens
  misc_feature: GYAE6OF02FZHVX.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctccaggctctcctctatgctgtctccaccacgggcccctggtctcccagccgtacggttcgtgggtcggtggggtcgtcggggactggtactttcacgttctaccgacctagtccgacggccggtaccctccgacgttcctaggtaaagttactttttacggacctttacttttacttttccgttcgttacctaaactactttagttcgggttacgttaccgttcgggttacccttcccggttaacctttaccggttttttaccgggacccggttaaacggggggtaaaccccttaaaaccgggttacgggtaacggtaacgttaaccgaaaccggtaaccgttcgggttacgggtaccgttaccggaacccttaacccgtaacgttcccgttacgtttccctttacctaacccgtttcccttccccccgtacccg

SEQ ID NO: 219749 - DNA, 751 bp, Homo sapiens
  misc_feature: GYAE6OF02IALER.24.87.H10.1.454.CMB.1.raw
  modified_base (208)..(208): a, c, t, g, unknown or other
  misc_feature (208)..(208): n is a, c, g, or t
  modified_base (341)..(341): a, c, t, g, unknown or other
  misc_feature (341)..(341): n is a, c, g, or t
  modified_base (380)..(380): a, c, t, g, unknown or other
  misc_feature (380)..(380): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgctagtctccagcccaccctgtctgtgtcctccgaaggggaaancgcccaccctctccgtgccgacgggccaggtgaagtaagttggtacgggcaggacctaacgtttacgccgtacggtaccgagacgaacgtaaaccgtcggaccgaggcctacccgagcctaccctcctcttangtccttcgcctccgaccgacgggcccctggtcgtacccncgccgtggttcgtgggacggtcggtcgtcggactaggttctacacgttcgtacacctagtccgacggtcccgtcgtaccgtacgtccgtaagtacgttactttcgtcgttacttttacgttcttacgttacaaacgttactacggttacggtacgttacgtccggttacccgtttaccggtttaaccgtttaccggtttttaccgggaacccgggttaacggggaaaccccgttaaaacgggttacgggaaaccgttaacgttaaacccgttaaaccggtaacggtttacgggtaacggtacccgttacgtaaccgacccgttacttccgttacgttacccgtttcttaacccgttcccgtaccccctacg

SEQ ID NO: 219750 - DNA, 549 bp, Homo sapiens
  misc_feature: GYAE6OF02I2V72.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttgcctggtaccagcagaaacctggccaggctcccaggctcctctctatgctgtctccaccagggcccctggtcgtcccagccaggttcgtggcggtgggtctgggcagatttcactctcaccatcagccggcctccagtctgaagtatttgctactttatttcttgttcctaactacttatggttagtctgggtccttccgtactaccgttttggccgtacggggacctaaacgtggaagactacgaacgacgtaggtcggtctgtaccaccgtattctgttccttcacttcctcccgtacc

SEQ ID NO: 219751 - DNA, 603 bp, Homo sapiens
  misc_feature: GYAE6OF02I5472.24.87.H10.1.454.CMB.1.raw
  modified_base (203)..(203): a, c, t, g, unknown or other
  misc_feature (203)..(203): n is a, c, g, or t
  modified_base (382)..(382): a, c, t, g, unknown or other
  misc_feature (382)..(382): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttgcctggtaccagcagaaacctggccaggcctcccgaggtcctcctcctctatgctcgtcctcccaccgacgggtcccctggtctccagccgtaggttcgtggcggtgggtctgggacagtacttcactctcaccntcacggtccgtcctcacgtctagtaagtagtttcgacttactttatttctcgtactaactacttagtcggtgtaccgtcggtcccttacgttaccgttacgttttcggaccggtaacgggtaacctaaacggtcggaacgtactacgaacgtacgtcggtggtccgtacgtcctaccgtacgttcgttcgttccttacgtaccttcccttaccctaacccg

SEQ ID NO: 219752 - DNA, 602 bp, Homo sapiens
  misc_feature: GYAE6OF02HMRVD.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttagcctggtaccagcagaaacctggccaggctcccagctcctctctatgctgtcctccaccgacgggcccctggtcgtcccagccgtagggttcggttggcgggtgggttcgtgggacagtactttcgacttctaccaccatcgacgccggcctccagtctagaagtatttcgtcttactttatttctgtacaactactagttggtgtactcggtcctacgtaccgttacgttttcggaccgtaacggggaacctaacggtaggacgtaatacgaaacgtacgttcggttagggttcgaccgtaaccttacgtcgttcgttccttacgtaccttcccgttaccccgaccttacg

SEQ ID NO: 219753 - DNA, 1048 bp, Homo sapiens
  misc_feature: GYAE6OF02IRO3X.24.87.H10.1.454.CMB.1.raw
  modified_base (231)..(231): a, c, t, g, unknown or other
  misc_feature (231)..(231): n is a, c, g, or t
tcagactactatgtcacgaccggtgctcgatttagcagtactgcgtttggggtttgggggagggaactggctccacgttagggtaccccagacggtaaccatggtaaggccccaagccgcagccttctcttcctcctgctactctggctcccgagtagtaccactggagaaggttacgtctatcgtacgtcgtagtcctcagccgacctgtctgtgtctccgagggaacgnggccacccttcgtcctgccgtcggggcccagtgagatcgttggcacgctaacttacgccgttaggtaccagccaagtaaaccttggaccaggtcctcccgaggccttcccgttccctctaagtcgtccgtaggtccgttaccgaccgtaacgggtcccccgttgggtacccgttacccacggtacccgtacgggtttacggttacggggtcggttacggggttaccgttaggggaacctaaggttaacttttcggaaccttacccgtacctacctaagttaccggtaccggtcccgggtaccctttcccggtaaccgtttccgttaacgggtaaacgtttaacgttttccgggtaacctttaaaccgttttttaacgttttacccgttaacgtttacccgttaaaaccgttacccgttttaacggtttaccgggtttaaccgtaaacccgggttttcccggggtaacccccgttttaacccgggtttaaaccccgttttaacccgggtttttttacccggggggaccccgggttttaaaaccggggggttaaaccccccgggttaaaaaaccggtttacccgggggtaaaaccggggttaacccgtttttaaaaccccgggtaaaaacgggtttaaaaccccgggttttttaacggggtacccgggggtttaaacccggttaaccgggggtaacccctaaaccccggggttttaacgtttaaccccgggtttttaacggggtttttaaccccgtttttaaacccgggtacccggggtttttacccccgtttaacccccggggggtttaaaccccccg

SEQ ID NO: 219754 - DNA, 577 bp, Homo sapiens
  misc_feature: GYAE6OF02HVPSQ.24.87.H10.1.454.CMB.1.raw
  modified_base (202)..(202): a, c, t, g, unknown or other
  misc_feature (202)..(202): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctccgaggggaangccacctctcctgcagggccagtgagatgtggcagcaacttagcctggtaccagcaagaacctggccaggctccagcctcctctctatgctgtctccaccacgggccctggtcgtcccagtccgtaggttcgtgggcggtgggtcgtgggactagtactttcactctcaccatcgagccggcctccgagtcgtagtaagtntttgacttactttattcgttntacgtaactacttagttggtagtacgtcggtccttccgttacgttacgttttcggaccggtacgggtaacctaacggtggaacgtacgtacgaacgtacgtcggtcggactgacctacctatcgttacttccttactcttcccgttccgtacc

SEQ ID NO: 219755 - DNA, 637 bp, Homo sapiens
  misc_feature: GYAE6OF02HATYX.24.87.H10.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (312)..(312): a, c, t, g, unknown or other
  misc_feature (312)..(312): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccaccggagaaattgtgttgacacagtctccaggcaccctgtctttgtctccagggganagagccaccctctcctgcagggccagccggagtgttagtaagtacttaggctggtaccaanagaaacctggccaggctcccaggctcctcatctatgatcgtctccaacgngggtcacgtcggccgtccccgctagggttcaggtcgcgtaggtggtcgtgggacagtaccttcacttctaccgaccgtcagcacgaccttagacgccgtaggtaagtacgttttcggacgttttactacgttgtacgagtacgtacgtccgttaccgtccgttcggcccgttcgttaaccggtttccggggacgggggtaccgtaggggtagggacgggacgggtaggaaccggtacgttgggtcggtacgtccgaccgaccgtacgtccgtttgttaccttcgtacgttcctttcccgacctactccgtacgtactagttacgg

SEQ ID NO: 219756 - DNA, 798 bp, Homo sapiens
  misc_feature: GYAE6OF02F6LAT.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaangcccaccctctcctgcgacgggccagtgagaatggttggcagcctaacttacgcctaggtaccagcacgaaacctggccaggcctcccgaggccctccctcctctatcgcctcgtccctcccgacccggtaccgggtcccccgttgggtcccgtaccccgacggtcccggttaggggtttccgggttcggggtccggggtttcgggggttaccggtcggggggtaacctaacgggtttaccgtttttacccgacccgtttacccgtaccgttaaaccccgcgtttaccggaaccgggtccccggggtacccctttacccggtaaggtttacgttaacgggtaaagttttacctttttcggtaaccttttaacgtttttacgttttcccgtacggttaaccttaaacgtacgttttacggtcgggttacgtaccgttccggtcccctttaccggttacctttaccggttttcgggacccggtaacggggtaaacccttaaagtcgggtaactaaccgtaaccgtaaacggttcggtcgtacggtctacgacctacgtacttcgtacttccgtactctttaccccgtccgtacc

SEQ ID NO: 219757 - DNA, 744 bp, Homo sapiens
  misc_feature: GYAE6OF02HL27O.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaancgccaccctctcctgcagggccagtgagaatgttggcagcaacttgcctggtaccagcaagaacctggccaggctcccgaggcctccctcctctatcgtctcgtcctcccgaccgaccggggtccccttgggtccgtaccccgaggtccccgtaggggtttccggttcggggtccgggttcggggtcgtacgggggactaggttactttccgacgttcctacctaaccctacgtccgaacgggtcccggtccctacccgtacgttccgtacggtaaacgttacgttttacggtacctttaacttttacgtttaccgttacgtaccttaaacctacgttagtacgggttacgtaccgttccgggttacccttaccggttaccgttaccggttttacgggacccgggtaacgggggtaaccctaaacgggtacgggaacgtaacgtaaccgtaaacgggtaacgttacgggtacggtaccgttacggtacctaaccgtagttccgttacgttcctttaccaccgtttccctacccggtacc

SEQ ID NO: 219758 - DNA, 626 bp, Homo sapiens
  misc_feature: GYAE6OF02JEUUL.24.87.H10.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaacctggccaggctcccaggcctcctcctntatgctcgtcctccaccgacgggcccctggtcgtccccagcccgtaggttccgttgggccggttgggtctggggacaggtactttcactctccacctatccgaggtccgccctccacgtctagaacggttattttcgaccttacgttttatttccgttacgttacctaaaccttacttaagttgggttacgtacgtcggtcccttccggttaccttacgttttcggaccgtaacggggtaacctaaacggtggagtaactacgtaacgtaacgtggtacggtcgtacgaccgtacctacgttcgtcttccttctacttcccgttcccgtaccc

SEQ ID NO: 219759 - DNA, 711 bp, Homo sapiens
  misc_feature: GYAE6OF02I9DBO.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgcccacctctcctgcagggccagtgagatgttggcagcaacttagccgtaggtaccagcaagaaccgtggccaggcctcccgaggcctccctccgtctagtcgcctcgtacctcccgaccgaccggggtcccctgggtccgtccccaggtccccgtagggtttccggtggggaccgggttcggggtaccgtggggtaacgtacggtttactttccaccgtcctacccaccgtactccggacggcccggtccctccgtacgtccgtacggtaaacgttacgttttcgtaccgttaacttttctttacgttcgttacgtaaactaacgttacgttcggttacgtacgttccggtccgtttcccgttaaccgtttcggttttaccggaccggtaccgggtaacctaacggttcggaacgtacgtaaccgaacggttaacgtcggtcggtacctacggccgtaccgtacgttccgttacgttccttacgtacccgttccgtcccgtaccc

SEQ ID NO: 219760 - DNA, 749 bp, Homo sapiens
  misc_feature: GYAE6OF02JJI9C.24.87.H10.1.454.CMB.1.raw
  modified_base (200)..(200): a, c, t, g, unknown or other
  misc_feature (200)..(200): n is a, c, g, or t
  modified_base (277)..(277): a, c, t, g, unknown or other
  misc_feature (277)..(277): n is a, c, g, or t
tcagactactatgtcacgaccggtgctcgatttagcagtactgcgttgggtttgggggaggaactgctcagttaggaccagacggaaccatggaagcccagcgcagcttctcttcctcctgctactctggctcccagataccactggagaagtagtcatgacgcagtctccagccacctgtctgtgtctccgaggggaanacgccacctctcctgcagggccagtgagaatgtggcagcacttgcctggtaccagcaagaacctggccaggctccgngcctctacctctgctgtctccaccacgggcccctggtcgtcccgagtccccagggttccgttgggtccgtggggtcctgggggacagacgtttcactctccgactatccgagtccggcctcccgtacgtactcggtaacgtaacgttttcggtacttaccgttttacgttttacctttacggtttaccttaaaccggtactttaacggttacgggtttacggtaaccgttcgggttccccgttacccggttaaaccgttcccggttttttacggggttaccccgtaaccgggggggttaaccctaaaaccgggttaccgggaaacggttaaccgttaaccgtaaaacccgggtaaccggttaacgggttaccggggttaaccgtttcgggacccgttaaccgtaccgttacgtttcccggttaaccttttcccgttaacgttttcccgtttacccccggtaccttaacccgg

SEQ ID NO: 219761 - DNA, 678 bp, Homo sapiens
  misc_feature: GYAE6OF02HJ97L.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangcccacctctcctgcagggccagtgagatgtgcagcaacttgcctggtaccagcagaaacctggccaggctcccaggcctcctcctctatcgctgtcctccaccgacgggtcccctggtcgtccccagtcccgtagggttccgttgggcggttggggtctggggaccaggtactttcgacttcgtccacccgtattccgacggcccggtaccttacccgtacgttccgttacggtaaacgttacgtttttcgaccgtttactttttactttccgtttacgttacctaaaccttaccttaacgttgggttacgtaccgtcggtacccgttccggttaaccttacgtttttcgggacccgtaacggggtaaccctaaaccggtggaacgtactaaccgaaacgtaccgttaggtcggtactacggacctaccgtattcgttacggttccttaccgtacttcccgttaccccgtacc

SEQ ID NO: 219762 - DNA, 567 bp, Homo sapiens
  misc_feature: GYAE6OF02GJL01.24.87.H10.1.454.CMB.1.raw
  modified_base (206)..(206): a, c, t, g, unknown or other
  misc_feature (206)..(206): n is a, c, g, or t
  modified_base (317)..(317): a, c, t, g, unknown or other
  misc_feature (317)..(317): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (479)..(479): a, c, t, g, unknown or other
  misc_feature (479)..(479): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaagngccacctctcctgcagggccagtgagaatggttgcagcaacttagcctggtaccagcaagaaacctggccaggcctcccaggctcctcatctagtggcgcgtcccaaccgngggcccacgtcggcgtcgacggactaggttcaggtcggcagggttcggtcgtttcggggactaggtactttcgactctacatcagtcgacagacgtggacgccgtaagtntttgactagtnttattacgtgtctagtctttgtttcgtcccttctccttctntcgttactacgtttcgaccgtaggttccgaggtcgtaggactatacgaaggtccgtacgtcggtcgtacgtcgacctaccgtattccg

SEQ ID NO: 219763 - DNA, 631 bp, Homo sapiens
  misc_feature: GYAE6OF02GN1UR.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttgcagcaacttagcctggtaccagacacgaaaccgtcggccaggctcccgaggcctcctcctctactgctcgtcctccgaccgacgggtccccgtggtccgtcccgacgccgtacggttcggttggtcggtgggtcgtgggacagtattcactctacactactcgacgtccgcctccgacgtctagaacgtttacgtttcgacttacttttacttcgtagttacaactacttagtgttcgactcggtcccttacgttacttaccggttttcggaccgtaacgggtacctaaacggttcggaagtaacgtaaccgtaaacgtacgtcggtacggtacttacgacccgaaccttcggtacttcggttaccttacgtacctttccctacccgtaccg

SEQ ID NO: 219764 - DNA, 634 bp, Homo sapiens
  misc_feature: GYAE6OF02GDIAP.24.87.H10.1.454.CMB.1.raw
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (351)..(351): a, c, t, g, unknown or other
  misc_feature (351)..(351): n is a, c, g, or t
tcagactactatgtcacgaccggtgctcgatttagcagtactgcgtttggggtttgggggaggaactgctcagttaggacccagaccggaaccatggaagcccctagcgcagcttctcttcctcctgctactctggcctcccagataccacgtggagaagtagtctatgacgctagttctccagcccacctgtctgtgtctccgaggggaaagngtccacccgtntccgtgccgagggccagtgagaatcgttggacagccaacttgcctggtaccagcagaacctgccaggctccaggctccgtcctctagtcgctcgtcctccgaccgacgggcccctggtcgtcccgngcccaggttcgtacggcggtggtcgtaggaactagtattcgactctacgacctagtcgtacgccggtcctccgtagtctagaacgtatttcgacttactttagttactcgttacaacgtacttagtcgtacgtaccgtcggtaccctaccgtaccgttacgtttacggaccggtacgggaaccgtaaccgtgggtaaccgtataccgtaacgtacgtaggttcggacgtacgacctaccgtacgtcgttacgttccttacgtactttcccgtacccgtacccg

SEQ ID NO: 219765 - DNA, 723 bp, Homo sapiens
  misc_feature: GYAE6OF02G8MU3.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttgcctggtaccagcagaaacctggccaggcctcccgaggcctccgtcctctatcgtcttcgtcctccgaccgtacgggccccttgggtccgtcccgagtccgtagggtttcgttgggcggttcgggtcgtcggggactaggtactttcacttcctactacccgagttccgaccgggccgggtaccctcccgtaacggttccgttaggtaaacggtttgtttttacggtacctttaacgttttacgttttaccgttcggttacctaaacgttacgttaagttcggttagtaccgttcgggtcccttaccggttaccttacggttttcgggacccgtaacggggtaaccctaaacggtcggaacgtactaaccgtaaaccgtacgttacggtcggtaccgttacggacccgtaccgtaagtttcccgtttaccggtttcctttacccgttacctttaccccggttaccccgtaaccccg

SEQ ID NO: 219766 - DNA, 837 bp, Homo sapiens
  misc_feature: GYAE6OF02HE7S9.24.87.H10.1.454.CMB.1.raw
tcagactactatgtcacgaccggtgctcgatttagcagtactgcgttgggtttgggggaggaactgcgtcagttaggacccagacggaaccatggaagccccagcgcagcttctcttcctcctgctactctggctcccagataccactggagaagtagtcatgacgcagtctccagccacctgtctgtgtctccgaggggaaagcgccaccctctcctgcgacgggccagtgagaagttggttaggcgagacctaaacgttacgccgtggtacccagacgaacgtaaaccgtcggccgacggccctacccgacggtccttccccgtcctacgtactcgtcctcgtcctacccgacccggtaccgggtccccgttgggtcccgtcccgacggtcccggttacggggtttccggttcggggtccggggttcggggtccggtacgggtaccgtacggtttactttaccgtaccttccgtacccgaccttacgtccgtacgggtccccggtacccgtttcccgacggtttaccgtaaggttaacgtttacgttttacggtaccttttaaccgttttacgtttccgtaccgttaacctaaccgtttacgtttaggtcggttaaccgtaccggtttccggtacccgtttccgttaacccgtttcggttttaccggaacccgtttagggtaaccccggtaaccgtaaacggtacgggtaaacgttaaccgtaaccggtaaccggtacggtttcggtaccgggttacccgtacggaaccccttaacgtccgttttacccggttacgtttaccccgtttacttacccgtttcccccgttaccccgg

SEQ ID NO: 219767 - DNA, 654 bp, Homo sapiens
  misc_feature: GYAE6OF02HS0XT.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttgcctggtaccagcagaacctggccaggcctcccaggcctcctcctctatcgctgtcctccaccgacgggcccctggtcgtcccgagccctagggttccgttgggcgggttcgggttcgtagggactaggtacttttcgaccgttctaccgaccctaagtccgacggcccgtcccgtccgtacggtcctaggtaacgtagttttcgacttactttactttcttagttacctaacctacgttacgttggttacgtaccgtcggtacccgttaccgttaccttaccggttttcggacccgtaacggggtaacctaaacggtggaacgtactaaccgaacgtacgttaggtcgtacgtcggacctaccgtagttccttcgttcgttacctacttcccgttacccgtaccg

SEQ ID NO: 219768 - DNA, 700 bp, Homo sapiens
  misc_feature: GYAE6OF02JQ5SC.24.87.H10.1.454.CMB.1.raw
  modified_base (205)..(205): a, c, t, g, unknown or other
  misc_feature (205)..(205): n is a, c, g, or t
  modified_base (245)..(245): a, c, t, g, unknown or other
  misc_feature (245)..(245): n is a, c, g, or t
  modified_base (698)..(698): a, c, t, g, unknown or other
  misc_feature (698)..(698): n is a, c, g, or t
tcagactactatgtcacgaccggtgctcgatttagcagtactgcgttgggtttgggggagggaacgtgctcagttaggacccagacggaaccatggaagccccagcgcagctctcttcctcctgctactctggctcccagataccactggagaagtagtcatgacgcagtctccagccaccctgtctgtgctaccgaggggaaancgcccacctctcctgcgacgggccagtgagaactgtggcngcaattcgctgtacagacacgaacctggccaggcctccgaggtcctcctcctactgtcgtcttcgtacctcccgaacccggtcgggtccccctggggtccctaccccacgggtccgttacgggtttccggttggggtccgggtcggggttcccgtagggggaacctagggttactttacccgaccggttcctaccgacccgttagtccccggaagggttccccggcccgttaccgacggttacggtaacggtacggttaacgttttccgtactttaccgtttttaattcccttacggttacctaactaccgttaagtcggtataccgtcgtacccttaccgtacttacgtttcggaacctacgggtaacaacggtgtaacgacgttaacaaccgttagcggtacgctacggtaccactacgttcgttcgtacctactacgttcccgttacccncg

SEQ ID NO: 219769 - DNA, 649 bp, Homo sapiens
  misc_feature: GYAE6OF02JZKUX.24.87.H10.1.454.CMB.1.raw
  modified_base (189)..(189): a, c, t, g, unknown or other
  misc_feature (189)..(189): n is a, c, g, or t
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtntcctccgaggggaaancgcccacccctctcctgcgagggccagtgagaatgtggcagctactgcctgtaccagcagaacctgccaggctccgagctctctcntgctntcctcaccgcgtccctgcgtccngcctaggtcgtcggcggtcggtcgtgggacctagtcgtttccgactccgtacacgtactccgacggtccggtccctaccgtacgtccgtagtaacgttacgttttcgtacctttacgttttacgttccttagtaccttaaccggtacttaacggttcggtaacgtccgtacggtcccgttaccgttaccgttaccgtttcggaccggtaccgggtaactaaccgtaggtaactaacgtaaccaacggtacgtttacggcggttacgtacgtaccggtaacctagttaccggtttacgttacctttacgacctttaccccgtccctacccg

SEQ ID NO: 219770 - DNA, 686 bp, Homo sapiens
  misc_feature: GYAE6OF02GKEQT.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcgagggccagtgagaatgttggcagcaacttgcctggtaccagcaagaaaccgtggccaggcctacccgaggccttccctcctctatcgtctcgtcctcccgacccgtacgggtccccctgggtccgtccccgagtcccgtagggtttccggttggggccgggttgggttcggtaggggtacctaggttactttccgacgttccgtacctacccgactcgacggcccggtcctacccgtacgttacgtaggtaacgttacgttttgtacctttacttttactttcgttacgttacctaaccttaagttacgttaggtcgtaccgtcggtcccttaccgttacgttaccgtttcggaccggtacggggtaacctaacggtggtaacgaactaccgtaacgacgtcggtacgtactacgacctaccgtagttaccttcggttacccttctaccttcccgtcccgtaaccc

SEQ ID NO: 219771 - DNA, 552 bp, Homo sapiens
  misc_feature: GYAE6OF02F4M8D.24.87.H10.1.454.CMB.1.raw
  modified_base (203)..(203): a, c, t, g, unknown or other
  misc_feature (203)..(203): n is a, c, g, or t
  modified_base (527)..(527): a, c, t, g, unknown or other
  misc_feature (527)..(527): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccacctctcctgccagggccagtgagaatgttggcagcaacttgcctggtaccagcagaacctggccaggctccaggctccgtctctatgctgtcctccaccgacgggccctggtcgtcccacgccgtaggttcgtcggcggttcgggtcgtgggacagtactttcactctcactatcgacgcgtctccgacgtctagaagtatttgcttactttacttctacgtactaactacttagtcgtacgactcggtcctccgttactcgtttacgccgtacggactaacgtgagtactacgaacgtacgtcgtggtctacgctactntcgtcgtcctctactactcccgtac

SEQ ID NO: 219772 - DNA, 627 bp, Homo sapiens
  misc_feature: GYAE6OF02J1GDA.24.87.H10.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtcctgtgtctccgaggggaaangccaccctcncctgcagggccagtcagagtatagagcaactcttagcctgtatcaacagaacctggaccaggctacccaggcctcctacatctatggtatctaccgagccgaagggccaacgtggtcgtacccgagccgtaggttccaggttcggcaggttcgggctagggactaggtacgttcacctcgtacacacgtcagtcgtacgtcgtcgcgtacgtcgtaggtaagtagttttacgacgttacgtttacttacgtacgtacctacgacgtacgacgtacgtagtacgtacgttcgggacctacgttccgtacgtttaccgggacggtacgggtaccggtaacgggtacggaacgtaacgtaaccgtaaaccggtaacgttacggtacggtacgttaccggaccgtaccgttaacgg

SEQ ID NO: 219773 - DNA, 632 bp, Homo sapiens
  misc_feature: GYAE6OF02F2LG6.24.87.H10.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctntcctgcagggccagtnagaatgtggcagcaattagcctggtaccagcagaacctggccaggcctcccaggcctcctcctctatgctgtcctccaccgacgggcccctgggtccgtccccgagcccgtaggtttccggttcgggtcgggttgggtcgtgggacaggtattcactctacacctatcgacgccggtcctccgtacggtctaggtaagtagttttcgcttacttttatttctacggttactaaaccgtactttagttcgggtacgtacgttcggtcccttaccgtaacttaccgttttcggaccggacggggtaaccctaaacggtggaacgtaactaccgaacgtaccgtgggtacggactacggtacctacccgtattccgtcgttccttacgacctttcctacccgtaccc

SEQ ID NO: 219774 - DNA, 529 bp, Homo sapiens
  misc_feature: GYAE6OF02JG772.24.87.H10.1.454.CMB.1.raw
  modified_base (204)..(204): a, c, t, g, unknown or other
  misc_feature (204)..(204): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (423)..(423): a, c, t, g, unknown or other
  misc_feature (423)..(423): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagaatgttggcagcaacttagcctggtaccagcagaaacctggccaggctcccaggctcctcctctatgctgtctccaccacgggcccctggtcgtccacgccaggttcgtggcggtgggtctgggcagtnttcactctcacntcagcgcctcngtctgagtatttgctactttattctgtacactatatggtntacgtcgtccgtccgtactacgtttcgaccgacgggacctaacgtggagactacgaacgtactaggtcgactagccacatcgtcgtcttctacttcctcccgtacc

SEQ ID NO: 219775 - DNA, 868 bp, Homo sapiens
  misc_feature: GYAE6OF02JQLMW.24.87.H10.1.454.CMB.1.raw
tcagactactatgtcacgaccggtgctcgatttagcagtactgcgttgggtttgggggaggaacgtgctcagttaggaccagacggaaccatggaagcccagcgcagcttctcttcctcctgctactctggctcccagataccactggagaagtagtcatgacgcagtctccagccacctgtctgtgtctaccgaggggaaacgcgcccaccctctccgtgcgacgggcccagtggaagaagttggttacggacagtaccgtaaacctttacggccgttagggtaacccaggactaacggaaacctgggacccagggtccctacccggagggtcctacccgttcctactagtcgaccgttcggtaccctacccggacccggaccgggggtccccctttgggtaccttaccccgacggtacccgtttaacggggttttccggtttacgggggacccggggtttccggggttacccgttacggggggaaacccttagggtttaaccctttttcccggaaccgtttcccttaacccggaaccctagttacccgggtacgggtccccggtacccgtacccggtacgtttaccggtacgggtaaagtttacgttttaccgtacgtttaccgttttacgtttccggtacgttaaccgaactttaccggttacggttttccgggtacgttaccgttacggttacccgtttaccggttaacctttaccggttttcgggacccggtaacgggtaacccgtaaggtacggtaacgtacgttaaccgaaccggttacgttacgggtaccgtacgttaccggtaaccgtacgttaccgttcgttacggttcccttaaccggtcttcccgttaccccggac

SEQ ID NO: 219776 - DNA, 667 bp, Homo sapiens
  misc_feature: GYAE6OF02H2ONJ.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagagtagtcatgacgcagtctccagccaccctgtctgtgtctccgaggggaagacgccaccctctcctgcacgggccagtgagaatgttaaggagttgtagcgtggtactcaacacaaacagtcggccagccgtccccggctcctccgatctatgatgctactaccgaagtacgggccacgtggactactacccgagaccgtaggttcaaggttcggacgaggtgggtacgtaggggacaggtaccttacgaccttcgtaccaccctaagtacgacgtcgtaaggttacgtagacggtaccgttaggtaaacgtttagttttacgtcgttaaacgttttaacttacgtgttaccacggttcccgtaacgtaccgtaaccgtaaacggtcccgtacccgttaaccggttcccgttaccccggtaccggtaccgtacggacgtacccgggactacccgtaccgaacggttaccgtacgttacggacgtccgtacacccttacttccgtatccctttaccg

SEQ ID NO: 219777 - DNA, 785 bp, Homo sapiens
  misc_feature: GYAE6OF02ICFXG.24.87.H10.1.454.CMB.1.raw
  modified_base (613)..(613): a, c, t, g, unknown or other
  misc_feature (613)..(613): n is a, c, g, or t
tcagactactatgtcacgaccggtgctcgatttagcagtactgcgttgggtttgggggaggaactgctcagttaggacccaaacggaaccatggaagccccagcgcagcttctcttcctcctgctactctggctcccagataccactggagaagtagtcatgacgcagtctccagcccacccgtgtctgtcgtcctacggaaggggaaagacgccctaccctctccgtgacgacgggcctagtgaagtatggttcggacagactaacgttcgccgttaggaccagacaacggtaacctcgggaccgacggtaccacccggaggtcccttccctaccgtacctagtcgtccttcgtaccctaccgacccggtaccgggtccccttgggttacccgccccgaacggtccccggttacggggttttcgggtccggggttccgggggttacgggtacgttacggggaaccgtaaggttcctttttaccgaccgtttaccgtacccaaccgtacgttaccgaccgggtccggtacccttacggacgtttacgtacggttaacgttacgtttcggtacttttaacttttacgtttccgtacgtacaaactacgtttagngttacgtcgtcggtccctttaccgtaacgtttccgtttcgggaaccggtaccggtaaaccttaagtacgggtaactaaccgtaacgtaaacgtcgttacgggtccgtacgtaccgaccgtacctgtttacccgtactttacccgtacttccccgttcgttaccccagtaccg

SEQ ID NO: 219778 - DNA, 538 bp, Homo sapiens
  misc_feature: GYAE6OF02FIL4T.24.87.H10.1.454.CMB.1.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtataagagcaactacttagcctggtatcaacagaaacctggccaggcctcccaggcctcctcatctatcggtatactccaggcacgggccacgtcggtcgtcccagccaggttcagtcgcaggtgggtctgggacaggtacgttcacttctcacctatcgagcagtctncgtacgtctgaagtntttgacttagtttattactgcctagcagcactagtgacgtggcctcgtctacgttcggacgggacggaccgtaagggtcgaggtaactacgaaacgtacgtggtacgtcgtacgacactacg

SEQ ID NO: 219779 - DNA, 686 bp, Homo sapiens
  misc_feature: GYAE6OF02FYN8U.24.87.H10.1.454.CMB.1.raw
  modified_base (203)..(203): a, c, t, g, unknown or other
  misc_feature (203)..(203): n is a, c, g, or t
  modified_base (480)..(480): a, c, t, g, unknown or other
  misc_feature (480)..(480): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangcccaccctctcctgcagggccagtgagaatgtggcagacaacttagcctggtaccagcaacgaaacctggaccaggcctcccaggctcctcctctatgctcgtcctccaccgacggcccctggttccgtcccaggtcctacggttccggttcgggtcgggttcggggtcgtaggggactacggtatttccgacttccgtacaaccctatccacgggccgtcccttaccgacgttcgtacggaacgttatttttcggacctttactttacttttccncggtttaaccaaactacgttaatcgggttacgtaccgtacggttcccttacggtaacctttacgttttcggaccgtaacgggggtaaccctaaacggtgggtaactacgtaacctaacggtaaccgttacggttggaccttacggaccctaaccgtaagttccgttacggtttaacccttccgtacttcccggttccccgtacccg

SEQ ID NO: 219780 - DNA, 546 bp, Homo sapiens
  misc_feature: GYAE6OF02IIQQV.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggagggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctccaggctcctctcctatgctgtcctccaccgacgggcccctggtcgcccagccgaggttcgtggcggtgggtctggggacagtatttcacttctacacatcacgccggtcctcacgtctgtaagtatttgctactttatttctgtactaactactatggtcgtactcggtcctccgtactacgttttcgccgtacgggacctaaacgtggaacgtactacgaacgaacgtaggtgctgacacatctgtctactactcctcccgtcc

SEQ ID NO: 219781 - DNA, 588 bp, Homo sapiens
  misc_feature: GYAE6OF02HD5AD.24.87.H10.1.454.CMB.1.raw
  modified_base (202)..(202): a, c, t, g, unknown or other
  misc_feature (202)..(202): n is a, c, g, or t
  modified_base (364)..(364): a, c, t, g, unknown or other
  misc_feature (364)..(364): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaanagccacctctcctgcagggccagtgagaatgttggcagcaacttagcctggtaccagcagaaacctggccaggcctcccaggcctccctcctctatcgctgtcctccaccgacgggtcccctggtctcccagccgtaggttcgtggcggtgggtctgggacngtattcactctcaccatcacggccgcctccgacgtctagtaagtatttcgcttactttatttctacgtactaactacttagttgtcgtacgtcggtcccttaccgttacgttacgttttcggccggtaacggggaacctaaacggtggaacgtacgtaacgaacgtacgtaggtcggctacgactaccgtattcttacgttccttactacttcccgtccctacc
